United States Patent 10,233,495 (METHODS AND COMPOSITIONS FOR SCREENING AND TREATING DEVELOPMENTAL DISORDERS) - sequence listing, part 62

SEQ ID NO: 552 - DNA, 5375445 bp, Homo sapiens (residues 3,583,631-5,375,445 of 5,375,445)
  misc_feature (865621)..(1125620): n is a, c, g, or t
ttaatccttaaggtatttagcaagtaattatttagtgactacattcaacagtgaggatagcctggattttgctgcagtagcaaacaaatctgaaatgtaagttgctgacacacaggttatttcacactcaaataatacgcctattaaagcaactggtggctctgttctatgtcttccttacttagaaacacaagcctccagcatccacagcagttctggccaataggtctttctgtaatgatggaaatggcctatatctgcactgcccgaaatggtacccactagtcacaggtggcaattgagtatttcaaatgcagctaatgtgactgaggaactgaatttttactttatttaattttaattagtataaataacaacaatcaaaaattggccactggctactatacagaacaaggcagattcagaacatcatgtgttgctaggccagggagagagaagcgtggacatttatatactgatgctaaaaatcttctacccagaagtaataatcatcatgccctttcacattcaatgggtgaaagtaaatcatgtgtccacatggagcttccacgggtcaagtagagcagtcctaccttgatctcatagaaggagaataaaaagtctcagtaagtagctttagtgaattacacaccacccccctgttcagggttctacatattaagtgtgaaataaaatagacctgcatcctgccctcaaggagcttagagtctaatagggaaggaagggtggagacgatcattaaaaatacacaaatatatgacagcaaacctttaaggcagaaaaactcttttggaaatcaaggcttgtagtttaaacagggaattaggaaagacttctatgaaaatgtgatctaaataatgagaatgaagtggcacagagtgaggtaaaggatattccagacaaaagcatgtgtgaaggctccagatttgggaagcacctggtggtatcttctgggtagtaaaggaaggccctgctggatggagtgtagacctagggagaagaatggcacagtgaatgcaggcagagcaagggccaagtcatatgcaaccctgtgagctctggtgggagtgtagagatggcttccatcaaagggaagccattagaaagtttgatgcaaggagaaacatgatttcatgcacagtgttgaaaaatcaccccagctgctgcctggacaagggtttggagaggataagagagaagtgggaaagctttcctctggcaagtctcctatattctattgctgctactactacaatcttcgtggcttaaaacaacacccatttatgacctcacagtttccatgggtggggagtcccagtacagtgtcactaagtcctctgctcagggtctcactaggctgcaattcaggcattggccaagctgcacacttccctggagctcagggttttcttccaagcacatgtggttgttggcagaattcagttctttttggttatgggattgaggtcccggttttcttaataggtgtcagctgggggtcattctcagcgcccacactttcttgctgtgtagccctcctgcagcatgacagttctttgagatcggcaagaaaatcagtctcttctgaacaagctgatctgcttttaagggttttcatctgattattcagacccacctaggataatctcccttttgactaactcaagacaaactgaattgagggcagccacggtggcttgtgcctataatcccagcactttggaggtcaagctggacagattgcctgagtccaggaattcaataccagcctgggcaaaacagtaaaaccctgtctctacaaaaaatacaaaaattagcaaggcatggtggtatgtgcttctagtccctgctactcaggaggctgaggcagaaggattgcttgagctcacagccaagatcatgccactgcactctcgtctgagtgacagagcaagaccctttctcaaaaaaacaaaaaactgaatggagacgttaatcacatttgcaaaatcccctcacctttgccatataacctgatcatgggagtgatattgtatttacaggtcctgctcctgtccaaggggaggggattacaaagcctgagcaccaagggacaggaaattcagggaccaccttagaattctgcctacccaatgccattcgagacataggcaaaggcaaggatttcatgaagacatcaaaagcaattgcaacaaaagcaaaaattgacaaatgtgatcttattaaagagcttctgcagagcaaaataaactatcaacagagtgaatagacaacctacagaatgggaaaccatttttgcaacctgtccatctgacaaaggtctaatattcagcatctataaagaacttaaatttacaagaaaaaaacaaccccattaaaaagtaggcaaaagacatgaacagacacttgtcaaaagaagacgttcggccgggcctggtggctcatgactataatcccagcactttgggaggcaaaggtgggtggatcataaggtcaggagtttgagaccagcctggccaacatagtgaaaccctgtctctactaaaaatacaaaaaaaaaaaattagccgggcgtggtggtgggtacctgtagtcccagttacttgggaggctgaggcaggagaatcacttgaacccgggaggtggaggttgcagtgagctgaaatcacgccactgcattccagcctgagtgacagatcatgcagccaacaaacatatgagaaaaagctcaacatcactgatcattagagaaatgcaagtcaaaaccacaatgagataccacctcacaccagtcagagtggccattttcaaaaaatcaaagcaacagatgctggcaaggttatggagaaagacatacttttatgctgtttctgggagtataaattagttcaaccattgtgaaagacagtgtgcgtccaaggcctagaggcagaaatatcatttgacctaggaatcctattattgggtatatactcaaaggaacataaatcattctattgtaaagatccatgcacacatatgttcattgcagcactattcacaatagtgaagacacggaatcaacctagaagtccatcagtgatagattaaataaagaaatgtagtacatatataccatggaatactatgcagccatgaaaaggaatgagatcatgtcctttgcagggacatagatggagatggaagccgttatcctcagcaaactaacacagtgacagaaaatcaaacacagtatgttgtcactgataagtgggagctgaatggtgagaatatatggacacaggtagaggaacaacacacactggggcctgttagagggtggttggtgggaggaagaagagcatcaagaagaatggctaatggatgctgggcttaataccgagatgatgggatgatctatgcagctaatcaccatggtacgtgtttacctctgtagcaaacctgcctgcacaccctgcacatatacccctgaacttaaaagctggagaaaaaaaaagaattctgcctttgcttgaacctgggaggcagagggtgcagtgagccgagattgtgccactgcactccaacctgggcagcagaccaataccccatctcaaaaaaaaaagaattctgcatgccacagcttttttggctttcccagctcacatagcatttgacctcctagaaccttccacaacagttattatctgtactcgagggaagaatgaaccagaagtaggcaactcttgcgcttaagaaccagttgattcgtgtgagccacaatctatcattttctgacaattcaatttgggcatatattcagttctgagagcctaattcaggctgcccagattcacaaaagactggtcagggagccagagggacataactattttttggcactaagtatagctgccagacagaccagaaccattgtgttgactgaggaaactacaggaaatatttatagagggttttggaatcagagacagggttcagtatggttgagtcccttaaccattcacagcctcagtttcttcatctttaaattggagatcattttaatcatctgcacagtgttatttgtgaggaataaatgagataacatatgtcaaaccattaacacagagtctggtacctaatacgcttgcaacaacagtagctgctattattcttatcttcctcaccagtcacagccagagttagataagtacttgttgctgtaacacagctgaaggcaggcagcttgggaagctgtccagattttctcccaagagggctccagagctgaagaaaacaagctcaccagtgtgtcactaagccactctgggccatcatttctgagtctgttaaactgagataacctccccgtctgctttcccttactggggaagtttgtggcagcaattcaaggctcttagaagaaacgtgccatagggtaataatatagtgataaataccttacatccatgtctcttgtctcctcccagggcataaaggtgttcttgcagctcttactaagatgtcttggtaacagaaccttcctgagcaatctatcattccattactttatagcctggatttgattatttattcatttagactctgctacagactgcttcataccactgagcagccactaatcaattaatgctcagttttttctgttgtcacatctgtatgttggaatggccacagtttccctgccctggacctctgaaatctcaggagtgttcttggaatcttgaagccttggtacttgccaaatattttctaacacatagtttcacgtattcccagccaaatatgatgtatcttaggatgctcttttataattgatttgcagggacttgctatgaacacagatgtgactcatttgaatccgtatatcagattgtgtttaggatgagaatattatgctgtgtctgtttcattatatgtcaaatgtcaatattaaagtttccagtaacacacacatgactcgtaaagaaaatgggaaggtattttcatatctgtgtttcagaactgaagacattaaaaaaagaattatttcttgaaaataaacacatcatggattggtagttttgaatctctgtaatatgaataaagtttataaaatcaaattacattgctgaaattatgcagaggaaatatcccaaaagagcacagaggataatattgataaaacaactctcttaataaatcacactgaaaaaaaacattcatgtggaccagaggttggcaaatatggtccaggccactgcctatttttgtaaataaagttttactggcttactgtcgcactcaattgtctacacactagccatggctgttttcttactataagtggagagttcagccattgtgatagtgactatatgacccacaaagcctaaaatattatttggtgttttgccaattaactttcctggcccctgatctagaacattagtttttaaattacctttttaaagacaaatacaaaatacattaagaatattgctaaacaccaggcacattggctcacacctgtagtcccagcacttcgtgacgccaaggcagaagaatctcatgagcccaggagctccagtccagcctgggcaacatagggagagcccatctctacataaaagtaaataattagttggtcattgtggtatgtgcctgtggtctcagctacccccgaagtaggagaatttcttgagcccaggaaattgagcctgcagtgagccatgatcatgccattgaactttagcctggtgacagagcaatactctctctctctctctcatctatatatataattaacagaaggaaatttggggaattcacaaatatgtggaccttaaacactatacttctaactaaccaagaggttaaaaaaatcacaaggaaattagaaaatactttgagaagaaggaaatgaaaacacagcataccaaaacttatgggctacaactaatgtagtcctcaaagggaaattgatagcaacaaataccaataagttttttaaagttctcaaaccaataaacttaatgttacaactcaagatgctagaaaaaaagatcaagctaaactcagtgcaaccaaagaaagaatcatgattagagctaaaataagtgaaatagaaaatagaaaaaatatagagtcatttaatgaaatcaaaagttggttcttggaaaagattaactagaacattgaaaaacacttggtttaacaaaaaaataaaagactcaacttattgaaatagggactgttactatgaaacttacagaagtaaaaaggtaaagggctttaccaaacttatttggtttgatataatctcatttatctatttttacttttattgctgtggttttgaggtattctccataaaatctttgcccacaccaatatcctgaaacatttcccctgttttcttctagtaatttcacagtttcaagtcctatgtttaagtctttaacccatttggagttgatttttgtatatggtaagtgataggagcctagtttaatttttctgcacatagatatccagttttcccagcaatatttattgaagagaccgtcatttcccgaatgaattttcttggtgccactgtcaacaatcagtgggctataaatatgtagatttatttctgagttctgtattctgttccactggcctatgtgcctatttctatgcaagtaccatgctgttttggttaccttagtatattttgaagtttgttatgtgatgtctctagctttgttctttttgctcaggattgctttggctattaaggaccttttgtggtgccatacaaattttaggattgtttttctatttctgtgaagaatctaattggtattttcatcagattgcattgagtctttagattgcttttggtagcatggtcattttcacaatattcttcccatttatgaacatgggatgtctttccattttttgtgtcctcttcaatttcttttgtcagcattttatagttttcctcatagaaatcttgctccttggagaattcctaggtattttattattttttgtagctattgtaaatggcactgctcttctcatttcattttccactagttcattgttggtatagagaaatgctactaaattttgtatgttgattttgtatcctgcaactttagtgcatttttttttttatcagttcttagagtttttggtgaggtctttggggtttctatatttaagatcatgtcatttacagacagagaccatttgactttctcctttcctatttgaatgtattttattcctttctcttgtgaaactgctctgactggggcttcagtactctgttaaatataaatggcaagagtgggcatccttttcttgttccagatcttagaggaaaagctttcaacttttccccatttagtatgatgttggcagtggtctgtcatatatagcatttaatattccttctatacctaacttcttgagagcttttatcataaagggatgttgcattttatcaaatgctttttctgcatccattgaggggatcatggggtttttgtttttaattctgtttatgtggtgaatcacatttagggatttacatatgtcaaaccatccttgcattccagggataaatcccacttgaccacggtgaatgatctttttaatgtgctgcttgatttcatttgctcatattttattaagaacttttgcatctgtgttcatcagagatattggcctgacattttcttttttgttgtgtccttgtctggtttgggtgtcaagtaatgctggcctcatagaatggatctggaagaattccctcctcttcaattttctggaagatatctatttgacatactgatttcctttcaatatatacccagtagtgagactgccgtatcatatgttttctttttaatattttaaggaatagtcatactgttttttttaagcatccatgcttatcttacagcactattcacaataacaaagatatggaatcaacttaagtgtacatcaacaaataaatggataagaaaaatgtgtgtttgtgtgtgtgtgtgtgtgtagtgaaatatcattcaggataaaaaagaataaaatcctttaatttgcagcaacatgaatcaacccagaggacattatgttaagtgaagtaagccagtcacagaaagtcaaataccatatgatcttactcatacatggaatctaaaaaaaactgatctaatagaaatagaaagtagaatggtggttaccagagactgggagtggaaggtttggggagcatagggaggcattggttaacagggacagtgttacagttaattaggaagataaattttgggtttctattgcacagtagagtgactagagttaatattgcatatttcaaactagctagaagagaggattttccatgtttttaccacacacaaaaaaaaccgataaatatttgaggtgaggtgatagagatgttaaatatgctgatttgatcattacacaatatatacatgtatcaaaacatcacactatgcttcataaatatgtacaatagcattttgtgtcaagcaaaaataaaactaaaaaaaaggtgtaaattttgatcaccttcaattaggcagtggtttcttagatatgacacctaaagccaaacatcaacaacaaaaaataggtaagttgaactttaccaaaattaaaaattttacatatcaaaggacaatattgagagagtgcaaagacagcccacaaaatgggagaaaatatttgcaaatcacatatctgataagactttaatatccagaatatataaagaacacttatatgtcaacaataaaaagacaaccaaattttaaaatagacaaactatttgaatagacatttctccaaagaaaatatacaaatggccaatagacacatgaaaatgtacttacatccttagtcattagagaaatgcaaataaaatcagtgagataccacttcacactcactagaagagatatgattttaaaaatttaaaatgaggatatggagaaattggaaccctaatacattgctagtgagaatgtaaaatggtgcaggtattttggaaaacatctggcaatttctcaaaaagttaaaaatagatttagcatatgatttagccattcaaatattaggtatatgcccaagagaattgaaaacataggttcacacaaaaatttgtgtgaatacacattcatagcagcatcatttataatagtcaaaaactggaaacaacccaaaagtcggtcaactaatgggtggataaacaaaatctggtatagccatacaatggaatatactaataaatcagccataaaaagaatgaagtgctaatacattctgcaacatggatgaacctagaaaatattgctaagtgaaagaaacttaacacaaaggaccacatattgtatgatcccacttatactaattgttcagaataggcaaacctatagaggcagaaagtatattagtgagaaagtatattagtggggaatgtggcatgactctaagtgggcatggggtttcatcctagaatgaccaaaatgttccgtaattagatagtggtggtggttacagaaacttctgaatatatttttaaaaaacacactgaatggtgtattttaaaagaataaattttgcgtattggaattacatcgcagtagaaaggaaaacaaaacaaaagtaggttgttgatcagaaccaaaaccctcactgttcatttttccaagaattccatttcaagaatttgatgtcctttcccctttctcctaaacatttttcttcttggctactcactaggcaacatattaaaatcctgtggaaaacttccactcctgggaagatggaacatatgtacttttccttatttctcccaataagtacaaataaaaactctaaacaaatatgataaaagtctgagaggcagaagaaggcagactagcaaggaagttcaggatccagggaacaacttgataatgaattccctgggtttgctttctgcctcagcaaacccaggggtgctttctgggtgctgctttctgggtgctgaagaaactggcaacctaggaacaccaatggtcataaacagggaaatctctaggcccacatggtttcactagagaagactaccaaaagaattgtttaaagaaaaattaacaccaactctaaacaatctctccagaaagcagcatagaagggaagacttttcaattcattctataaagctagcattctttaataacaaaccagactaagacaatacaaaaaagggaaactacacaccagtatacacacaaagtccttaacaaaatatttacaaacagaattcagtaatataggccaagtgtacctatattacagatcacgcctgtaatcccagcactttgggaggctgaggtgggtgaatcatttgaggtcaggagttcaagaccagcctggccaacatggtgaaaccccatctctacttgaaaaaaaaaaaaatagctgggcgtggtggtacacacctgtaatcccagatacttgggaggctggggcaggagaatcacctgaacccaggaggtggaggttgcagtgagctgagatcgtgccactgcaccccagactgagtaacagagggagactgtgtctcaaaaaaaaaaatcagtaaaatataaaaagaaatatacgtcatgacaaaatgactttatgccagggatgcaaggttcttagaatattcaaatatcaataatatgagtcatcccattaacaggttaaagaagaaacatgacaagatcatttaattattgcaggaaaaagcacttgacaacattcaacacctattctaactaaaaatactcagaagaatagaaatagaggtggactttttcaatgtgataaaaagcacctataaaaaaaccctacagctcacattaaacgtaatggtaaaagattaagtgctttccccctaaatcagaaacaaggcaagaatgactgctctcaccagccttatttaaaatagaactaaaagttttagccagtgcaacaaggaaaagaaaaggcacacatatcagaaaggaagaaataaaactgcttttttcctacttcatatatagaaaatcccaaggaacctataaaaagcaacctcctagaacttataaatgagttcaataaagtctcaaggtacatgctaaacatacaaaatcaattgtatgtctgtacactaccagtgagcacataaaaattaaaaataagataccactcaaaattactccaaaaatattaaatactcaggtataaatctatccaacctatgtatgctgaaaactacacaatgctgggtgaaagcaatcagatatctaaataaatggagaaatattccatgatcatggattagaaaatacaatttagtaaacattaattgtcttaaaattattctaggattactcaacctaaataaggtttaacaatttatatcaaaatcctagcaataatttttgtagacataggcaaaactattttaaaacttatttggaaaggcaaaatagaatcacaaaaataattcttaaaaaatgaaggaatcactatcaatttcaatatttattatatagtaatcatgtctgcatgtttgatagaggggtagacacatagataaatggaacagaatagagaactcagagccacagacaagcatggcaaactgatttttgaccatggaataaaagcaattcaacgaaggaagggtagtgttttcaacagatggtattggagcaattggacatccataggcaaaaaatgaacttcaacttaaacctgacatattatacaaatagatttaaatgtaaaactataaaatgtacaggaataaaacgggagaatgtcttcaggaccagaggcttgatgaaaagttgttagccatgacacaaaaagcataatctatcaaagaaaaacatagataaattagacctcatcaaaatttaaaacttttgctctgtgaaagatcagtaaagataagacgtgtctggggaaaaaatgcaaaccacatagctcacaaatgattcataactagaatatataaagagctctcataactcaaaataaaaaacatacactgataaaggacttgtaaggatgtggagaaagcagatcacatatactttgctagcggaatgaaaaatggaccagccactctcaaaaagcttggccactaaaaacacaaacaaacaaactgaaaatacacttagatgtcgcagcagttgtacttctgggcatttatcccagagaaatgaaaaccatgtttgcacaaaacctggacatgattgttcacagcaaccttacttataatagccaaaactggaagcaatgaaaatgtgcctcagtaggtaaatggctaagcaaaaactctgtggcacatacataccatggaatgctacttagcaatcaagaggaatgaactattgacatttgccacttagacggatctcagggcattttgctgagttttttagggagatgcaaaagagagtaatggttgttaagggttggttagcaatggtgggtggcagggatggcggtgtgactgtaaagggcttaacataagggagaattttgtagtaatggaacagttctgtatgtaaaactgtatactcgtattgtatcgaggccaaattcctggttttgatattatgctactgttacgttggatgtaaccagttagctgagtgaaaggtacagagatctatctctctgtactatctttgtaacttcccaaaattatttcaaaataaaaagttaaatccaagggaaaaccattcatcctgttgggaatagattttaaatatgctattttgttaacaagtctattatttaaagagtcaactttcctgaggataatctgcctacccttcaaaatacctcagattctaatagacaaaatgtatgtttctttcagtgtcttggggctatctaggcaatgatagttcagatacagttggaggatgaaaacaggaaaatggaacctgatgccctgtagtatcttaacctcccattagatgagcacagatatattctgaatgactggatcaatttacctgtggaatacatctgatttataaaggcatctctagcaattgatctgcaccaaatcacagatatcccaaagagcagaagaaaacaaaaggaaacaaagagaaactttcttgtttcctggcccttcctattttttaatgtgaactaaagagttgatattgcttccacttgttcattgcaagactaaaacagctctaatattgcaaatgatcaaatgtctaattatatcattaggcacttttaacaacaaaggctttactttgattcagtaaatcaatatgccctagggttctcccaaagggatgccataaaatgagcttggttttataatttgtccttttaatatctatattttattcaaaatacagtcattagaactgatttgataatgctcatgatagcacaattcttactatatttctgacagaccttttcagatggaaacttaaagggagttctcctttgtcagagaaaggttgtaagaaagtagaatgaagacatttattgaaaaatccatatggtttcaagcctccttaggagatcaaatggaagatactcctttttttcctctcagcctttgattttgtcattgcatctctggaccattgcatagtggtccagtattaagagacatgaggctgtaacccagggaaactttggaccaaccaacaaaatcctgtgtttggaagtcagatcagaaaatagttatcacatgcatagccaaaaccagaagaagtagtccaccaggggctgcttgcccctccttttagccataaaaaaaacaaccttcttctatctaatagcatcctattacctcctattttctgctgagaggatgtcttggcaattgggataatgttccattaaactccaagacacatacttcctcattttagcagtcttgctgactgtactttatacagtgtctcactgctgaaatcaattagtgtcttatcaaatttttagttaagtaattctcatttaaatctgtttactttctaagaactcatattcccagttctggacagtcttgtgtaattacaaattttattatagcattagagtctaaatctccttttgacttctgctatcactagcctgataaggctttatttttacaatgccttctctggggttttttgttcaatctgtaaggccttgaaaatgaattgtggttgctgacattactatttactaacatttactctcaaattgcaaatctctgagagagacaaagtagaaacatgacaagaggtaggaattccaactctaactaacacttactatctgtgtcttcagcatggcttttgaatttttctaagactcagattttcatctgggaaatactggtgaaatattgtgttgtgccttgtttatagtgggtgctcagtaaacattggttttctctctctcatgatttctgcacagtgaagtcaaagatgtctcaggcttacactgaaacctggaatgtgggagaacagaggaaaaggtaatagataaattctgatgaatacacaaatctctttccacacattctgatacatggaatctctgggttggtaagacttacatatgagagatcaagtggaaagagtgagttataatctcagagagttttgacagtcaaacagaatggcatttctagctctctgggttgttcttcctcctcaagagaaatacttcagtccaagctacgatgaccaggtaagccaagggagtatctcaagggagttcagttggagattaaatatactggtgaacctgtttcaaagagagacagtttaaacaaggaaattaaacctgttttgtttgtaccagagagactgtaatttacagagatgcctgacatgaggacgttaatgccattggaagaattgattacttacatttcccaagagaagagagcataccatgccacgcaaggccacagtgggagcatcaagctttggtcaggaaacagaagcaggaatgagaaaaaaaacaagaccagagctttcattgggatttcttcaacagcaaggcaagccagggtaaatagtttagtattggctagtttgaataacaaacaggcttagaggaaaaaaaaaaaaaaaaaaaacagtctatgttagacaagctttgttcagacgtgagttacagtgctattggccatgagtacaatgctaatgaatcaacaataatgtatgaaataaggtgctttaaacaaaaacacacataaaacaaggttatgtattgattggttgaaaatattctgaccagagcctggtaggaaacttaccctgtatttcccctaggaggtttgattcagtattcattaatatagtatttgtggcaacattataaaacataacaagaattgattgtacaattctggtcaggatgcagagtaactggatctctcacacattgcaggtgggaatgtagaatggtataacaactctgaaaaagtttggcaactcattttatcacgttaaagatacatttaccatacaagccaatgattgcactttgaggcatttacccccagagacatgaaaacttacttacatgcgctcttcaaatggtaggtttctgcttgttgctaaatttgggaagtttgaggccactttttttccaagttcatattctatttcttcttgtgggactcaaaggacatgaatgttagatcttgtgttactgtctcacaagtcccagaggctcagttcatcttatttccatctattttttttttcctcaattgttcagactggatgttttctattggtctatctttaaattcatggattccttcctatttcatctcgtttctgctattaaacccatccagtgaggtttttcattttgtatttatttattgtatttttcatttcaaaaatttcatttggttctttgtatttttattttattgcgcagtctatttttacatttgtttcaagagcatttgtaattgcttcctggagcatttttatgatagctgttttaaaatttttatctaaacaccccaacatctgtgtcatctcagtttggcatctgtcaatcacatttttatatgattttggattgtcctatttcttaatataatgagtaattttgggctgtattctagatattttgaatattatgttgtcagactgattcctatgtaaagctattttggcagctcgtcaaccatgtaagttcaaaatgcacgtccagctcacttttgtggctcatgattcaaatgtcaatgtagttaagtctgcagttctgctgttgaggttagtgacacttgtgtaccaacctagatgacaggagtataccctatcgtctctagcaatggctagagtggggaaggcaggggcactcattactgcaggggatagaagacagagttccatgcactgacacagctggggatggggagtcatcttgttccgcagaggagatggatttacaattctgcccaccagctccagagagcaagggtgcttcctcatatctgtggtgtcatgggaggtgagtaacaggaaggtggaagtcagagttgacctacaggctctacgtaggaaggatacagcctcacatgcagagcaaagagatggaagaaagaaagggttccacccacaagtgctactgctgcaacacctgttgtggcggagggtaggtgtagtttttttcatggtgtttacctcaagaacagatagatgttcattaaaggcttctggactattatgttgcacttttctcagttctttgggcaagagaaaacagggttttcttgggggtacttttttgtctgcatctactgatactgctgagtttcaggtttctctagtgcccaagctgagatatataggagataagaaaaaaagagaaaagaaaacaaaacccagggcctcattcagttccaacaacccaaggcagtctgcttttcctccaccttttagagtactctgctgggtaacttatgtatttcatccagggaccttggttgtgattagcagaaggagtaaaatagaattcactttgcctagaactggaagtacaaccagttcctttgggatggctattaaggatttctgattctttggtcttatgaacaatactgattcatattcttgtacataccacttggcctcttagctccttgagataaattcctgcaggtagaaatcttgaagtcaagaggtaatgcactgttatagctcttgatacgtaatacgtgtgatgtaacactgtacccctgtaattcttgctagatattatctttctgtttaatactggccaagctgatacatgaaagactgttcagtctggattactcatcaagaactgcaagcctctagcctttttctgtttcttctgtgtattattaataccatttgttcactcttctttcttcaacttttaagttctggaacacatgggcaggatgtgcaggtttgttacataagtaaacatgtgccatggtggtttgctgtacagatcaacccatcacctaggtattaagcccagcatccattcactattcttcctaatggactctttcccactgccccaccccccaacaggccccagtgtgtgtcgttcccccttccatgtgtccatgtgttctcattgttcagctaccacttatacatgagaacatgcagtatttgattttctgtttctgtgtttgtttcctgaggataagaccttccagctccatccatgtctctgcaaaggacatgatctcattcctttttatggctgtatagtattccatggtgtatatgcaccgcttttctttattcagtctatcattgataagcatttgggttgatttcatgtctttgctattgtgaatagtgctgcaatgaacatatgcatgtgtgtatctttataatagaatgatttatattcctttggttatgtaaccagtaataggattgctgggtcaaatggtatttctgcctctaagtctttgaggaattgccacactgtctttcacaatgattgaactaatttacactcccaccaacagtgtaaaagtgttcctttttctctacaacctcaccagcatctgttgtttcttgactttttaataattgccatgctgaatggtgtgagatggtatctcaatgtggttttgatttccatttctctaatgatcagtgatattgagctttttttcatatgtttgttgcctgcatgaagtcttcttttgagaagtgtctgttcatgtcctttgcccgctgtttaatgaggttgtttttttcttttaagtttcttgtagacttgggatattagacatttttcaaatgaataggttgcaaaattttttcccattctgtaggtcgtctgttaactctgacagtttcttttgctgtgcaaaactctttagtttaattagatcccatttgtcaattttttcttttgttgcgattgcctttcatgttttcatcatgaaatctttgcctgtgcctatgtcctgactgttattgcctagattttcttctagggtttttatagttttgggttttacatttaagtctttaatccatcttgagttaacttttgcataaggtgtaaggaaggggtccactttcaattttctgcatatggctagtcagttctcccagcaccatttattaaatagggaattatttccccattgcatgtttttgtcaggtttgtcaaagatgagatggttgtaggtgtgcagtcttatttctgagttctctattctgttccactggtctatgtgtctatttttgtaccagcaccatgctgttttggttactgtagccttgtagtatagtttgaaattgggtagcaggatgcctccagctttttttttccttaggattttaaaatagtttcttctaattctgtgacaaatgtcaatggtagtttaacgggaatagcattgaatctataaattactttgggcaatatgaccatattcacaatattgattcttcctatccatgagcatggaatgtttttccttttgtttgtgttctctttgatttctttgagagtggtttgtagttctccttgaagaggtccttcacttccctttttagttgtattcctaggtattttattctttttgtggcaattatgaatgggagttccttcatgatttggcactctgcttgcctgttgttggtatataggaaggctagcaattttttgcacattgattttgtataccaagactttgttgaagttgcttatcagcttaagaatcttttgggttgagatgatggggttttctagatagaggatcatgtcatttgcgaacagagacattttgacttcctctcttcctatttgaatacccattatttctttctctttcctgattgccctggccagaacttccaatactacgttgaatagaagtggtgagagagggcatccttgtcttgtgctggttctcaagggaaatgcttccaggtttgttcattcagtatgatatcggccatgggtttgtcatatatgggtttactattttgaggtatgttccctcaatacctagtttattgagagtttttaacataaagggatgttgaattttgtcaaaggccttttctgcatctattgagataattatgtcatttttgcccttagttctgtttgtatgatgaatcacatttattgatttgcatatgttgaaccaaccttgcatcccagggatgaagccaccttgattgtagtggataagctttttggtggactgctagatttggtttgcaaaattttattgatgatttttgcattgatgtttatcagggatactggcctgaagtatttttttgttgttgtatctctgccaggttttggtctcaggataatgctggcctcataaaatgagttagggaggggtccctccttttcaattttgtagaatactttcaggaggaatggtactagctcttctttgtacctctggtagaattcagctgtaaatctctctggtcctaggctgttttttggttggtaggctatttattactgcctcaatttcagaactttttactggtctatttagggattctattcctttctggttcagtcttgagagggtgtaggtgtccaggaatgtatccgtgtcttctagattttttagtttatgtgcatagacatgtttacagtattctctgatggttgtttgtatttctgtggggtcaatagtgatatccttcttatcatttctgattgagtcactttgattcttccctcttttcttttttattaatctagctagaagtctattttattttttcaaaaaaccagctcctggattcattggttttttgaagggtttttcatgtccctatctccttcatttccactctgatcttgcttatttcttgtcttctgctagctttggagtttgcttgctcttggttctcccgttcttttagttgtgatgttagggtgtcaatttgagatcgttctagctttttgatgtgtgcatttagtgctataaatttcactcttaacaccgctttagctgcatcccaaaaagaatggtacattgtctctttgttctcattgactccaaataacttctggatttctgccttaattttattatttacccaggagttattcaggagcaggttgttcaagttccacgtaatcgtgtggttttgagtgagtttcttaatcttgggttttaagttgattgtgctttgtggtctgagagactgtttgttatgatttcagttcttttgcatttgctgaggagtgttttacttacgattatgtgatcaattttagagtaagtgccgtgtggtgatgagaagaatgtatattctgttgtctgggggtggagagttctgtagatatcgatcaggtctgcttgatccagagctgagttcaggtcctgtgaatatctgttcattttcttttctcaatctaacattttcagtgaggtgtcaaagtctgccactattattgtgtgggagtctaagtctctttaaaggtctctgagaacttgttttatgaatctggttgctcctgtattgggtgcatacgtatttagcatagttagctgctcttgttgaattaaatgctgtaccattataataatgccctttcttgtcttttttgatttttgttggtttaaagtctgttttattagaaactagaattgtaactcctgcttttttctgttttccatttctttggtgaattttcctccatccctttattttgggcctatgtgtgtctgcatgtgagatgagtctcttgaagacagcataccaatggggcttgacactatccagcttgccattctgtgtcttttaattggggcatttagtccatttatatttaaggttcataatgttatgtgcgaatttgatcctgccatcatgatgctagctggttattttgcatgcttgtttatgtggttgcttcatagtgttactggtctgtgtactttagtctgcttttttagtggctggtaatggttttttctttgcatatttagtgcttccttcgggagctcttgtaaggcaggcctgctggtaatatattcccttaggatttgcttgtcagaaaaggatcttctccttcacttgtgaaggttagtttggctggatattaaattctgggttggaaatccttttctttaagaatgttgaatattgacccccaatctcatctgacttgtagggtttctgctgggaggtccactgttagtctgatgggtttccctttgtagttgacctgacctttctctctggctgcccttaacattttttccttcattttgaccttagataatctgaagattatgtgccttaggattgatcttctcactgagtatcttactggagttctctggatttcctgaatttcaatgttggtctgtcttgccaggttggggaagttctcttggatgatatactgaagtatgttttccaacttggccccattctccccatctctttcaggtagcccagtcagtcataggttcagtctttttacataatcccatatttatttgaggttttgtaattccttttcattcttttttctctattcttctctgcctgtcttattccagaaagatagtcttcaagctctgagattctttcctccacttggtctcttcagctgttaatagttgtggttgcattgtgaagttctcatattgtgtttttcagctccatcaggtcatttatgcttctccctaaactggctattctgattattggctcctgtaatgttttaccatgattcttagcttctttgcattgggctacaacatgctcctttagctcagtgaagtttattattacctacctcgttaagcctacttgtcaatcatccatttcagcggcctcagcccagttcagttcccttgctggagaggtgttgcggtcatttggagaagaggcagtctggctttttgagttttcagcatttttgcattctttctcatctttgtgggcttatctacctttgatcttcgaggttgctgaacttcaaatggggttttgtggggtcttttttgttaatgttgttgtttgtttgttttaacagtcaagtcactcttctgtagggctgctgcagtttgctgggcgttcactccagaccatagttgccttgttcctcccatacctggaggtatcaccagtgaaggctgcaaaacagcaaagatggtagaccattccttcctctgggagcaccatcccgggggggcaccgacctgatgccagccagaacattcctgtaggaggtgtgtggagaccccgttaggatgtctcacccagataggagaaatgggatcagagactcacttaaagaagcaatctggctgctccttggcagagcaggtgccttacactgaccactcggcctcctcagagataggagcatagaaagattaagtctgctaaccacagacatagtggatgcccctctcccctgggagccgcagcaccagggaatgatgagagttctgtccctagaaccctggctgcagttgttgaaattcccaccaggacacccctcccagtgaggagagatggattggtgtcccacttaaagaagcagactggccatgatcagacacagtagctgtgctgtgttgtggggaattcctcctggtcgctagtactggcaggctacagcagccaactggaacagcagatatggcagctgcctctccccctgggaactccatccatctcaggccatttccagcctgccactgctggccagctggaattccaagccagtgagtcttatgaggtgccatgggtgggggcccacagaatgaggctgcttggttccctggattcagccccttgcctaggcaaatgcacaggatctcctgccttgctggaattcctggggctggagtatgcaaaactcccgggtttccctaaatgccccagtgagcaggtaggcagccactccatcaagactctgcatagctctgtgctttggacccaaggccctggtgatgtaggcttatgaaaggatctcctgatccactggctgcaaagatccataggaaaagcatggtttccaaggaagggtcacgcagttactaaccacctcatttggctgggggtgggggttcccctggctctttgccacttatgggtggaccatcaccctaccctgcttttcctcactctccatgggttgagccatcctcctagtcagtcccaatgtgagaacctagatacctcaggtgcagaattcactcactgttttgtgagcgccgtagattgcagctgcttctaatcagccatctcggcctctctcctgttcacttttctattgagatgttcatcttttccttactgatgtgtaaaagctttccatatatgaatatcggtattttgtctgccatataggctattaatactattcccagtttgagtttagtttgatttatgtgattgtgtcatgtacaaagttttgttttttatgtagtcaaatctatcaatttttacacattagctattgggcagatcttccttccaagccctgttctgaacccgaatcgttccctactctcttctgtcccctttttgtgtttgagatgtcaaaagggaagagaaaaaccaacatagatctttttaaagaagaggaatggagtaacacatgagaaaggtcttcaagattactttttcctaatcttttttgtaaaataagagccctccaaaaacccatgcaaatccctcactacttcgctcactctgacctaagccaaatgcatacatggccaaatcagagccatctgcattgactttccacaggcaaaatccatttcccttgggaacatcagacacagcatctttcacagattccctgctcggttcctactccttgtctgtgctctagtagtgaatcaggaaagacagtgattgattgaaatagcatatggcagcatcaaataccagtttttctgactttgacagtttcaagagttgtcgctagctttttctcaagctgaaacctagtgtttttaccttagtttctttgctgtgacactcagaatcagtttcggtcctctgtcagttacatagcactcataaatatttaaatattccaaagtattgtcctgattcctacttcaacccatgcccccactgagctgacctaagcattccactctattgacttgtgtgtgagaaactatggattattttttatgttttctttttcagttattgcaatgctaaaatagcaaggtcatgattttattttctatgctgtctgtgaatggcctataaaacactgagcactgaacttaatacatgtaacaaagcaatggtgaagaggcaattcaaagagaaggcagagaagttcagagacccaactgaacttctgagaatagtatttcagacttggaagtaaaagaccaaagtttatttgcttgtgtccatttcttgatcattaattatagttattcaattaataattcagtgtcctgaactattttgataacttctcattaagagaatcaaagctgataattaaggaatgagtcagagacctcatccacagagagcaagggcccaaatgaacaacataaaacgtgcatacttttacattcctaacatgtaagtgggctatgaatattgatagtactgaataggagagatgaaagtatgagcttgcagagccctgctttcttcatagccaaaaatcaatactacaaagatgcccaacatgcttcaataactgttcatcaattatttactgggctcttttgttctaagtttctgtttacaagattactttataacttgaaatgattgtttcccctcatatggctgctgaatggggcttgagttttttacaagatgaacctgaaggaatgtgtgtgtgtgtctgtgtgtgtgtctgtctgtcatctcatgtttcagatcaaatcgggataacgctgttctgcatctttctttccagtggtgctctgatgtccaccagatagttattaaaggccaaggcatttacttgtccatgaagaaagcacaagagtttttcaacattctgccaaatcgacagctaagggcaacaggaagcaatgcttctcgagtgtttgagtttgtcccttctttacttgctcaaatttctgacttggaaacaaagaaaaaacatgaaacgatctagtcttacctgttcacaattttctatcagctgcacgcacttaaacctcacgccccagttttcagacaaggctttttggtttttcttttggcatgaaatgactaattggactacaagttattcataaatgatatacaactttattaagagctgattacagtccatgggcacttgtaaattcaacgaactgtggatcaaaaatacttggggggaaagaaagatggttgtgtctatactgaacatgtccaaaccttttttcctgtcagtattccctaaatacagtatgatgacaatttatataggatgtgcattgtattcggtagtataagtaacctagggatgacttaaagtttatgggaggatgtgcgtaggttatatgcagatactatgccagtttgttcaggctagactgcttcactaaatggtgaagttagtcaacagactagcattggatttatccttggtcagtgtgtccctaataatgcacaaagaattttgtacagaagcattttccagtttatctgtgaaataggaatttttggtatggtgtttccattgccacttgcaggagtcaatgctcaaccttgtatacacaacaacaagttcttgcaaaaattgaaatgaaagtagctggccaagtagtgatggtggtggacgagggagtatatatagacccataaaaggggcagcttctcctctgcatccaatagtgtcgatgtgagataacataggctgttcaatattgccacatctgcttgtttaagcaaccttggaaatccacataacatatgctagattgtatctgctcttgtaatcaagtgcaggcttagctgttcaccacttataaaaccagtaacaaggatgaagtgtagtgaaaggaaagtgattctatttccagagctagccgtggggaaaacagccagctcaccctttccggaaccacttcaaactttcggctggggagaagggcttaaagagggaacttggaatgggaggcatgggggaatggtgctgaatacaaggtccacgtgtcttcttctggtggctatctagaactattgtctaccaggagcatgggcggctgtcatcttaaagcggctggggtgtggactaaccacccttgaggtaatgtctggaattttgcagctgggtctccatgcttggtctgtctcaacattagcccctggaacttctaagtaagcacataattagataaaagcatacagttagataaatgtgcatgggggaaagaaggagtgcatagtgggaaagggaagggaatggagtttcaaagtatgttttgaggctatattttaagactaaggaaaagtttctacagtttattttggggttacatcttgagactggaaagaaaggaggggaaagaagtttaaaagtgcattttcaagctagactgctcagttacactctcaggtagcctctggcatgaggaggggctggtgatctgccaatgagcacagtggtatatgtaacttacaggcagcttatagtccaagaccaactacagagcagtttaatatttttagtgttgttcctggccaggtttcctttaaataaatcttttaaaatacaaatattcttttaaactcaagcagaaattctgttatgattattttacccaattttaaaattttaagtttttttaaattatactttgttttagggtacatgtgcacaatgtgcaggtttgttacatatgtatacatgtgccatgttggtgtgctgcacccattaactcatcatttacattaggaatatctctgaatgctttccctcccccctctccccaccccacaacaggccccggggtgtgatgttccccttcctgtgtccaagtgttctcattgttcaattcccacctatgagtgagaacatgcggtgtttggttttttgtccttgcgatagtttgctgagaatgatggtttccagcttcatccatgtccctacaaaggacatgaatgcatccttttttatggctgcatagtattccatggtatatatgtgacacattttcttaatccagtctatcattgttggacatttgggttggttccaagtctttgctgttgtgaatagtgatgcaataaacatacgtgtgcatgtgtctttatagcagcatgatttatactcctttgggtatatacccagtaatgggatggctgggtcaaatggtatttccagatctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgtgttttggctgcataaatgtcttcgtttgagaagtgtctgttcatatgctttgcccacttgttgatggggtgggttgtttgtttcttgtaaatttgcttgagttctttgtagattctggatattagccctttgtcagatgagtagattacaaaaattttctcccattctgtaagtaagttgcctgttcactctgatggtagtttcttttgctgtgcagaagctctttagtttaatgagatcccatttgtcaattttggcttttgttgccattgctttggtgttttagacatgaagtccttgcccatgcctatgtcctgaatggtattgcctaggttttcttctagggtttttatggttttagatctaacatgtaagtctttaatccatcttgaattaattaatttttgtataaggtgtaaggaaggcatccatttttttaaaaatgggtagcaacatgatgatattcttcatcactttgttgacgttgggatagtggcaaagagcgcaggtgctggatgcaaacagaatctggctacagatttaaggctagcccatcacccggacacctagaatacagaatagtattttaaaagtactctcagacaaaaataaatctagaattttctctatcttatcatgaccctcattgtataatttccagtaataactccctgtgtgagtttgggtcggtctaatatcttgtaggtcttaaattctcctctatgaaatggaaatactcataaaggtctcccaaattgagtagaaaaataggtttgtagagggatagagaattttgccaataactctgaacagtcttgtagagcctccttaaatgtaatttattaacagagttccacctttccaatgtggaaatgaaggcaaaggggtacatggtttggagcagcacatccggacatgagggagagagagaaaaatctaggtactgttcctttacggagactttggctgtgtccacacagatacaagcggcaaaggtttctcaggtgttgggactacatgtgccagtcagagtcctaacatgctgtgaccaacagcctcaaaactgtcctggtatgtttgtttgttttaaattctgcaaaaataccaaacattctcatacctatttccctacaggaaaggaatgggaatgataacattaaaatacttctcaaagcaagccccatttcaggccttacttttgaagtaaaaaagtacactttgaaacaacaatggatgaaatggcagctttgaggcctgccattttcccaaatggaccactgattccctggaagtggtttactcaccagagatgtaccttaaggtgaagtactgtcaagccactgtttcatgtaccataaaatttccatatatatatttaaatacatagttaaatatatatatatatatttaactcaatactaaagggagcaaagtatgcgtaaaacatcatgagtgtgcctaagcttaatgctacataggtttgggagaagaaactaagctacccaaatgtatgtgccaactttgccatatagttcaacatccctaaagttaagtgttatttttaaaaggagtttttcacgtttaaaatgtgtaagcctaggtaggatgttaacacaaagtcttaaggcatataataatcacaaaaacatgtatgccatcagcaggatgaatttttttacttattcatatgatcataacaaatattcaaaaattacgccaacaaatctttccattcctttccattccctctgcaagaataaaatcaaataactgttaggctataaacaacattaaagtatttattttccccctataaatgtgaaaggacagggataattaacttggtgcagaaactatgtttttggcatttcttaatatataaaattcatcccatatttttacagtagtatgtactttaacaacattatacatctaaaatctgggtcagtcattcttcatctgtttcatacgtttccgcatgacagcatttgagaatatgtggagacatgtctgctgcaaaatcattaagccaatcaggactcagattttaaagaaataagatggctaacacagaagtcacagaagtagggaaacagctaagttaagaagaactcatttacagtctaaaaattcagcactgaaagactcctgtctcggagttaaaatcttttcatataattggcataaatttgatctaagaaataacccttgatctaaattgagattgttttatattttaaatgatttacctacatgactacacaaaagccgtaaaaattccaacaagttttataaatatgttctgatagagctttggttataaaatattggaattgatatgcttccttagcactcagtaaaatggtacattgaagttaaaacgctctcattttatctctgctaactggaaaatggaaagcaaaaaaaaaatagaagtaaaaatacaatgcacacacaataatccaactatgtccttctattcttcaagggttataaaataaacgttctttaccagttaatcagttgatctctagcagtaattttcttcaccagctaatctacatctgcaaatatgttttgccaaaatctttttagacccctttaaaaccactttaatacaaggacaaaaggaaaagttcaaaagaggaacagaatgaggaccctttggaacatacatccaagttcttttgtaaaagcagaaagaaagtgaagaatgaacatgcccttagtggtgatccattttgaagactctgatttgctcttctcggattttggaggtatgctccttgggaatccagagaggatgtcaaatgggtggtggcttgtggttataattcaatgaaataaaatcacgaagcagagagggctgggccagttaagtgaatgccacctctcacagctcacatatacaaatatgaagttgctgaaatcctagacaattttctgcaaaggggccatgatgggaatccaagcaaaagagctccgcctcctgctgcccctccaggattgaagcacacctctctcttcgctaccgcgttacctaaaacaaatcaaaataagggaacattcaacactctatacccaccgaaataaccattcctgcccccgagaccaataaggtcctgactgtgaatactttatcagtttgtacatttacctataaccgacctcaccaaatcaacagttcaaattctgctttgcagcctaaaagcaagaaatataaagaatacatgcacaaagacttccataagagggtattatgcagtctggctttgtatttgtgaggttataaaaatcccatctgattaggtacactcatcgcccatcagttcatgcatgctgagcatgctttgttaatggcactagaattttttcaaataaatggttgattaaaatcagtgcatgtcaagataaaaatgttgccttttttatgttattttttatgcagttaactttcacttttgaaaataggttattttataaaactgctgtattatccattaaaaaggtagtggttgtatttttcagacatccaggctcattgcttgtgatctaagaaaattgaacagcagtttctattcatgtaagaaattttacgtgtttgttagtcaatataccagcacaggtggaaaaaaaagcataagactttaacatgcctacaccacaaaaatattttttcaaagcaaattatttgatagtatagtcaccatacccaggctttagacccaatcagctatgtatgcaaacctcagcgttgctattaactgacatctggcctttatgtactcaacagtattactccccttttgtttgtgctgggtaactacagcaaactaaacaaaaaccctgcccccatggagcttaccttctagtgcagggactggaaaacttttactggaaaggactcaatatggtaaatattttcagctctgcaggccatacagtcactatagcaactacttaactctgcctttatttcattcacaaaagtagccatagacaataaataaatgaatgggcattgctttgttccagactttatgtatagatggtaaaatctgaatttcatataatcttcatgcattctgaaatattctgtttttgattttttccaagtacttaaaaatgtaaaacccagtcttagctcatggcccatacaaaagcaggccaagggctggatttggcctgtaagccacagtttgctgatccctattccagaggaagaggttggataaacaggtaaaattaataatatgggcaatggagaaaagtaaggtagtacgatacaggaaagaaaggctgaggcagggagggtagagggccgctcttctatacaggatgtcaaggaaggttgaaggaggagaggaagagttaaatgcaaggactttggcctttttctgaggttcaaggaagagatgaggaatgcatggcaagactgaactgtcaacttaaagagttgtgacaaatagaacaaagatgtaagagaaagaggaatcaaggacaattccaagatctttggcttgagcaactgaatgatggagttggccatgttctgtgatggggtagagattgtctccctttgccttagtttcttcatctgcaaaatagagataatagtacctgcccccgtcaaagagtaaataaaatatgtgacttgaatgacacagcccagtggttgacacatggtttgtactcagggaatggtggctattgtgatgttagctctttctggatctatcagtctacatccgggatgtaattgtcaaaagcatcttctttgaggcaacttattccctatgcccagctcattttggacaacttcactgaagttggatgataaaatgctctcagacttattttcctttaaaattattattgtactgattacatgtggaagattcattgctacttctgaattttgacggatacaaggctactaagatgccaatattagctctattcccattcatcagggtaccctgagcatttcaagtctgactatagagatcagggaagacaaaacttgagggtaaaggagtcatctgagctggacattaaaagacaagtggaattttagaagggcaagtggaaaaaggaggcagcaatggtatggggaaatacatggcctgtacaatgattggcagtgaaggcccatttaagatgcttataatctgtattttgcatcagtttccaatggggatccattgatgttctctcaacagggagggaacctgggcagggagcttacctttgatgcagagaaagcaaggtataagccaattaaaggtgagaacaggtagagagctcagttagactaatggttccctcatactgcctgttgatcacaatcaccctaagaacaacttttttaaaagcgtggttttctaagccctatcccagacttactacaccagaatatcctagaggtagagttcaaaactgtgttttttacacgttcccatgatagcattaaattattattatattgacaatgacccatggtgatggcctaagggacaggcagattagagagccatttgaggaagatactgaagacaaaactgttgcttccattctgtacaaattttccaatatgaaatattggaaatatttagacaatagaaactttgaaaaacaaaatgaagtaaaagaatcaagtaggaagtttgcaaagagctactgaaaaaaatatactattctttaaagcagcttttcaaccttcatactattgacatttggggtcaaataattgttgtagaagctgtctgtgctttgtaggatgtttagtagcatccctggcctctacccacaagatgccagtagcatcctcacaatgtgtgatgaccagaaatatccgagacattgccaaatgtctactcaggggcaaaattgtctctggttgagaactgctactctaaagacatagcttttcacccttagtagaggattcaaaaataagaacattaaaaagtctaaaatgtcttaagattcaaagtgatttgcttctgctcacaaacaagatacggcaaatgcttggcttcgttgctaagaagatatcatacccttgttagaaggcttaaaatggcaaccccagatagtaaaaaactctttagctcaccgaatgcagcaaaacccagatttcaattaagaaaaaaaaaaattaaggcaggtccacagagagagtcatattttcccaaaagaagcagtagctgcatcccctctagagacactgaaaactgtcggcagagtaaactcagtgccaatattttatacctggaaaagataactagttagggaattatcctctctcttttcatatcttcatctaaagctattaatattcaagttaactgccaactattttcatatttgcatttaaatggaaaataaaattctgacatagctgacttactggagaccatcttacctttagcttttctgtgttttgatgctgctgtgcatgaactatttaaagaaaatggaaactattattgttatacagtttagttaatacgtcctctagggagacaattgctctgcttttctaggacctctgtcttacctgtggtgtaaggtcagtaacaattttaagaaaaagatactactggaagctagtcacagatccacaaatgaatttactctatgtgcataagatccataaaagacataaaatgttttatgcagttcaagtcacactgacttagattaataaaggaaacaaagttttatgacttcaagattattctcaagtgacatatcactaaaaaagcagcccaagtatcatgatggcttggggaactgtattatctttctacaacttttcgaagtgctaaatgaaatgtcactaccattgaggatttagctacagcaaacttacattcccagcacagagccaaaatgcccctaaaggtttgcttcctgcaaatgccttttctaactacacataaatagaaagccgttctaccaagagaactacagttggcttttgctcatgatcttgttttatatttatatataaaaatcaatacaaatataatcttccaaaatattattccttagcctacaagaaatacactgatggatgtaataccctaattcgtgggctactccaagattttcacttaggaaggaattaggaaaaaatagctgaaatgggacaagggaaagatagggaaattatcttaaggcagggtttgcttagcaagcacgctgagtctatatagcatggaaatttattgggaatggcttagaatgatacgagtgttgacctccttgcaccaccagtaaatgactccatggacttctgctgctctggacataaaagcagatatcagatcgttatcccagtcatctcagtatcactaacaaggataagttagttgacaaccgcaattcacgttgaaaatggtctggttttacctagagaatcaaccgacaactattccattgataatctggggtataatatcagctaaagttcccatttaaaatgtattgtagaatcatattttctattttgttttagacttaatatctttatattttaatatattttacaaaatcttaatgtataagttcaagttcacacttagaaggagaactggcctgtttttgacctccatggctgaagatgaattactaaacacttaagagttctcattcaaagtattcataaaggggacgacataagaaaggcaagaagccattcactgtatgtacttcctaagggatcaaagctcaatagcaatgagaaccaaagactcactccattccagtatgtccagctctaatgatcttagaatgaccttggtcatgtcatttttcattcaagaaatagttaccaaggcattcatctggctctgggactagcagggaaagcaaaaacaaagccagggcccaacatcaaagctctcccaccagacagaaagctctaggtattaagcaaaatatggatagcaatctatgtaaaatgtaaccataataaatgctcagagatacagggagcctgaattcaatcaggaaagaagtccccgaaaaaatgatgattagccagaaaagaaaggagggaaacatattctatgaagagggaacagcccatgccaaaggaccagggtaagagggactgacaaaaggccaggatgtttagagcagcaagaaggaagcggaggtggtttggccatgttacacattaaggaccaggcagaggctagtggaccaatcaccagagggtgccagtggaatattttgaggtggactagcttagaggatgtgcattttacaaaattattgtagtcactgtgtagggaccagactggaaggcagcagtctagcagtctagattcatctccatatgagatggcagattggacaagaggagtaagcacagtgttgaagaatcatggaaaagttgggtagtaaaaatcctaaggacaatgtaaccaactgaacataggaagaaggtaggtttctggctggaggactgggtagacaatggtgttcttcagcaacagtgagaattgaaaagacgaccacttggggagaaaagcgttggcttctaagtcttgaataagaatctccaaccattaaatctcctttaaagcaataggtatttctacttgagtaaatcatctggatgtggattcttgtcatggtgttttgatacattggcctgtcgactctgaaacctttactttaaatcgggcttgtgaagaagctgaaatgaatttagtagccctgcctaaaataatgaattctcccaccaaatcactgttctataaaatctgacacacagaatgatgccgggaaatgcgcttttcaaaaaggccaaatccgtaaggtagcactgcccaagcaggtttattaacacataataatgtgttcttgatggcagaataaaatcaaggggagaaagccccacagttgataacttgtaaattgtagttgcattttgtctatacttgccttcgtagttttgactttattgccactgctacaggaccaacctgagtaatctggcagcactttacaatcctctccttccaaacacggattcatgtgacaccaccatttctgaatcacaatggaagctggaaaacaaaggccaaataatatttgtgacactgtttcttcctccaaagatggacaaaataaaactcaatacagagtagtacactgagttcaaagattgctattaaatttacggttggtaaattgaaggaatccaatcaggcatatactctacaaaatatttcatttttttattaaaaattttaaaagcaacagatgttggtgagaacgcagagaaaagggaatgcttatacactgttgctgtgaaggtaaattagtacaacctctatggaaaacagtatggagatttctcaaagaactaaaaatcaaccactgaatccagcaatcccacccctggaaaagagactgttatatcaaaaagacacctgcactcatatgtttatcacagcactagtaataaatagcaaagtcatggaaacaacatgtgtccatcaatggaggacgggataaagaaaatgtggtatagatatgctatcaaatactactgagccacagaagagaatgaaatcctgtcttttacagcaccatggatggaactggagatcattatcttaagtgaaataacccagaaacaaagtcaaaagtcagtcattttctcacttataaatgagagctgaataatgtgtacacagagacatagagtcatggaacaacagaaattggagacttggaagggtgggaaggacgagaagttacttaaggggtacaaagtacactatttgggtgatggctacactaaaagcccagacttcaccactatgtacccttaaatttatacaaatataaaacagatcacttttgcagtggactgcccaattgtaaaatatagctggtgagatctcaggctttgtggtgggcttgcctgggtttgaatctgactgtgccattgtctagattacactagttctcggacttctcttagtgtcagtttcttcatttgaaaagtagatcctcaccccaggatgttaagaggataaagttaatccacgtgtgaaagtctttgctgactttgagccagtcacaatagtctcagaaaatgtcagctgttaatatggtcatcatctttgattgcaggttacaatggtattgcaactggttcttaagtttgatgctgtcaataggaaaaactaaaagcactaaaaatttccatcatacatggtattcatctctccatgccattctagtgagtggacagcaaccacttaaagtcaattacaagaagccacaggaacatgggagggcctggcattccttcaccttttcatatgcctgttagtcatttgtatgtcttccttggaaaaatatcaattcagctccttttcctactttttaattagggtattaatttttggcacttgagcaggtaggtttcttttatattttggatcttaactccttatcagatatatggcttgcaaatattttctaccattctctaggctgctttttcatttgatgtagtcccaattgtttatttttgcttttgttgcctgtacttttggtgtcataaccaaaacatctaagatcaatatcaaggacctttttccctatgttttcttctaggagtttcatagtttcacttcacagattacatttacatccttttcaagttaacttttccatgtggtttaagtcacaggtctaacttcattcttttgcatgggaatatctaattttcccagcaccctttattgaagagactatcctttccccattgtgtagtcttgtcaccctgtcaaagactagtcaactataaatgaatggatttatttctgagttgtctattctgttccatgggtctacatgtctatttatttttatgccagtgccatactgttttggtaactatagctttgtaatataattggaatcgggctgtgtgcctccaactctgttcttctttttcaaaattgctttagctatttggggtcttttgtggttctatatgaattttaggactgtttttctatctttgtggaaaatgccactggaattttgttagggattgtatctgtagattgctttggagagtatggacattttaacaatatttttccaatccacgaacacaggatattgttctgtttctttcattaatgtcttacagtttttagtgtactgatttttttacctccttggttaaattgattcttaagtgttttatattttttgatgctattataaaaataggattgcttccttaatttcttggattgttcattgctagagaaatgcgactgagttttggatgtagattttgtattctgcagctttactgaatttattagtacctggtatttaaagaagaacttggccgggtgccgtgactcatgcctgtaatcccagcactttgggaggtccaggcaggcagatcatgaggtcaggagatcgagaccatcctggataacaatgtgaaaccccatctgtactaaaaataaaaaaaagccaggcgtggtggccggtgcttgtagtcccaagctacttaggaggctgaggcaggagaatggtgtgaacccgggaggtggagcttgcagtgagctgagatcacgccagtgcattccagcctgggtgacagagcaagactccatctcaaaaaaaaataaaaataaaaataaaaactctccactttctcttccaaagaatcgaagaagagagaacacttccaaactcatttaataacgccggcattaccttcatgccaaagccagattaggacactacaaaaaagaaaattataggccaatatccttgataaacatacatcaaaaatcctcaacaaaacactagcaaactgaattgaacatcacattaagaggatcctccactatgattaaatgggatttatccttgggctgcaagaatgcttaatcaataaatgtgatacaccacattaacagaatgaaggataaaaatcatatggtcatctcctgcagaaaaatcatttgaccaaattcaacatccctttatgataaaaactctcaacaaagataattttatacagaaggaatgtacttcaacattataaaggtcatatacgacaagacatggatatctacgctcaccatttctattcaatagagtaccaaaagtcttagagcaagcaggcaagaaaaaaataaaaaaggtacttaaattagaaaggaagaagttaaattttctctgcaggcaacacagtcttatatataggaagccctgaagactttcctgacaggtttgactcaaactatgctgcctgtgaagtcagaaactctagttcaaacaaagctttacaaatcctaacagctactttttattgagggccaggcacccggctaatttccttcctgcattttctaatttaaacctcactacaaacctgaggttaaaaattatttttcagggcagggaggtgagggataaaagactacacatgaggtacagtgtataccgctcattggtgcacccctcacctatctcaaattaccactaaagaacttacccatgtaatagaaaaccacttgttccccaaaaccttttgaaataaaaaatatttttaaaaacattatcttgtacttcatcgaaatgaaaaaactgaggtccaggggccttaagtgactagggcaaggtcacagagtctgaaaacagtcaaacaagctcttgaagagaggcagtctaatgctagagcccaagtgctaacgcttatattcatacctccctcccttatgcatctactagaaacaaatccttgtatggaaggaggcagccagtgcattcaaacagttccccagacaaacactatgtggcatgatgagagcacgggacaatttcattatccactgaaggggccagacattgtagaatcttctccacaagtggccacattgtacccgattctggccgaatatactgagctactatctagtgatatccatcaaaacaaatagtacctaagtcaggtggatttgtgatctagggtaaccacttgttatttaaatcaggcattgccaacaccaagaaaggaatctagccaaattggttatttattgtgccagagactgccactaaactgggatggatgtacatagcaggtaaaacctaataaagttatattcttggccaggcatggtacctcacacctgtaatcccagcactttggaaggcctaggtgggcagatcacttgaggtcaagagttcaagaccagcctagccaacgtgatgaaaccccgcctctactaaaaatgcgaacattcactgggcatggtggtgtgcacctgtagttccagctactcaggaggctgaggcagaagaatcacttgagcccgggaggcagaggttgcagtgagccgagatcgcgccactgcattccagcctgggtgacagagcaagactctgtctcaaaaaaaaaaaaaagaaaaagttaagttatattctttgcagcctcaaatatcataacaatttccccttgcagcttcatggagctgtgtcactttcaaagcacttctacttactgttcctcttttgattgtcccaacaaccttcagaagccagaaaggggagccagatggtaccacagataaaaaccagagcttccctcagagttagtaaaggggtggagggtggtactagaatctagattttcttcttctctatccagtagtctttctactgtaacacaattttcaataatattttagattaggaagttctacatagagttttactatactcatagtgttgaccactcattcttgtctgaataccacagattggttccaagtggatataaaaataaataagagatggcccccagacctcaatttaaaataccatctgcaggactagaaaagttacataaatgttgacagagcttagttgtatttacatagaattagagctgaatttaaaatactttgtcttcaaaactcttcctcagactaactttcttccactcaggagtgagaacccgtgtactttggaaaggtatcagagtttcatgaaagattcaaaagcagtcttgacaggtggccagaggtccacaactgaagacaggagcgacagtgacggttccacctggaagccagcagacgcatgtggctgaagtgagagatggtcagggaagccctggacacccagattaggagggtgtctgggaaggaaccattaggggctctcgaggaaaattcaagattagacttgggtctctcagcagcagacagccagggaaggagtctgagccaagtagtgcaataaggtagacaaaactgggtgccagaagagtttgagaagaacaaactctaaaacagaagagcaactgaggtgggagtgaagtgagaaattgcggaataaattccctgcagagaaaaacaatgaatcagataatctcaacctttcagcagataaattccagtcagcacttacttactgaacccatggggacacaaggtacttctgatgccaaaacctagaaaaggagctggagggggaaataaaaatgacggatccggatgtatatcacagaacactatgccacttcttaactacaggaaaaaaaatcagcatttacctagtgtttagggatttaaattaaaaaatttaaaaaggaaacctgaaagaccaagacagaactcttatgagattatctaccaggtttttcgtttaattggaaaatatggagtgatgctttcttctaaaaacagatttgcctcagattccttaaaatagcaagctgccctgaaatgtaaaggagtcctatttgcaaatatatatattttcccatctcacagaagaatacattgtgaggtgcccttgttcgtcaaagtgttacccatgatggagtttctttgtgaaaggctttatggcaagtgctctctcagaaatgacagacgtagaaggaaacaccacaataatcaaaagacacattgcaaattccgttatgagttaaggattgactaaaaactgacagcaagggtaagaacccactgagggctcgacctgacagagaataaggtgattaaacagccaggaaatttaagcttcgagtgcaccttcagcctcactagcagggacaaaggactcagaagtaggattttattaaagttactggtgagaacatctgcccactttactgagccttgtctccacaggaaaataagtttgtaggaggcatagatatttttttcctgttacaaaatatcataatacactttaaatgagaaagtgtcttgtcacttctatttttaaaataaaattcgtttaaaagccccatgcttcctgacttatgaaaacacataatacccctgtcttcaagctgccaacctgtaatgaatttccagttttatgcagaaagaaagaaaaaaataaaaagacagtgacgccctccctggttttgtggtagcaactgctatattctataatgctgttgtcgaggtgaaaatttcatgtgataattagctgttttgcttctagtacattttccttactctctattgtataaaatgagttttattttgtattcttttcccaaataaacatcactcggttaaacagaacacaattatgtattcatacagttacttagataagccagacttcaaattataataaccaaggacatgctcacttttcatgagttggattcttacttgctgatttagtttagctgtatttacatggtgtgatggttaatattaagtgtcaacttgattggattaaaggatgcaaagtattgttcctgggtatgcctgtgagggtgttgccaaaggagattaacatttgagttagtagacaaggaaaggcagacccacccttaatctgggtgggcactatctaatcacctgccagcacagctaggataaaagcaggcagaggagcagatctttctcccgtgctggatgcttcctgccctcaaacattagactccaagttcttcagcttttggactcttggagttacaccagtggtttcccaggggctctgggctctcaggccttcagccatgggctgaaggctgcactgttggcttccctacttttgaggttttgggtctaggactggcttcccggctcctcagcttgcagacagccacttgtgggaattcaccttgttactgtgtgagttaatactcctaataaactccccttcatatatacatctatctcatatatacatctatcctattagtcccgtccctctagagaaccctaatacacatggtgaaagatattctaaagaaaaatgtatgtttctactgcaactatgaacagaaaaattaagaaaacatcttcctagaatatatgctttataaaatatgctccaagattttaacactttgtgtcttcagttatttcaatcctattattatttcaagattctgtgttctttaaaaattaagccattaacttttatatttcttgttaagaaaagaagccataccaacttgacccagctaacaggcataagagcagtagttagagcactaaccattttttttacaaggaatcttacttgttcacacattctgcaagtaacacaatattgttagttccacaaagtacacagaatactgagtcagtgcatgagtacacatacactgatcttttggaatctacgtttgtcctctctactaaatgcagacccacacaagcatatccacatactttgggaacctctaagtcagggtttctcaacctcagtgtcattgacatttggaccttgttaattctttatcgtggcggtcaatcctgtacattgtaagatgtaaggcagcacttccggcctctacatgctacacaccagtagcaccctctcccagctgtcttgagacaatgtcaaatatccccaagggggcaaaatcgcccctggttgagaaactgatctacagtttgaaggcatactaactcaaaacgagaggttgtgctagttcatcagacctgctcaaagctcttacttacgaaaataattctaatccatgataaacaccatgctacctctattttatgtcttccttcctgcccctaccatgggcaattccatgaatttaaagtttttgcacacccacttgtgagttttctctctctctctctcaaacacacacactgatacggtttggctctgcccctacccaaatctcatcttgaattgtagctcatacaagccccatgtttcatgggaggacctggtgcaaggtatttgaatcatgggggtgggtttttttttcccatgctgttcttgtgatagtgaataaatctcagaagatctgatggttttataaagggcagttcccctgcacacactctcctgcctgctgccatgtaagacatgcctttgttcctccttcaccttacaccacgatggtgaggcctccccagccacgtggaactgtgagtccattaaacctcttttgctttataaattacccattctcgggtatgtctttattagcagcgtgagactaatacacacacatgcatgctcgcacacacaaatcctgactgattgtgagctcaccatgaaacctatgctgacgaggtgacctgtcaaatttaggcatcacatttctccttctccggaatcttacagtgctttatataaactttgttcataatacttcatactcttttttattggcacactctcttaaaacgcaaattcccagaaggcaggaattaaatcctaaaatttgacttattctaaggcctctcacatcaagggtccttttacctttccaagccagaccaagctacttctagttcccgagttagccccactcactctcatatgcttcgtgctgccttgttccctgactccctccaccatcatatccttctacctactaaattcagactcattgcttctcaaggggcagcatccctgaccacctctctgttctccctttgagtccttcattaataaaactttgtttctctgaactagtaaactctgagttccttgaaaccaggacctgagtctccttatcatgcttccatctggcatctagggcaggtcaggcacaaaggtgccaaattaaaatgatgaatgaaccaacgtatgcaatatacatatcctcccaactcccaaagtgttttggcaaaatcctctctgtcattcatgtgtctgcactgagaaaaatacgttttaagtggaaggagaacaagcccagtgaaaacacattgtaaagacagaccctatgtctcatcacacagcccataaagccatgaaacttgtctgcagtccacacagtaactctccttcttaactaagtgaattgacatcttgaaaaagtgggccgggtgcggtggctcatgcctgtaatcccagcactttgggaggccaaggcgggtggatcacgaagtcaggagatcgagaccatcctggctaacatggggagacccccgtctctactaaaaatacaaaaaaattagccaggcatggtggcacgcacctgtagtcccagctactcgggagactgagacaggagaaacacttgaacccgggaggcagaggttgccgtgagcagagagcacgccactgcactccagcctgggcgaaaaagcgagactccgtctcaaaaaaaaaaaaaaaaagtgatagaaattggggcatcaaaaaattttttaaatagctttgaaaagtaactactttccatttctgagcttttgttttattagtcttttaaacccaatatttagaaaccattttgacaaaataaacttccttgtactacacatttgtctcattttatcataaaaccattcagcattatctctatagagcagtattttcataaatgtgtagaatatagtttccaccataaaacagacctgtatatgccagccgaagattcacaaagaagaatgcttaccagctgaatagctgtctgttttaggacccataccacagtctcacgatcaaataattccctgtcccgtctcccaaatccccaatgtatattaaagacccacttcaataactcaggggaggtttcgtaagttaattatgataaaaaagtttggcagaaggggaacagctaattattttccctgtttatataatataatctatggttttatagaaaagcaatgaaaacactagataattatctgtggtgtggattaacagaaatgcaaaaggatattccagtttctatgtcggcattaattagtgccccatgccaacatcttcttgcctttgttttaatttaaatgtaaattcaggtaaattttatattttagatcctttctattcttattgacagataagaggaacatatcagcagagaataggtcttctcacattccaattagggcatgatactgcataattattatgggataaagattaagcaggtaaagctaaaaagccctaatggaaacatattcagataaggaagagatcaaagagagatgaaatcagacatacatcccaaccaaagcttaaacttcctacacttctcagtgactttgatccaataaacatttattgaacaccgactgtttgccagacaatgttaggtataggagacacaagttgaaagacacaatctcacctttcagggtactggcactctctgaccacaaatgttacactcaagttacatgtttacatcaagcataacctgcactttccaatgtgaagctttaagccacaagtccctattaaatctaaatttacactagccacatttcaaatgctccatagccacgggtggctaatggctactagccacactggacatatatatcatcacatatagatatctatctacacaggttatgtccataaatatatagagagggaacatgtgcatcatcacagaacattttagtagacagcactgcatagactctgctcagatgctccaggactggtccgtatcactgatcctgtgacactagggaaaccatttagttaacctgagagtctgtttgttttgccataaacacaatcaaaatgtccatcaataaaggaatggtggccaggtgtaatggctcacacctgtaatccccacactttgggaggcagaggtaggaggattgcttgagcccagcagttcaaggcagcagtgagttatgatcatgccactgcactccaacctagatgacagagcaagaccctatcattatttttaaaagggaagacgaatggctaaataattatggcctatccatacatggaatgctatggagcaattgaaaacacccagttagatcaatatgtaccagcacacaaagatttctgcaacctaatactgataggaataaagcaggatgcgtgaaatatccaatgtgatagcatttgtgtaaaacacacactcatattgaaatctaccactgttttctacaaacctatctccaaatacacagatatacagaaaaatatattgaccaaacagataaatgcagttacttctagggtggtggccaaaggggatttgcccatacatacaatttaaaacaagatagtttgcggtaaggtattcacattttctttactaagataaagatactaatagtcatcactgccctatcagtactttttaggtaccaataaaagtgctttgaatattgtacaacattattctgggttagacaatataaaaagagtttgttagaagacatttaaggcctacagaggcaagcaaacatattgtctgtagagagcaatctgtgattagcaaagtccattctccactgtactaaaagttgtttgtgggccagccaatggggaaagatgaaagtaagagaccacatccccatccacaagctgtttacatactaactggaaggcatacgtttttacaataacatgggatgaatgtcatgaactggaaatccagggtgttgcaagaacttacaagagatttgaaaggagaataagaagaattaagcagaccaggtgtgtctcatggggaggagggcaatgattcaggcaagggatataaattagtaatgtgcagaaatgaaaagaaatgggaagaactctggattgcctagggtagagtacttgaaagagaactgagacacagatcttgcagggctcggcaagccatggtaaagaactcctggagtttatcttaaagagagtgggaagccactaaagtgtggttttcagtatgggagtgacataatccattctgtttgtgtagatcattctgggtagaggactgaaagcggaaggagaggtgtggcacactcagcaagatctaagggtggcccctagactgtggacgtagcagtggggatggagaaaagtgggctgatttgagagacagccagcagaaagaatggttgtgatgtgatttggattcaattaatagagatgataaatacattagacttccccagctggagatatacagactcagcatatttcttttaaatgccattttttaaatgttaaagatcttcatctttttttaataggttgacaatcctttatcaataatccccaaatccaaaaagctttggaaattgaaaggttttctgtaagatgacagcaaaacctgacttgaattaacatgaagttctttatccagccttatcccatgctgcatgaatattcatacatttcactgcagatatagtaatatttctatgattatggggtgcaagtggagagtacagtaggtctgtaaggtaatagatggtatatttactatgttacccacataaaatatgagcaaagtctgaattcagcaacacatttggcccccaaagtttctgataaagaactgtaggtggaaaatttccactttcactttcctgttttaaaggtggctcagatggtgctgatgtataccactgtaaccacagagcccatatagttgtgtatgtctatatgtgtgtttggtagggggaatgggatgcaggtaaatcagccgttcttgttcactgtgcaatatgatctggagttaagaatgtgtgtgtgttttaactgctgacctttagacatgcatcaaatgagacaggaaatgttcattttcagggaggtttcgtgacactgcagagcaactgctacaggactaaccccatgtatttgttcccctggggactgacacttgtttctaacacggcgtctgctggaagaagccaggggtatcaaaagaaatcaatcccaggcctccacctacaaccatcaacattcatatatattttttaactattggcacagcactctgctaggggatttggagattacaaatgaacgatacatgattccaaactattcccagggaagttgttccaaagagactgtcctataaatgtctgttaaaatgataaactagaaataaaagacaggatactaacatataacaccaagcatgaagtgagaaagtcatgctgctaattttgagtagagagcataagaggaaggagaacagggcatcagaggaaacaattgctttggtgagtgagatttggagacaggtgggtaaaaggaattgaagcacatcttcccaactgccctataatataactccccattggtaccccttgtgggacattattgaaggcatatcttaccatcaagacatttttggagttgtatttatgtacatttttggattgacactgatctcaaagcaaccctaggtttctttgggttgcaaagacagtaaagtagggaaattcctggtgggttttggcctttttgaaataccagagatgctgaccagagaggtcttaccttcaacacaagaaggttgagcccgagttgtgcccgccacctgtcccgggaagcaagagcacttgaccgtttgtgaccgctcttctatgcggttcttattgcagcacctgtgcacggcgaccacctcacaggtcccttgcttgatttggtggtgacctagttggtaatgggggagaaaaacaaacccagtgctgttagaaggaaatgacaccaccaaaaccaaaatgatgctatgatgacattttccaacttcctgtgctatgcttatgagtctttgtaacattttattttgataacatattatttcaaatttatataaaggtggtgagaagagtgcaaaaagcttctgtgaacctgtggtaggcagaaatgaggcctccaggatcctcaacccctggggtcacactcatggttatgacacattaattacatgataaaagagagtttgcagatgtgactgagattgatagagtttttttttttttttttttgagagagaatctcactctgtcactgagattggagtgcagtggcacgatctcagctcattgcaacctctacctcctggattcaagcgattttcctgcctcagcctcccgagtaactgggattacaggtgtgtgccaccatgcccaggtaatttttatatttttagtagagacagggtttcacaatgttggccaaactggtctcgaactcctgacctcaagtgatctgcctgcctcagcctcccaaagtgctgggattataggtgtgagccaccgtcactggccaactggttgattttaagagaggcagtgtagcctggattatccaggtcaggccattcagggctcaaatgagccctgaaaagcagacagatgaagagctccaggtgccattgctggcttgaagatggaggggccacatgtcaaggaaatggagatctcagtcctacaacctcaagaactgccaataaccagagtgagcctggatgctgattcttccccagagcctccccataaaggaatgcagtctgctgctaccttgaatttaacccaatggtgagacgctgagcagagaatccagccaggcagtgctagacttctgacctgcagaaacatggggctaaatgtgtggtactttgttattagttggcaattgctgttgtaacagacttcacccaggttcaccagttaatatgtggccccatttgctttatcattcactctctcatgtttttctaagccatttgagagtaaatttcagacatgatgcccctttacccctaactacttcactgtgtattttctaaaaacaaagacataaggttacataatgattaaagatagaaaatctgacatgatacaatgctactacgtaatgtacaatctatattcaaattttgccaatgtcccaataatgccttttatagctattttccccctgatcagaatccaaccaaggtgcatgcattgcattctgttgtcacatttcattagcctcctttattcagaaactcctcctcagtctttctttcttgaccttgacatttttcaagagttacatgccaattattttgcagaatgtccctcagcttggatttgtgtgatgcttcctcttgattagattcaagcaatgcatttttagcagattgtcccagaagtgattctatattctcagtgcatcatatcaggaaacacccaatgtcctttcatcccattatcagtgctactacctttaattaaatggttaggatggtatctgtcaggcttctccattgtaaaggtattatttttccctttatattagtaagcattttgagggagatatattagtgagactatgaatatatcccattctttatcaaactgtcacctactagttttagtacccattgatgatttccacctgaatcaattatcaatatgatagttgtaaaactgattctatgttaatgttcaaatcgtcccatatctggggaggaggagacccttcaaattgtcccagatctaggcaggaggagctgtgtcatattctcatcattctctgagaacttactaaccttctgaccctcaagatgttccagacttacctggtattttccctgcccccgtaatttcttcaagaatccttgatgactttttgtggggcatccgacttagaaacccgaatctcaatgtgtaggtttactcatcacaactagggagtgattcaggccctttcagcaaataggtcaaggaagtatgtgcgcaggtacatcgacatctccgattccaatctagcaccacagtttcttgctactctcccaacaactctctatttatatctcccatcaccaaccacctgaattccatcatcctgtgataaagtagtttctgtattgcacatgtacttaagggtaatttacattggaatccatttatcaggagtcttttgttagaacaacagaaactgatttgagctaacttaatgcaaagaaactttactggaagatcaggagtttgtagaacaaagagtgaatgtagctaaccataagtggaactactctcatggctcgacctgagtgagtaattccactctgaacctgccattctgctccatgtgtcagttctaggaaagggtgcatctgactggcatggcttaggtcacatgtcaactgtggctgccaccctctaagatgctcccctgtcatccccaccaccaagtattcacacgtttgtgcagccccttcccacatggcaccagggttggtctatatgaccaaaagcatgcagcagatgtgctggtttgtcaagtccaaaattaggtggctgtcatctccaggccctcagatcactcactcaggggaaaccctggcatgagcagccctacagccaggcccaggtggtaagaaactgaagtgtcctgacaatagccgagtcagtaaacttgcaaacagactccttgtgcaggcccctcccacattaaaccagagttggtctgtgtgacaacagcataccacagcagaagtgatggtttgccatgtacatgattaggtgataagacaatggcacgctcactcacatgttcatcatctgtcctggggaaaccatgttgtgagcagccctatgcagaggactacatagccaggagctacagtctactgccattggtcacatggataagtgtggaagtggatcctacagccccagccaacagcataactacactctcatgggaaatcctgagccagaaccacccagctaagccactcccagattgctggtgtgcagaagctgtgtgtgagataataatgtctgttgattgttttaggtttccaagatttggggtaatttgttacacagcagtggataactaatacaccaactctggctatacccagctggggagacttacctttgctctgataaaaataacataaacgagactgtagaggttctgttcagaaattattaaggaaagacaactttttcaagtaccctcaagtgtgttcatgattttcagatacatccatttacatataaattgttgtgtgaattgtaagcaatttcatctactcattaaaagaggtttccctgaggattcccactggttaatgctttgcttggtttctgttggtgtatgtgtttcaaaataaaaccaatttaaaaatattccatgattcagacttttgatccataaagacaggctttccaaacaataacctcgatattattctgaatgttttctggaccatccctgtcatgccatcttcaacgtcgatggcaagaaaattcaattactggtgagaacaaatgctaaggcgaagtttcatttgtaaaatgcacagacagaaccagtacccagagaatcaaactaccagcaagagagaaagttttcaatctactacttaagaaagcatgaatatggagaagtgatttaaatgataaacctaattaaatgttcataacaagagcgttgatttcccataggtagttgtatacaattgtaaaattaaataaatagtaattataatgtcagtaaagtagtatgaaactttagcactgagtgagcagaaaagtaagggctgggaaaggttggaggggagatcctgtctttggtttccaaatgcaaatcagcaactttcagtcaaacattccctgacagctaatgactagccatgagcaggggccaggatgatcctttcacagttacctctcaggaaatgtcctcccattggtcattgtctcagtctgcttgggctgccataacaaaataccatagacatagactgggtggcttaaacaacagaaaggtattttctcacagctctggagacagagtccaaacttaagatgtcagcctgttcaattcttggtgagcgctctcctcctggcttgcagtcaccttcttgctgtgtcctcacatggaggacagaacaaactctggtgtctcttcccctttttataaggacatcagtcctgtcagattaaggccatgcccttaaatgacctcatttactctttatcaccacctcacaggccctctctccaaatataatcacatttggggttaggacttcagcatatgaattttgagaggatacattcagtccataacaaaccatcatgccttggttagattactaaatgacccttgagagtctgtaatgaaagcagctttaaaccccactaagaaaatgaaaaatatatgtgtcagcaacttcttggagcagtcaagaaatgatctggatgttcagtaatgctatgatttacttagaactctgttgctatataaccatccacaagtacaaatggattattttccattcaaacttagaactgggccacagtgccctgaattatcaggttgcctgatccagaattttaattatttatacagcaccaactcttgtatttcactgattttaagatacatatttttttcaccttctaacacatcaggaggtgacataactaatagcaccttacaattataattgacactgcttttccttcttaggaatacacattatagtgttgtatctcacaactgatggcatcttagatttgataaaatataggttttaggtactgtttgaattttttttttgttacaaatatcctgtgcaatcttataaaaatgctatggggtaggtactgttttttactccgattttatctttaagaaaatgtacagaaattaactaattcacccagggcctcataactagagattgagaagaggtgagattcaaaccataagatgaaggaaaggttcccctcttgctttatagcttgtattttaccaagtagagcctaaaatggcatctccacctcagcaagtcatgggacatagctcagtttcccactgacaacatctttttcaatttgatgacagtgtttgtgtgattccatacagtctttttagaaatttgtgtattggtgacagtggacaactgatgtggtttgactgtgtccccacccaaatctcatcttgaatcgaagctcccacgattcccacgtgtcatgggagggacctgatgggaggtaattgactcatgggcacatgtctttcccatgctgttcttgtgatagtgaataagtctcatgagatctgatggttttataaaggggagttcccctgcacacactcttgcctgctgccacgttaagacgtgactttgctcctccttcgccttctgccatgattgtgaggcctccccagccttgtggaactgtgagtccattaaacctcttttcctttataaattacctagtttccttcataaattaccatgtctttattagcagcataaaaatgaacaaatacaactatgatctttgaataaggatatatttttatttctttgtaatttcctggcacaggaggtaggtactcggcaacaggtacttaaaggtgctcaaagcctgatggcagaaaataaggatccagtgtgaatggcgcatagaaattgctgcttataattgtttcagcagctcgtgttataacattgtattagttaaggttctccagagaaataggaccaactggatgtatacatggagaaaaagagaagtattttaaggaattgtcccatgcaattatggtagtaggcaagtcctaagatctgcagtctgcaagatggggactcaggagagccatttgtctagtttcagtccaagtccaaaggcctgagaaccaggagagccaatggtgtcattcccatctgaaggtcagcagtcttaaggcccagcaaaagccagtgtttcagttcaggtctgaaggcaggaaaagacttatatcccagctcaaaggcagtcaggcaggaagaattctctcttactcaggggtagagcagcctttttattctattcaggtcctcagcagattggatgaggcccacctacatttgaaagggccatctgttttactcaatccattgattcaaatgttaatctcatccagaaacatcctcccagatacactgggaataatttttaccaagtatctgggtacctcatggcccagtcaagataacacagaaaagtaaccatcacagatgtcttacaaccatgtatgacatacagtattgtaggatgggagaaaaatgaaagctgaaatgcaagaaactagcagctcttgttataaacttacttacttctctaaaaaggtacaggggggatgccttgttcaataagcctggtaccagagagtggccacttcaagtaaattcacttaaaacaaagatgaatttttcctctaaaacagcaggggaacataatggtgtggcgatccatcttgaaaactgaagctaaatattgagaacataacatgaggcccctgcaataagtgagaagttgcagatgaaacttctcatatggagtttactttaagttttgaagtgtgaattggagcaggcaagactgcgttatccagaaatggggctgctcctaggagggaaactggacaaagcaaaaaacaaaacactgtccccttcatgctgttaatcctttcagtggctaagctacttcccttctggctttgtctgggtgggcagatggggggtagatgggtaggtactaatttctatttattttaccaactcttacgtacagcatactatgtgccagagactgttcttggtgctctttgagacatattttttaagtggggaaacttgaaactgttactcgattcctttccacacttctgaaattgcaatcgggttgcatattttctgttcaaaaaagaagacttaaaatactggcagggctgtaacatgtgagatgcctgtttcctcattcaccagaatagttgatgtagacaccattaaaagtgttatgataatccttacaacaaaaattgattgcttcaggactgctatagaggatggattaactttatctgaagaataaatagcttaaatacatatcatttttttcttattaaatatacttttaagaaaagtttcaaacaatagaaaaaatacccatttgtcccagtgcagacagggcttttctattgtgaaagggacaaaatacaaaaccacatctgcaatagaagttcttcagctgaaactacttgaaagctaatagagacacagaaagcatcagattagggagactttctttatgctattatttcccttgcatccttctccttttgttgaaatcctttttccccttcctcctcctgcccagcactagaaaatacaccctcaaagagaagtctcacactccactgatcttcttagaaggcatctgtttgatttgagtgtggttttctgtatggcattttcagcctatctctccacgggagcagaatagaggaaagagaaggctaaatacaagatttcatgaaatgaaagcagaaaatgaggccacagatagtggcttcccttggcgaacatgcccagtattcctagttgcagttctctagtaattctcaactttcttctcctatccctatcccaacttggcttttaatcaaggaagacatcgcagtgtagaagacgatagtagccatttgatggacaaacttggtagtttagttgtgaagacaaatatccactgaggccttactatgtgccagggcctctgccaggtggtgaggataggacagtagaagagagagacccctgtggtctcaaaaagtagagatgccaaatggaattatctgactgttctcctaagatggaagtggatttatcgttacctgctggtaacaaaagacagggtattgaacttaagagtcaaaagaactgagctggaatactagcttccagacttaggtaatttgattaagcctctcagtcttgcatttcgcatgtgtaagtagtacatgacaattatgaagtttaaataaagtgcttaaagaacacagtgaactacttgaaacactgcagatactgaataaatgccttttggcttttattacatatttattcaataattatttgctaaatatttactctttgacaagcacatgctaatataacactgaaaaaaatgagcaaaaaaaaaaatcatcttccttgaagatctttcatattttagtgacaggaaaaacacaaagcaagaaaggtgcaatttaaaataggaagagcctaagaaactaacatttgagtactgagtgagacattaaagctgttgaaaagataaaagccttgcaaaatctgaggggaaatgcccttgtgactagagctgtgtcagagcagaaacaataaggagatgatgccagaaagataatgaaaggtgtgtgggtgattacatgggccccatggatcattatagaggcttgggcttttactcaaagtgggctgagaagccactggatattttgagcttataatgacttaatgtgacatatattttaaaagattctactgtgatcagagcagattaaagaggggcaaggatggaagaagcagagacaccagctcctgccacagtaatccctggaaagctggtggtggcttggaccaatgtggtagcagtggaggtaggaagaagaggttggattctggaagtagaggcttctagatgtggagattctggatgttaagaggctaactccaaagtttcgggtttgaacaagaatggagtcgtcccttaaataaaccagagaaaacaaggagcttggttgttaaatttcatgtcttaaatagacaggtaactgagagaagtccagatatttaagtctggagttcaagagagaaatctggctttaggaaagacatttgctcattattggcgtatgtatctagtattaaagccatgagactagataaaatcccagagggaaaaactgtagctagaggataaagaaaaagattacctctatgttaagagctgggaaagccattggtggccttaatttaaaaaaaaaaaaatgtagcagaagaatggaggtaaatcttgattggaatgggttggagagagagcagaactgagaaattgtagacaataactataatgactatttgagaaatggtgttatcaaggcaaggagagaaatgagaatgccaccaataggatagacagatgttagccgggatttttaagatgtgggaaattacaacatatgtgtatgctatgggggaaaatctcatagagatgtctgaataggtagaaggaaatgggtagagcatcaaaggaaaggctttataggagcatagatggctcatttacagtcttcctctccccagtttttgatacagccgatggtctatttgcagggtatggtttttgctatgcacttcttaaattcatcagaataaagtatgccttgcccacataaaactagtccccactcaacaccaggtgctgtcctgttaagtctgtctatctctcagtgactgtctaaaatatcctatgatgcaaatattacaaaagatgaagaatctcatgaagtcaataaaagtgatgttggggccgggcacagtggctcacgcctgtaatctcagcactgtgggagactgaggcaggcagatcacttgaggccagggattcaagacaagcctagccaacatggcaaaacccgtccctgctaaaattatgaaaattagccgggtgtggtggcacatgcctgaaatcccagctactcaggtggctaaggcatgagagtcacttcaacccaggaggtggaggttgcagggagctgagatcatgccactgcactcctgcctgggcaacagagcgagactcctttttttcctttttctttttgagacacagtgatgtttgagagctgcttgaacaccattcatagctattaactgagaatttggcagatttaggtcaacaattgaagatgagaaagtcaactgaaatattcaaaagagagtgatttaagtagcaaaggcctaaagagagacctttaggaaaattggtgaagctcttgaatgcttttgtgaacatccatgatcatgtggcaaaaggcaattgtaaaatggaggatgatatattagactatattacattatttcccctgaaaagccatgtagcaaaatccagtctaagaattatatcccagctctctttcccttttccactcagagccttcttcctacaccaaaaagatataatgtatttcctaactttaatatatttcaaggaaaatttatcatctgcttggaacactctgtctttgtgagattaactattattgttcgattctaatagatattacaagaaaagttattcaatgggtcaaaaatcaacacaaaaaaatactatattctaaccaacattcctcagtcgcttaccttactttttaagatatctaaaaacctcccaagctcatcacttctaataagtcttaaaatttgtcttcccttactactcaaaacactaccttttctaaggactttccttttgtcagttttcttaatcagaagtctactatctgtttaccactttttttctaataatatcatagatttgaaggttcataatatctcaagatgataaacaccatggaataaatgctctgaggggatctcatcattaggtaaaccttggtctttagtatgtatgacagactacacacacacacacacacacacacataagtatgcatacactgaactagaaatagctccctaagagttagttgatttaaataaataacatatactttcaaatgttatactgagatacaacttacttcttagtgaacctaatccacttatattttgtaaatattccatcaaactgtgttatgaacggtactgaatttgtcccctacaaattcatatgttgaaactctagccctcagtaggattgtatttggagatagagctttagtggggtaattaaggttaaataggtcataaaggtggggtcctaatctgatagcacaagtgtcctcaggggaagagacatcagagagctcattcttccccatacccccacagagaaagaggctatgtgaaaacatagcaaaaagacaaccgtctgcaagctaggaagagagcccccaccagaaactgaattgccagaggtccaagatcaacaacttcttgaagttgtcagacttctagcctctagaactataacaaaataaatttattttgtttaagctgtccagactgtggtatttgtagaagcccccactgactaatacactgtcacttagtaattataacttcataggctgaaaaaaggtgaaatgattcgtattagggagtatcacagtggaaaaataattgagcaaaacaaatcactcgtgtttctgaagagtctctctctgtgtgcttatatatgtagtaaattggctttttagcctaattcattttcgatcactgggaaatatcatgactctcatccctgttgcaatggactgtactgggcactccagttcctgtttgtctggctctggttttactattgcctagtgcttgtaaaggtttcaaactcagcagggccactagtggagaggaaatcaaatgaagtggctccccatgctcagtccatcacaatgagtaccttgcttctgagagagcatagttgcaaagacacagaaaagaatgcaaaaaactctccatttggaggcagttgacaagcagggcactgacactgcccttcactgacatcctccctctaccctaatcatccccctttcccagcatccctgaaaaagcagagtgacagccaagtgtgtggttaaccaaaagacaaagaagccagaaggagcagtgaaattgcttgggttcagtttcaaagaactgttaaaaaaaactatatatatcatatttagaataaagccaaatggagagttagaagataaaaataaacaaaaggacttgttttagtccttataagtccttttcaatatgtgcatttgtgatttcagcaacatttcatccacagttggatagatttcttatttgttcttctactaaatttgtatgcaggaccatctcgtgaacaaaactaaataaatctctgtatgtataatgtagaaattggtgataagtttctacttgtacattttaaatataaaaagtatatttgtattgttaacatcttcccttaggaaattttgttctattttagccctaagtaaaataggctccagcaataagctgcatttttttttatcataacctaaacaatattttaggtgttaaactctcttacaaatgctatttttgtttacacactatatatgtcattaagtatctaagtccagaattaaaatatgagaatgctactctcatgtggcaccatgaatctctctttaatagcacttagcagtaccagatttcaattgatttttaaatttctaattctaattaaagatggcagagtaaccgcctgtgtgtatcttctctctttcctaagaccccactaaaaccaaagaaaaggaaaacataagatctgaactcagaagagcaaagtacagaagtggacacatcagctgttgacagacatttaatagccttttggaggatggaaagcaggtggattaggagtgactgactgagacaggcagaagtggataccgaggggaagagattcagtatcccctcactttaaaggacctcaataggtgcttcaatgcatggggctgacagcaagaggctaagctgaccatcagtgtactcaaaaataagtccattagtcaccattcccatccatattcagagagtccatgcttccataaaaaaggtacaatgctgggagaaagtctccaatatgaaagagaccaaaataaataaacagaaaagatagaactagagaatggagaaacaatgacaaggaacagaaaagcacctaaacataccaataatagtagtactactcaaaaaggagagaaagagaaggagaaagagataatgattagcacttacaatatgccaggtacctaaagtttatatgtacttcctcatgagttttatatatgtgagatcaaatagagaatgaatacactcacctgcacacataaacacacatatataatctcattaagtctttgataatagggacagtaagggaacaagacaaagtttcataaggtcatcgtcaaatactcttaaaaaaaaataccacacatcaaatccaggtaataaggatcctcaaacaatgctgttaacctttctgctatgatacttctcagagagacatatgtacagataatacaaatgctatgataaaaaaatcaatcagacaataatacaaaagcattcttaaattttttaatagctaaaatcaatttttcctaaaaaaaaaactcagaaaattccaaaagcaaagataaagagatgaaaattatgaaagcaaacagaaaatacttagagaaacaatccagatgtccccgaatcctatttcagagataaagaacaactacaaaaagcagagtaaagataccaccaaagaaagaatacatatccaagatcagaaagacttgaattcagttagtgcccagaaacacgggatgaagagcagacctacaccaaggtgtttcctcatggaattcaaattttttgggataacaaaaagaaaattgtgagagctttgaaaagccaagggaaacaaatattaacatgtggaaaaacaaataaaacaattttattatacttatcaaaagtaacactgtatgctaaaaaccaatggactcatgcttttaaaagtctgaaaaagatttccacacccaacaaaactatcaataaagcatgagacttagcaaatatatcagatcctgcctaaaaacgtttatttttttgttttgaatattttatttatttcaatagcttttggagtacaaatggtttttggttacatggatgaattgtatagtggtgaagtctaagattttagtgcacctgtcacccaagtactgtactcaaaacttttattttcattaacacaattatttaataatttaccagaggatatgctatagcaaaataaaagggtagagttagagagagatatggggcccaggaatcaaggaatccaattcaaaagagtggcgaaaggaagccccagactcagtttttcaactagccagtagagaagagaaagccggaatagaaaagaaagccagaatggaaatgatctcgggaacaataggaaatttcataaaatgcataagctacaaacatttacacatgcaaataaagcagttagaaacagaaaaactatccaagaaaggaaacactatatattaacaagaggttataagtaaaatctaaagttgatgtatcaataaattgcaatgtatatatattgattagaaatatggtgttaatatataatatataaaaagagagcagtaattgcaactgaacagtggaatttgggacacagaaagatgagggagttaatttttcaaatatataccagcataattttgataaatctgattatatatttcaaaatctaaccagacagatgattttcaagccatagtatcttacattcataggtaagtccttatatgtatacatacaaatatatatatatatttccacatatcacacatacatatgtgcacacacatatatgcatacatgtacaagaattgattcctttgcatttgataaatatttctaaaaatctataaattttctatccttagtactttttttcctatactgctaaggttattttcaggttaaaaaaaaaatcaaatctttatttgctacatttttcagatttgcttaagcagccaaacacccacatgcacacacaacttgttataagaatactgactaacaattgttaaaacctccaaaatataagatccccaaagcacaggcaagaaaagcaaaaatagataaataggattacatctaaaaagggcttctatgtaacaaaggaaacaatcagagtgaagagatgaccgcagaatgggagaaaatatttgcaaaccatacatctgataaggggtaagatccagaatatataagaaactcaactcaatagtaaaaaaggcaaataatccattgaaaaatgggcaaaagacctaaatagacatttctcaaaagatgacatacaaatggccaacaggtatatgaaaaaatgctcaacatcactgatcatcagggaaatgaaagccacaatgagacatcacctcactccagttagaatgcctattatcaaaaagacaaaaaataacaaatgcatggatgtggagaaaatggagtggttatacactgtcagtgggaatgcaaactagtacagccattatggaaaccagtatggaggttcctcaaaaaattaaaaatagaagactatctcatgttccagcaatctcactacctggtatgtatccaaaagaaataaaatcatatgccaaaaaaaatagctgcagtgtttactgcaatagcatgaagaatcaagatatgaaatcaacctaagtgtccatcagtggatgaatgggtaaataaaatatcgtatatatacacaatggcatactatcgggtcatttaaaaaagtaaaatcctgtcattggtgacaacatggacgaatctggaagacattatgttaaatgaaataaaccaggcacagaaagacaaaccttgcatgatctgactcatatgtgcaatctaaccatgctgaacccataacagtagaacagtgggaaccagagctaagaataggagaggggagaaggagatggggaagagattcgtcaatggctacaaagttacagttagagacgaggaataaattctggtgttccattgcaggggtccccaacctcctccgagccataaacaggtaccagtttgtggcctgttaggaactgggctgcacagcagaaggtaagtggcagacaagtgcttcatctgtatttacagctgctccccattgcttgcattactgcctgagcactgcctcctgtaaactgcacatgggagggatctaggttgcacgctccttatgagaatctaatgcctgatgatctgtcactgtctccaatcactcccacatgggaccagctagttgctggaaaacaagctcagggctctcactgattctaccttatggtgagttatataattatttcattatacagtacaatgtaataataatagaaataaagtgcacaataaatgtaatgtgcttcaggcattccccaaaccatcctcccatcccagtgcatggaaaaatcaagtttgattaaaccagtccctggtgccaaaaaggttggggaccactgttctactgcacagtagggtgactatgattaacagtagtgtatatttcaaaatacctggaagaaaagattttgagcatttttactacaaggaaataataaatgcatgaggtggtggatacgctaccatacccagatttgatttttacacaatgcatacatgtatcgaaacatcacactataccccataaatatgtacaattattgtgtgttagtaaaaaccaaaaaattcccaaaaacaaatgcagaaatcccaccgagtagcatcctcataatatttaattaattaacaatcttttcttgcacaccatctcttaggctgtaagctctataagggcagggaacacaactcctttatttgtggatggatccctgtagtaaacaatcagtaaattcttttcgaattcaggaattaatctttttaatcctctttttcatacatggcttacactaacacagaaaacaactgccgtgtaaaagctctatcaatggccacagaactgccagaggtaccttactatcatgaaactccaggaaaaatatccctgcataggactatgcccaacctccaagccagtcaggaaatcagatccatgaaaaaaaaatatatctaaatataatcccatccaaaagctaaatttgttacatcccagattttgggttgtgggttcatttttgttttctgtttgtttttaatacaattcttgggaaaaacactttgtcaaaaatatctccctcctaaaaacatgactgctttaggaatgatgccaaaattgggtcagttgtaggggttatgcatcttacatgctgttataagggtagaaaagtttgtgacagctcaggacaggttgatgatagcatgttctgaaatgcccagaaagagtctagcaggaaataccattgctgataacagtgattatctgtgaggaatgagactgaggagaaaatttctgaaataagcaaaggctggttttataaaaataaaagcaattataaaaatggaaataaagcagaagctctcttaaccagtgctctaaaacaccagttttcaaactagggtatgtgaacccctagaaatatacaaggaatttccaagggatagatccacagacagtttttaaggaatcaatctccagattatccttcatacatttttaaaaattgggatgatgatggaggcacatgccggctctcaagacccacctcaccttctcccactttataaagaaaatatttttttgtgcaacccatctcttactgatacaggaagagggcagggaagtgccaggtagagaagggtggggtcccggcgagggctccaccctcgggcctgtgcccatggacctaaatgaagacaggcatttctgtttttgtgcccaaaaagttgccttttggcctgccatactcccatcctgttcccgtaaaagcctgagctctagagggcacacacacaagcggctggacatcaagaggagcaggacacaccagcagacaccggcagaccaacaacagcagaacgactcggacaccaaggggagtttggctgggggcggttgaagaagagtccagcccctgggtggcctgtgtccagggaaaaatcaccttctcactccatcccccttctgactccccatccatctcactgagagctacctccaccactcaataaaaccttgcactcatcctccaagcccacgtgtgacctgatttttctggtacactagggcaagaaccccgggatacagaaagccctctgtccttgtgataaggcagaatgtgtaattgagctggttaacacaagctgcctgcagacagaaaagttgaaagaacatactgtaacacacatccactggggcttcgggaatcgcagacatgacacccctagacactgccatgggactggagcccaaaaagtgctccccatggcctctgtatctgcccatctgcatgctcccctttggggtttgagcagcggggcactgaaaatatgagccacaccctgtcgcacttcctgcgagggggataagggaacactcccatctcattactatggaactaggagtaaacatttccagattaaaacccaacaaaaaaagtttaaaaattcgtattatcaaaagtaccacccctccaaatttatttcattaaaagatgaaattccagtaaaattttactaatgcagaagaagtttagatgtcaacttaaaatgtgcaaacagattcagaggtgtgaagaccactaaccacacaacgcctttctagaatattctaacagaatgccacagcataatgaatgctctcacatacgaagagcaagaggtgagcttcatattcaccaaaattgtgtgttaccaaacctgcttacatcatttgtagtagctggaattatgcaacctaattgagtattgtgtaaccaagagaattgcttcttcaaaaacaaatccaaatgcttggtaagactcaaaagcaaattgtaaaaaaaatgcaaccaaatgaggaatgggcaaaataagtataaaagggagggatgaagattttttttttaattctgtaaggcttcacaagtgtctaaggcctacacctcattttaaccagaaaacttgaaattcagggatgacataaaatagatgagctttatggaagcaagaccatatggaattcagattttcaatccacgttcaacgaagagccttgatcatccatcagatgattggtaaatgagttcatttatgggtattaagttcaaataaaatattaaggcatgtgtgacggttaatttcaggtgtcaactggatattaaggaatacttaaaaagttggtaaattattacttctgggtgtttctgtgaggacatttccagagggacctggcatgtgagtcagtggactgagtagggaagagccatcattaaggtgggtgagtgccatccaattagctggaggcccagatagaacaaaaaggcaaaagaaaggtgaattctctccctcactctcctggatctgggacactcatcttctcctgcctatagacatcagaactccaggctctctggtctttggactctggggacttaacactagcagccttcagccttggactgagagttacaccattggcttccctggttccaaggcatagcttcacgttggggcaggccatcagaaagaccaagcacaggattagagggttggaacttccagtgcctggatgggtagagggaggggagctggacttggactgaggcatgctaccagcatcccagggtttccagcttgcagactgcctgtcatttcttagcctccatcatcacatgagccagttcccctaataatcccctctcatccatccatccatccgtcaatccatccatccatccatccattcactcatcctattggttctgtctctctggagaactctgaataacactgcatgtttcatctttttaaaacaataattccttctccaaatgactttttctgttaatcagacaactaatgatctcaatcatctatatgagagagcatctattaaaattaaaagtcatgattaactccagctcagtcattctcaaaaaggtcccctataatagggaatattataagcagccggaattatgcaacctaattgaatattgtgcaaatattcaagactgaccccactttagatgtcaggccatctgcacttctgaccaacttgactacaaattcaggggttcccacaagtccctcagctttgataattcactagaatgactcatcgaactcagcaaagctctatatgtatagtttccattttattataaaagatacacatcaggcaaggtctggaagggtcctcgatgtggagtgtccataccctctccccttggattcagggtacaacaccctcctgaaacatcaatgtgttcaccaatcaggaagttccaccaagctttggtgtccaaagtttttatcaggatttcaatacttaggcatgattgattatatcactggccatgtgactaaacccaatctccagctcccctcctctacccatgcagacactggaagttccatccctctaatcctgtgcttggtctttctgatgacctgcccccacctgaagctatgtaaggatatgactcactgagtcacctcagtagcatatcaaagacactcctatcactcagcaaattccaagggttttcaaagctgtgtcccaggaaccagacacattatttattatgccacatcaggtaaattaaaatggtggaatggtgacaatttagttaaatttctaataaaattttcgtttgacagatgaagattaagagcagaggcacttaagaagacatgagaaggacagggaaacaaggaataatgtgcgatgaaaacagcaataaaaaaaacttatagcaagcgtgagacttactcaagcagtaaccaacagcctaagatcagaaccgtattgtcaacatgtttgtccaaagagtagttttcattcagaaacaaagcctctggagcgagagaccaaacagaaatggaccttccttcttcatccaggagatgaactacagcagtcaagctaggcctgggggtagacattagagaggctaacaataaaaatagggatcttctcccaagctccagtcctaggagaggtggcaatacttggaaaggtagcctctggaagtagtttactcctggaaatacctgctaagatcaatagcaataaaaacctggaatttataaacaaggccaaatgtttatagtataatgttaatactactgaattatttcattctgctgcaagcattagatagatggaaattaccccatacttctgtaagagactacattttattgactatttaatacacattatctcctttgaaatggctcttgaaccggagggaaagaaagataagaccatgaatacagaggcactgcttgtggaaaggaaaattctctccacactctctagtctcaagcaacatcagaaagaaaaccaagaaatacaattaaatggaatatcagtaaatgttgagcattccacctgaatcttgccttttactttttaatagcacatatgagagaagcagtagagcaaagatcaattaatcaacaaatggtattgggtcaactagtagccacttggaaagaaataaatttgaatttatataaaatgctatatatcaaaatacactccaggtgaatcaagaattttaatgtaaaataataaactgtaaatgcactatgagaaaacatgagagatcctcttttcattctttcatttagtagtaagaaagccctttctaatcaaaacatgaaatcagaggcataggggaagaaaactataagtgactctgtgaaaaggaaattgtgtagctaaaatttataaaaataaaaataaagtcaaaacataggaggaggctctatacttgttctcgggatattaaaaagctgcaaaaaagaaagctattcccatcataacaacaaaggctagataatgtacaaaatcttaactatctttagaccctcagaaagtaacaaagaatgagtgaagtaaattccaaaggatgtgaggatgttaactgacatttgtcagaccaggggaagaaacggtagctgctatacaggcagacaatcagaaaacaactcagattttagctatttgttaaagcccttatgtgagctgggagcctctaacacaataggatttgggggaatttgtactcactcttttccaatttcctccactgggtgctcatgagaaagcttggggacagtgcaagagaagacagagagagactcactaggcagtgtaggtttagactggggataagctgtcactgtgaaataggcacaaaacacaatgctggggagagtaatgtggcaggaaatctgttccctccccaaaccaccttaccgctacacatacaagggaaaattcagctgccatggagagagtatgaggagcattcagaaagccccacccttggaagcagaagagccaagaaacagtacccctgttcccaactcaagtattgaacttattcacaagctactccagcctacctttggggaggggacaagagcaaagagagagacttcttccacgttgcagggtgttcggggtttgctcaaagctgagggtgaagcaggaaatcttaaaaatgtactctggtaatacaggtcccatattgaccacaagtagcaacactccagagctgaaggcaagggaaggctgtggggacccgggcaatgatagcaacaaccaaaaacaaatccagcttaactgctggctagattgacccaactcctggcctgatagcagaagagatagacctgtttcctgtcataaatcataaataatatttacttcagtatcctgttccacacatactgtccagcattcaataaaaaatgatgagattcacacaagaaagcaagaaaaaatgacccagaagacaatggagcaagatctttgaagtactaagagggaaaaagcaaaaaactgtcaacccaaaatgttatgtttaaaaatgaaggcaaaatatagtacaaaaattaaagtagaatttcaaaaagtattcaaaaatggcagagtaacagaggaatggaggaatggagggacataaaaagagaggcagcaagcagaaaacaaaaaaataagccggtagactcaaacctaaacataataataattataatccagggtaacaaactaaataattcaattaaaaggtagagaccgtcagaatagacaaaaacaagacccaaatatatgctatctataagaggttcactgtgagaaacaggaaaattaaaagtaaatggatgaaagaaagatacaccatacagaaagtaagcataaaatggctggaatcactatattagtagtagataaaacacagttccaaacaaaaggcattatcatggataaagaggaacatttcattataacaaaagggtcagtttaacagaaagatatagaaagcctgaaagtgtatgctgtaaagctttaaaatatgtgaaacaaaagtgttggaactaaagggacaaagagaccattctacatccatagtttgagattcccccttctctctgcaactaatagaaataactagacaatattaacaccaccaccatcaatcacagcagaactgtcaaccagctggacttacttactatttatggaagagtacaaccgacaacatcagaatacacattattttcagcacgtgttaagtttatcagaatagaccatattgtggaacataccgtaagtctcagtaaatttaaaactattaaaatcacaaaaaacatgatatctaaacacaatttaattaaattagaaaccaataataagaaaatcagaaaaaccatttggaaattaagcaacaaattactaaataatcatcaagtcaaagaagaaatagcaaaacaaattataatatattttggtgtgtatgataattttttaaaagacaaaatgaaaaccttcttggaccaacaaaagctaaataaattattgtcagcaactcagcacaataagaaataataaagacatttcttcaggcagagcagaaggaatatgacactgcatagacatttcaatatatatataacgaaataatgagtgctggaaattataaaaatatgaaagattttttcttatttttaatcttcatactataactgtctaaagcaaaataataatacactatggaatttaaagcagtagatagaggcatgaaacaaaagcacactgcgggaacatatttatgatatacataaggcagtatattatttgaaggtagactgtgagacaaagtgacatattttaagcttcagggtagcactgtccaagaaaacattctgtgtagataaaaatgtgccatatttatactgtccaatatggtagccactagccaaatgtggatactgcacacttgaaatgtcattagattacctaaggatatgaaatttcaagcatttaactgtaaattaattaaaaatttaaatttaagcagctacatagggatagtgcctgccttattggatagtaaagcccaagaataaccatttttaaagaaagtacaattaggaggtatagataattagtaataatggtgggaaaatagaatcataaaaactactcaattcaaaaaaaggcagtaaaacaaattaagaatatataaaagtagagaacaaatagtaatatgcaacagtcatgtgctacataataatgtatctgtcgatgacagacgacatagacaatggtggaagtatgaggttataatactgtatcttttctatgtttagacatacaaatacttaccattgtgtacaactgcctacagtaatcagtaccataacatgctgtccaggtttgtaacttagaagcaatagcccataccatataacctaggtgtgtagtagtcaataacatctaggtttatgtaactatatgatatgtgcacaatgacaacattacctaacaatatctttcttagaaagcatctccattgttaagcaacacatgactgtagatttcaatttacccatatcaaaaattatcttaaatgtaaatcatttacacacactaattagaaaggcagagattttggaatgaataagcaagaaaacccaactatttgctgtctataagaaacccactttaactataaagatatacattaatcaaaagcaaaagaatgaaaaatatataccatgcaatcactcatacaggtaactttgaatggctacattaatattaaattacaaagtaaacttcagaaaagaggattattactagaagtaaaaacaggaacttcataatcataaagaggtcaatatatatcaagataacaacataatcctaaatgggaatgtatctaataccagagtttcaaaataaacagagcaaaaactcatggaactaaaagaaatagacaagcacgcaattacagttggagactgatatggtttggctgtgccctcacccaaatctcatcttgaattccagtgtattatgggagggacccagtgggaggtaattgaatcatgggggtatgtctttcccatgctgttctcatgacagtgaataagttttacaagatctgatggttttaaaaagaggtgttcccctgcacaagctctctctcattctctctttgcctgctgccatccaagtaagacgggacttgctcctccttgccttctgccatgattgtgaggcttccccagccacgtggaactgtaaatccaattgaacctctttcttttataaattgcccagtctcaggtatatctttagcagcagcatgaaaacaggctaatacaataaattggtaccagtagagtgggtgttgctgaaaagatacccaaaaatgtggaagtgatgttggaactaggtaacaggcagaggttggaacagtttggagggctcagaagaagacaggaaaatgtgggaaagtttggaatttcctaaagacttgttgaatggctttgcccaaaatgctgatagcgataaggacaataaagtccaggttgaggtggtctcagatggagatgaagaacttgtcaggaactagaggaaaagttactcttgttatgttttagcaaagagagtggcagcattttgccctgccctagaaatttgtggaacttcaaacttgagagagatgatttagtgtatctactggaagaaatttctaagaagcaaagcattaaggaggtgacttgggtgttcttaaaggcattcaggtttaaaagggaaacagcataaacgtttggaaaacttgtagcctgaaaatgagatagaaaagaaaatcccattttctgaggaaaaattcaagccagttataaaaatttgcataagtaaagaggaaccgaatgttaatcaccaagacaatgggaaaatgtctccagggcatgtcagatacctttgtggcagcccctcccatcacaggcctggaggtttaggaggaaaaaatggtttcatgagctgggcccagggtccctctgctgtgtgcatctagggacttagtgccctgcatcctaactgctccagccatgactcaaggggccaaagtacagctgggctgttgcttcagagggttgaagccccacgacttggcagcttccacatgatgttgagcctgcaggtgtacacaagtcaagaattgaggtttgagaacttctgcctagatttcagaggaggtatggaaacacctggatgcccaggcagaagtttgctgcaggggcggggccctcatggagaatctctgctaggacagtgaagaagggaaatgtggggttggagcccccacacagagtctctactggggcaccacctagtggagctatgagaagaggacctcagaatggtagatccaccaacagcttgcaccgtgctgctggaaaagctgcagacactcaatgccagcccatgaaagcagctgagaggagggctacaccctgaaaagccacagaggaggagctgcccaaggctgtgggagcccacctcttgcatcagcatgaccttgatgtgagacatggagtcaaaggatatcattttggagctttaagatttgactgccccactgaatttaggacttgcatggggcatgtagccactttgttttggccaatttctcccatttggaatgactatatttacccaatgcatgtacccccattgtatataggaagtaactaacttgcttttgattttacaggctcataggcagaaaggacttgccttgtctcagatgagacaatggactgtgaacttttgagttaacgctgaaatgagttaagactttgggagactattgggaaggcatgattggttttgaaatgtgaggacatgagaattgcgggggagccagaggtggaatgatatagtttggctgtttcctacccatatctcatcttcaattcccatgtagtgggggagggaccctgtgggaggtaattgaatcatgagggcaggtctttcctatgctgttcttgtgatagtgaataagtctcatgagatctgatggttttaaaaagaggcattccctgcacaagctctctcattctctctttgcctgctgccatcagtgtaaaatgggacttactcatccttgccttccaccatgattgtgaggcttcctcagccacatggaactgtaaatctaattcatactctttcttttgtaaattgcccattctcaggtatgtctttatcagcagcatgaaaacagactaatacagagaccttaaaacttgactctcagtaattgataaaacaagtaaacaaataatcagcaactggctggtatttatggaaaaagtatgcccaaaagcatcagaatacatatttttagtacaatatggaatattcatcaagtcagatcatattctaggacataaaaaaaaaaaaaccttaaaaacctaaaaggcatacctggcaggttctttatctacaaaggatttacactaaaagtaaataaaagaatagtatttggaaaaatccaaactattgaaaagtaaacaatacattcctaaataattcatggctcaaaggagaaatcataaaagtattttagaatatgttttaatacaatgaaaataaaaatagaacatatcaaaatgtgtgagacatatctaaagcagtgaccaagggaaatttacaaaaatagatccttatattcaaaaacaagaaaggtcctaagtcaaaaacttaagattccatataacttaaaactatataaagaagagcaaattaaatccaaagcaaaaaatggaaaaaaataacatcagcatgaagcaatgaaaaagagaaaaataattaaaaacaactaatgaaacaagtctgctcttcaaaaggccagttaaattgataaatctccccaaattaatcaagaacaaaagagaaaaaatatgtattaccaatattaataacaaaaagggaaacatcactactgattatattgataataaaaggaaaaatggtatattatgagcaacttcgtgccaataagtttgataacttatttgaaaaattcctgaaaaacaaactaccaaagctcattccaaaagatactgacaatatgagtatctctatatcaaataaattaaaattatactttaaaaccttcccacaatgaaaaccacatgtctaaagacttcattgctgaatttttcctaacatttaaagaagaattaatataaattctacacaaactcttccagaaaaaggaataggagggaacatttactacctcattttatgtggccagcattactctgatatgaaaaccaaagacactaaaaataaagaaaattacagacagatatctcgcataaaatagatgcaaaaatccttttaaacactagcaaatcagtaagaactaaaaccacaaaagtcttagaaaaaagtatgggggtcaatcttcatgactttcgatttagcaatgaattcttagatgttacaccaaaacacaagcaaagaaacaaaccaaataagtaaactgaacttcatcaaaatttaaaactttaagtatcaaagaatactttcaagagtagaaaaacaacggagaaaatgggagaaaatatctggaaaatctatatctgacaagggtctagtatccagaatacatcaaaaactcttacaactcaacaaaagaaaaaaggacaaacaacccaacttataaagggcttgaatagatatttctccaaagaagataccaaatggtcgagaagcatatgaaaagatgctcaacatcatcagtctttaggaaaatgcaaatcaaaaccacaatgagataccacttcacacccaagaggatggctgtaagcaggaaaacgtaagtgttggcaaagatatggagaaattggaaacttcatacatttctgatggggatgtaaaatggtgcaaaacagatgttcaaacaaaaacttatacacaaatgtttatggaggaattactcaaaatagccaaaaggtgaatacaacccaaacgtctatcaatggatgaatgaataaataaaatgtgatatattcatacaataaattatccagtgattgaaaaaaaattgagtactgatacatgctacaacatgaatgaaccttaaaaacatgatgctaagtgaaaaaagaaaaaagacagacaaaaaggccacatgttgtacaattccatttatatgaaatgaccaagacaggcaaatccctagagcagaaagcaaactagtgatcgccagggctaaggagagggagggggaatggggagtagcagtttaaagcatatgagatttccctttggggtcatgaagacagtctggaactagacagtcatgatggttgtacaacattgtgaatgtactaagtaccactgaattgaacaccttaaagttgttttaaaaatgtgtattttacaacaataaaaaagcaaatcatttccagcagtatataaaaataataatatgtaatgaccaagtaaggtttatccaaggaatgcagttgatttaatgttaaaaatagatcaatgtaactcaccaatatgaccatgtcagtagatgcagaaaaaatatttgacaaaattcaacatccattcataagaaataaaattctcagaaaactagaaatagaaggaaatctcttcaacctaataaaaggcacatacagaaaacctatagcaaacatacacaactatgaagatcaaatgcattccccctaagactgggaacaaagcaggaatatttgctctcaccacttccattcaacattgaactagaggtcctagccagtgaaaatcaggcaagaaaaagaaataaaaagcaaataaacctatttctatttgcagattacatggtcattcatgtagaaaatccaaaacaaaggcagacagtctcagaaccagatagacaagcacagaggagcttcatccagcctgggggcctcagcactgtgaccaaagaccaaactgagatgaggagaggccttccaagaataaatttaggaaaacaagaaaaagatatttgtaaacactgaggacttttctcaaagaaaatggaaaggggacagtgatccaaaaaatgatggctctatctgtttcagagtttcccacctagtttttttgactctccagatggctccagagtttgcaagataaacttcaaagaaaaatcacagacacacacacacagagagagagagagagagagagagagagagagagaaagaaaaagaaagaaagaaagaaagaaagaaagaaagtaagaaagaaagaaacaaaaacaaagaaacaaagaaaaagagatggactgaatagataccaaaataacaggtgtgattgtcactaaataaaaagattgttgagacttcagttttcttctttttgcttttcaggttttcccaagtttatttttataatgaccctgtttactcttgcaataaacatttgtcttaaatggaaaaaaaaggtcaaaacacaaatgacaaattagggaaaagatgtgcaacaagacagatgcagctattttcttcaatacataaagagttttaaaaatcaattaagaaaaggttaagaatccaaagggtcacacgttaacagaaacacagattgcttgtcatcatatgaaaagatgctcaacctcactaataattaaagaagcaaaaattaaaataattctgactagcaattttgaaaagctttatgattcaaagtgttaagagagattatgaggggaaggcacaacttttgatgtaaatggctatattgtgaaaatattgcaataaaatactagtgtgtccggaattggtgggttcttggtctcactgacttcaagaatgaagctgcagaccctcacggtgagtgttacagctcttaaggtggcacatctggagtttgttccttctgatgtttggatgtgtttggagtttcttccttctggtgggttcacggtctcgctggctcaggggtaaagctggctcaggagtgaagctgcagacctttgaggtgagtgttacagctcttaaggcggtgcctctggagttcttcgttcctcccagtgggtttgtggtctcgctggcttcaggagtgaagctgcagacctttgcggtgagtgttacagctcataaaggcagtgtggacccaaagagtgagcagcagcaagatttattgcaaagagcaaaagaacaaagtttccacagggtggaaggggacccgagtgggttgccactactggctcaggcagcctgtttttattctcttatctggccccacccacatcctgctgattggtagagcccagtggttctgttttgacagggcgctgattggtgcgtttacaacccctgagctagacacaaaggttctccacgtccccaccagattagctagatacagagtttggtcccaaaggttctccaagtccccaccagagtagctagatacagagtgtcgattggtgcattcacaaaccctgagctagacacaaggtgctgattggtgtgtttacaaaccttgagctagatacagagtgccgattggtgtatttacagtccctgacctagacataaaggttctccaagtccccaccagaatagctacaaagtgtcgattggtgcattcacaaaccctgagctagacacagggtgctgattggtgtgtttataaacattgagctagatacagagtgccgattgatgtatttacaatcccctagctagacataaaggttctccaagtcctcaccagtcaggagcccagctggcttcacccagtggatctcgcactggggctgcaggtggagctgcctgccagtcccgcaccatgcgcccacactcctcagcccttgggtggtcgatgggactgggcgcctggagcagggggctgcgctctcgtcggggaggctcaggctgcacaggagcccacagaggagcaggggaaggctcaggcatggcgggctgcgggtcccaagccctgccccgcgcgggaaggcagctaaggcccggcgagaaatggagcacagcagctgctggcccaggtgctaagcccctcactgcccagggccggccggccgctcctaatgcggggcccaccaagcccacacccacctggaactcgcgctagcccacaagcaccgcgtgcagccccggttcccgtccgcacctctccctccatacctcccagcaagctgagggagacggctccggccttggccagtccagaaagggactcccacagtgcagcggcaggctgaagggctcctcaagtgccaccaaagtgggagcccaggcagaggaggtgccgagagtgagcgagagtgagcgagggctgtgaggactgccagcacgctgtaacctctcactagggcacttttcttaagaggcatctaaatgttaaatgcacaccctctttaacttagcaattctacttctagacatttgttctacagatgtatttgcaaacatacacaatgatcatgtacaaggccgttcagtactctttcacaataccaacaactggcaacaacccatatgtccatcaataggggactggttaaataaactacgttaagtccccacaatgcaggaaggtgatctatatggcttgatatctagaattaaattaataaagcaaattgctggatgacatggagagcattctctactttgtgtttttttaaaaaagtagatataagtttagaaaagtactggaggacaccagggcacacgtttatctatataacaaacctgcacatcctgcacatgtatcctggaacttaaaattaaattttaaaaaaagaaaattactggaggaaacacaagaaaatagttaactatgaggccaggtgaggtggcatgtgcttacagtaccagctacccaggaggctgagatgggaggatcaggtgagcccaagagtttgaggctgcagtgtgctacaatcacacctatgagtaaacactgcagaacagccactgcattccagactgggcaacatagtgagactccaccccttcaaagaaggaaagagttagctatggttacctctaatagctaaatgtttatatacactttctactgtttgaaatcttaccacatataagtattagcttttataatcacttagtcttaataatgtactgtatcttggttttctactttgtaaaatggtaataattatctagctcatctcagaaggtaattgtgaataccaaatgagaaaatacagatgcacgaaagtgatttgtaagctttatatgggtgatccacaaactgcatataagttaggtattattgctaatcatgattattttttcagctacaggaaatcattttatgactcaggatttacaatgggtaggtctgagaaaattttaatttactggggaaggataaatgtgaaataaaggctaagaacattgctacaaaatgtatttgtggaagaaggtttttgtcttgttttgcctttaaggacagaggagaaaaaataaaaagagtcaggaaaaaatatacaaagctcatgcagaaagttatttctgtgctaaataaaaatgtaatcctatataacatttttaggtccttaaaaatgaagatataaaacctcacatgaagttccacaggagcctcataattaaagaagagtcagttgaggccaaggtgatccaaagagaaatatgtcccctccatgctgagtgaattttaagcaggtgtttgcaggtatcaataaagctaatgttaaggggaaacagaaaaacaaccagacctaagagtattcagcggagactgaaattgcaacaaactaaccccctacactcactattaaaagctcattaactcccagctgttcatccattaggctgagaagaagaaaaagcacatgccctcactgtcacatatttataccagaggttttcatctcataaaggggaaagagaggggagataaggagaagataacaatcataattatatcaccaggctgtggagaaagctgtgctaaatataataagcctctcaggcaataaagtcagatgaatgtccaaagtctgccattgtaaagaagaaagaagggaagagggcgaacgtccatcggcatcacgggactcgtccttgagccacttacacatcagagccccttggctcatctcactaggtcacatctgatctacaccacaagcagcaacacttgcaaataaaattattttatcctagtcattcgctatggtacagtccctgactgcatcaaattaaacaaaagaaggcataatgaatacaaatcaaatttaaagcaatctatgcacaaaccattattttccttaaagaatgatggattggagctgcatgttgtgtaataaagcttctagacgagcactcaaaactagcaacttgtaacccgattccaacccacaggtgtttcatttgggtcaaggctctgaaaatgttttagttgttagtacttaaaaatcaagagatgtaactcaatcatctctctccagtgtgtccggcaaaattggaagattgcaatgctggctgtgcatttgcatatttctgtaagaggtaagactagttcctttaggtatttgagggttttgatccattatagccccagaagagtacacatttaaaaataaaatagagctttctctacataaatcttgcacagtggtgtgtaacacgtggctgcactttctcacctcattttcatggcagtatctctatagctccagcctcaatcatctgactgtattccttaccaccttctccctcactaccctggccacactactgctgctcctcaaacatgccaatcacctctgcctcaggacagctgccctcactgtcccctcacttggaacattcttaccccagatatcatcgggctggctccttcatcttctttgaatctttactccaacatttcctttttcggagaggtcatttctgactatgctatttaaaagcacaagtctttgctgtgcagaaacttttagtttgatgcagtttccactcatttactttttgcttttgttgccagtgttttggtgtcatagccaaaaaatcattgacaagaccaacatcattgagcttttcacctatgttttcctctaggagttttatagttttaggcgttgtgtttacatattttttttttaagagacagggtctcacttcatcacccaagctggagtgcagtggcatcatcatagatcactgcagcctccaactcctgggctcaagccatgttcctagttcagcttcccaagtagctgggactacaggcacacgccaccatacctggctaaatttttattttattttattttatttttgtagagacaggatctcactatgtcactcagctggtcttgaactcctgggctcaagctatcctcctaccctggccttccaaggctctgggattatatataggtgggagccatcacacccagccatgtttaaatctttaatccatttgggcctggtgtggtggctcacgcctgtaatcccagcactttgggaggctgaggtgggtggatcacgaggtcaggagaccaaggccatcctggctaacatggtgagaccccgtctctactaaaaatacaaaaaattagccaggcatggtggcaggtgcctagtcccagctactaggggggctgaggcaggagaatggtgtgaacctgggaggcagagcttacagtgagctgggatcgcgccactgcactccagcctgggcgacagagtgagactccgtctcaaaaaaaaaaaaaaaaatctttaatccatttggagttgagttgatttttgtcaagcactagttgaccatatattccagggtttatttctgggctttctagtctgctggcctatgcacttctttttatgcctgtatcatactgttttaatgacaaagtttgctaagagagtagatcttaaatattcttaccacacacatacacacacaggtaacaatgtgaggtgatagatatgttaattagctcaactgcggtaatcatttcacaatgtatatgtatatcaaaatatcacattagacaccttaaatatatgtaatttttatttgtcaattgtgccttaataaagctgggggagcacatctctgaccccagctttatttttccccatagaattcatgacatgttatgctttatttgcttatttactgtctatccccctacacatgatgctcaagagggcaaaaaaaattttctgattcgttcactgccatgtaattagtttcaactagtgcctgacacgcagtagccactgtaaaaatatccatcggatgaattaactttgtttctcatcagaaaacaaaagaaatgcacacatttaacacatacccacacacatcaataaaaccgtggtaacctctcacctctaaaatgaggatataattcactggcaatagacttgccctacaagaaatgctaaaggatattcttcaggctgaagggaaaccacatcagtgggaaacttggaggaagaaaatcaatgaaggaagaacaacaaaaattgttaatatctgggtaaatatagtctatttttcgcctcaagttcttaaaaatatgtataactgttgaaagcaaaaattataacattttcgaatagagttttcaatgtatgtagatgtaatatatataattatcatataaagggaggaggataaagagatgtatatgcttgtgaggcttctacgttttgctaagtgtcaaaatattaactctaatgcagactttgaaagatcagatatgtacattttaagccctagagcaatcactaaaaaagaaaaaaaaagaagcataaaaaagtcaataaataaattgaaatgaaatactaaaaattattcaaataaaagaaagcaggaaatgggaacaaagaagcaaaaggcaaaggtgacaaacagaaaacaataaaatggtaaacctaagtcaaaatatttcaataattacattaaatgtaaatgatctatgcatacaaattaaaagagagattatcagattagataaagtgagaatactcataatttaacaaaataaatggggaaaaaggaccatgctgagtatactcaaatgagtcatgttatacagtaagttctcaggtagaaggtcagcatcatattcatatggatatgagaatcccctaaatgactactgcaaatgacctcaaatctgacatttgtgcagaggcatcccaaccagggaacaaagtggtacaatggcatagtaacaaaggaaaatgtgccaactggggagaacacaggagcagtgaggggtgaaaggacctctcctaccttttgtaccacccttagcactaatgaaggaaggaagcaagtctcaggaaccctactttggccatttttgctctctggcccacttcctcaacatacttatttcctttcaaagtatttatggcaacccccaatgtgtgtagtaggtcagtggaaggataaggcaaacgtggatggatgcaaactcttataagcacatgtgaccaaaaggaagaaacatggtaaagaactaaaacaaagtcatggaagatagagtcatctttctcctatggactgatctcaagccacctggtccacaaaagggaaccaacttaagtatctgaccacacatggccctggggcactagtcacactgtccatgctctctgcacaacacaagtattagaagttgaattgtgtcccatcagaagatatgtttaagtcctaatccctgtaaatgtgaccttgtttggaaataagacctttccatgtgtaatcaagttaagatgaagtctaatctaacatgctggtgtccttgtaagaagaggaaaatgtcatgtgaagacagaggcagagagagtatgacaatggaggccgagattgaagtgctccaactcaagccaaggaatgcctggggctaccaaatgctggaagacgcaaaaaggatcctcctctaaaggattctgagggagcatagccctgccaacaccctgattttagacttctagtctccagaactgtgagagaataaacgtttattgtcttaagccacccagctgtagcactttgttatggcatccttaggaagctaatgcagcagaggactatatttctctttataacgtatcatcacttaaagacaaagaaaataagaaaataaatgactttgtttctgtcaggaagcccaagaaataaaccatactgtgcctcactctcttgtcatgaagcagagatctcaaacttcaaagactacaaggtaaataagaaaggcagctatgttacctagtaggacacagaagcaaaagggagccctgtcccagaggagcagcagcttttcagctctagatatgtgaaacttttgttagaaactagaaattagaaccttgatgtggtatttccagaatctaaaacacagcacagtgggccaaacctggcccacaggccaccagtttataatccctgctctcaggcatactcctgtaccctaaggcagagatttagattctaaaaaaaaactctgagactgtcagaaaattcagaggactttcaatatgtaatggcctactaatggatttcattagttttctagtttttctcaaattattaaacaatctaattgttcttagaaacatgccatcaaaacccatctttgcaagctcatttcactcattcgcaaaatgaaaggctgaactaataccatattattaagtattacttatcaagaataagaagttagcagactaaaaagtcctttcatcattagtggagggaaatcatcaattattaatcttatttctattttttggttgagaaaattagctatgattatacatatagactcacccattgacaatcatgttctccctcaatgagtcaatgaaaatttttggaagagagagaggtgatgtctcaaacttggagggacatactatgatttcatagtctgggatatgacctaggtgttctgatttttaaaagcttccccagtatcttagcatgccgcacagtttgcaaacctccacagtagacaaaaaaagaagaaatttttctaacattaggatagtattctttctctatttcagatacaaaatatgacacacacatactccaaagataaacccctcaaagctctcaaagtttcagaacagattgatttattctatctcttgccctgctgttcattgacaaaaatcttctgtgttcccaaattggtctgcggttgcacatgtaattttgtaattattgttcatgcagcaataattttcatctaagatcttttcaaattaactagattaaaagaatgccacttatgaacaaaatacattctgaagatagaaacaactttgcttccattcctaatgaaactcagacctttcatcttaaattcaagcaaaatctcaagcactaaaatgagtttgatactttcatatttctattaaactgaggccatctacacaaaggtaaaaagccttcttattctcttcatgatccttatacagctgtgctactgcttccatgagatcaaggagttatgttgtctcttaatggcaggattacatttttcctatatttctgcttttattattcttgagttcgcaaagcatctcaattttggcaggcaaatataggcagttaatcactctctgatttcagggacatagaaactgatttatccaaatgtaccctgggagatggatctttgagtgagattgtctaattccattcagaaaaaaagaagatggttcactggcatgagcccaacatttactaaatagaaaaggagaatggaatattgtttttaaattccaccaagcagactgaaaaattaaaagaatatatggacaataactgcactcagacggctattgctctattgaaaacaccctccattctaattgtttgcttgtaattcatttcagggtttggttttgcagcaaactgcttcagataagcaatcctatttggtggttcatagctaggcagcccaatttggaaatccaattgccgcttatgcaataattagtcagaaagctaaattgcaaaaatggcattttaactttgagcttatatttgagcaacagagcattaaaaacacttagtatgaatcaatgctctctcctgtaacagttaactgaacttcatgaagagtaaaaattatgatcttttgtgaaaggaatgagtgaaactttgagctggttttttaaaaaggagctgccatttttattgctgtgcttgagttacggactttaaaaactgcttcatgcatgcaagtttaattcaccctgtaacaatgaatcaaatgtaggtgcagaaagaggaattacatagagataaagtgcaattcagaaaatgccatccctttacctgccggtctatataataactcaagatgtaaccttactgtgtttaatggtgtaatcaaaaaatgtgtcaagacactggaattttgaagctgttccacgtacaacacatccctgatgactcatttaaaagtggacaggttgtcagaatcaatgggacataaacatcttctattccctgaggagctttgaggatcctgacctgtataaaccctgatttttttcaaactcctctctttagaataaaaggatattcttgaaaattctaatatctttttgccaagctttggtagatacatgagaatttattttgccattgatgagaacatggaattcatgttttaaggagtcactgtccatgaacccaagctaaggaaagactactccaattaatttgtgtcacttttttcccctctacttatccttcctgaagaactaatcattaacatggggaggtttgttttctactctggctgttttcatttctcctgtcataatttaaaaagccacagggtaaataaagatcattgtatttcactcatgttaaatacatgctgcattattacaaagtaatctaacacccggctttaaagtcccttactttcaaataaatataaacaacagggacagctctagccttcagatgactttctctcctcccccgcaccattcacagctgctcagctctcccctctccttagcactttcatatcgtttctattttctgtgactccctcttttcatcatattgctttcaaaattccacactgtgtagtgatctcactagtgaacggctatgcctacctgcagatgtcacagttggcatccctgcctgcagcccaataagccaagaagacatctctgtcgatcattttggtggggtaaaatatatacactccatacctcagaaagcatgatgcagcaccattatttaatatgatccaacaattctgattccctttattatttttaatagccatcctattaataccactaatgcagagagataagtcataggaattgctcccaacaaaaagacaaacagaaaaaaaaaatacagctgttgcagaaccaagagtagatatagatgaaaaaacatatcctaccaagtgttagaaagcctaaactaagcctgtttttgaatcagatttgtgtctcaatacacacacacacacacacacacacacacacacacagacacacagtctttttgtcctcagcacacagggtctgagagataaataatactttatatgcttgtaaaataaaggacagattccatagttattcagataaattagagattattttgtgctgggagttcagcaggaaagactcaaagaggtgaagatcttagctaggtcttaaagagattcagatactgataacagagagggtacaacgcattctagatggagacagctttgacaattgttagtttggggccattcagtatccattaccctcaatgctagtaacacatccaatttccctttaataaaacacccttcccccattctcaatcttctggtttacatgaggccctaccttccagcttcagctacagatcatatgaccccaacctaagatggccaacgccttgcatttacccctagccacaaccactgatttagtcacgagttattgactcaagcttacccaagcaagaccccagttagggctaactcagggtgttctgccgtattgactagagttcattgctctatcctgctaaaccaaaatttacaaggatgtaatgcttgagctactgtcatcatcttgccaccacatggaacccaaaaataaatacaaaatccagaggaaagtagaggcaaaagataaagaaaaactgaatcctcgagctactgtttgaagctcaagcccatttggtgaggccatgttttcctggatggtgttggtgcttgcggatgttcgttggtgtctgagcattgaagggttagttatttaatgtagtctttgctgtctgagtttgtttgtacctgtcctcttttgggaagacattccaggtattcaaacagatgtgggtgttgtgatctaagccatatctgcattatggggcaccccaagcccagtaacaccgtgattcttgcacacttgtaaagtaccacgttggtggtcttggagaagagctggaagaattctctggattaccaagcagagactattgttttcttcccttactttctcccaaataaacggagtctctctctgtgctgagctgcttggagctaggggtggggtgacacaagcacccctgtggccatcaccactggactgcactgggttgctaaaaactcagggcaagttctataggccctaaataaaccacttgctggttgcagtgggcatatataacaatgattaggaaataaagcaataaatgaaaaattagtgacaaactgtagaataacaaacacctgattataaggttcagatttaaagaaattatacactactacagtatatataattctaatatagacaatatctctccacttttaaaggacaaaagaaatcctttggccttaggaaccaaaaagacacagtgcaactataaatatactggaattatacattccaaaagaatgtggcagggttgctactcactatttttaaaatctatatatgtaactctaaatggatcaaaaacctaaatgtaagacctaaaactataaactcttagaagaaacagggaaaagcttcatgacattagatttggcagtgatttcttagatatgaccaaaagcgtaagcaacaaaagaaaaaataaattgaactacatcaaagtttaaaatttccatgcatcaaaagacataactaacagcttgaaaaagcaacccacagtttgagaggaagtatttgcaaatcatgtctctgataagaggttaatatccagaatatataaagaatccctataactcaaagacaaggaatcaaacaccccaatttaaaaatggccaaaggactagaatagacatttctccaaatatatacaagtggccaacaagcatatgaaaagatgctcaacatcactaatcacaagggaaatgcaaggcaataccacaaacaaaaacctgctccctttcattacaatgactactatcaaaaaaaagtaaataaataaaatagaaaatagcaagtgttgttgaggatgtggagaaaacagaacctttgtgcactgctggcagaaatgtaaaatggtacaactactgtagaaaacaatacggcatttccttaaaaaagtaaaaacagaattaccacatgatctggtaatcccacttctggatatatatccaaaagaattgaagtcaaggacctgaacagatatttgtacagccgtattcatagtgatattattgcaatagccaaaagacagaagcaacccaaatgcccatcaaccaatgaatgaataaacaaaatgtggtatgtacatacactggaatgtcattcaggcttaaaaaggaagacagggccaggtgtggtggctcacacctgtaatcccagcactttgggaggctgaggtgggtggatcacgaggtcaggagaacgagaccatcctggctaacacgttgaaaccctgtctcaactaaaaatacaaaaaattagccgggcatggtggcacacacctgtaggaccagctacttgggaggctgaggcaggagaatcacttgaacctgggagacagaggttgcagtgagctgagatcatgccactacactccagcctgggcaacagagtgagactccatctcaaaaaaaaaaaaaaaaaaaaaggaaggcagttctgacacatgctacaacatggaagaacatgaggatattatctaagtgaaataagctggtcacaaaaagaaaaataccatacgaggtacctagagtagtcaaattcataaagacagaaagtagaacggtggttgtcagaggctgagggtgacgaataccatcaccctcagttattatttaatgggtacagagtttcagctttgtaaaatgaagagcactccatggatggatccgtagcacagcgatgtgagtatacataatgccaccgtactatacacttaaaaattggtaaaatggtaaattctatgctttgtgcatttcactacaattttttaaatgtttaatgaaataggtgatgaatgaacaacatatttctcaaaaagaatataatataggtatatcttcatccagctgtcattcaccatcaaggatttcatcacacagtatctcacaagaaaaacctagacgatcctgtttttattaaaaggtggcatggcaatattctttcctcttttatgatacctaggtaccaaaatttacttgatgcaattggtaaatggagatatgctgaagtcagctggtgtgtacaaaggtgaatgcaggggaagagataatgcagaaatgaaaaatattcacccaatttatcatgttaattggtgtttataaatctaaaaatataagtgtcttgtaattatggagcaaagaaaatggcttcctctcttcaacaaaattatgagccatcaattttttcaaaagtatgatgttttgacaatgtaagtgcaaacaaaattaaaataaccagaagtaataagtagaaccctattagaaatgtatctggaatctggacttaatttttataagagggatatgttccagcttcatgcatggcagctgttgaacatttagttgcattcaagggacattgctcatttggggtatgcacaccatcaagagcacaaaaatataaaatcatttgttgtttagattcatataaatgtgtgaataacagcttgggatataattcatataccatacaattaagtcaaagtgtacaattcagtggtttatgatatattcggagttgagctatgtttgaattcttgttaaaacttgtaaaactgttttttactaaaataaaactacatacaagataaaaccatcaactaacttttttaagagaagcagaactagtaaaattgagtcatacaaaatttaaaaggaacaagaaaaaataaaatatgcaaatttaaatttcagcgtggtcattgcaattaagtttaaatatgtcactggtaaattaagatgaaaaggaaactgcaatctgttttattgtagtcctggtttgttttatgttaaaagaaagacataccttgaaaaatgctttactttctaggtgacagggagccactgaagagtttttgagcagcaaagcatcaggagtttgtggtagacagaataatgtcccccctccctcaagatgttcacgtcctaattcccagaatcttatgaatgtgttgtcttacctggtatcttagtccattcaggctgctgtaacaatatatcataatttgagtggcttataaacaacaaacatttatttcttacagttctggaggctgggaagtccaagatcaacgtgtctgcagaggccctgattcctggtcctggaacaaagccctctctctgtcctcatatggtggaagagactagctctgcagtccctttcataagggtactcatcccactgatgaggcccctgccctcatgaccgaatcacctcccaaagaccccacctcttaataccaccaccttgggggttaggatttcaacacatgaattttgagggatccacaaacattcagaccatagcacctggtaaaagaggctttgcagttgtgattaaatcaaggagccaaaaatggggaagctatccctggttagccacgtggtcccaatttaatcccatagctccttataggaagaggcaggaggatcagtcaggaagaaggcaatgtgacaaaggaagcagaaggagaaaaggcaaagtgatgagaggccacgtgctaaggaatgaagatagcctctagaacctgaaaggggcaaagagatcgtgtctccaacccctgggccatggaccagtgcctgtctgtggcttgttaggaaccaggctgcacagcaggaagtaagtggccagtgagttagcaaagcttcatctgtatttacagccgctccccatcactcacattacagcctgagctccgcctcctgtcagatgagcagcagcattagattctcacagaagtgtgaatcctattgtgaaccgcacatgtgggggatctaggttgccgctccttatgagaatctaatgcctaatgatttgttactgtctcccattgcccccaaatgggactaattgcaggaagataagctcaagactcttactgattctgcattatggtgagttgtataattatttcattatatattacaacataataacagaaataaagtgcacaataaatgtaatgcacttgaattatcccaaaaccatccttccattccccagtccatgaaaaaaatgtctttcacaaaactactctctggtgccaaaaatgttgggaaccactgccctagagcatccagaaggaaccagccctgccaataatccagcactatgagatgataaatttgtgttgttttgagcaactcagtttgtgatcatctgttacaacagcagtaggaaattaatacagaataacggtgctgaccctgaaccccagtgagcacaacaacaatctgagtataaaacacattttcttacagggattctatcccagtcacttacagaatcaaacttgtcgaaacagatagaaccatggagtggacgttacccagcccctcaattttgcttatgaaggaaactgagccacagagtggccaagcaactgccccaacttagagagtgtgagttctctgccttcctatccacactcaactccccaactggtctgctccacacttgcttctcagctcgccagggactggcaccagaatggggaggccactcttgaagaatttcattaaggcacgtttgaaagcttgtcaaaacttaggagaaaagaaagtcaagttcttctacgtgtgcatattccacaaatttaataagaaccgaagcacttgaagaactgagctggaatctttattaacaagacagggaactgaaaatgaggctaaggaaaaggcaaagctatgagatcaaaatgatgggacatcagctttgtcaccaaagctgtgggcaagaggcaggaatttgagaagagagaagatgccacccctttgactgctccaaagctagttaggctttcaagtgttgaatggccaagagatgcctggatgaaaaagcccatcattaacttgcatgactccctccagactccagaatttcacagccagacttcttctggatttaaatcccaagaaagtgtacccaccatgccagggctatttgttttatttttatagagataaaagatttaataaatattgcttttctgatggtcatagacatgtaggtttccaagtgaaactctcatccacgtccccctgggccaaaatatcggaagggattattgttttgctgatgcattcctgttttattctgtctttgtctaactggccatcatagctttgaactagctctagaatccctgtgaattttgctacagcctttgggggaaatatataggtccaggttaagaaccacccaaatctcttttccaccagatggctcttcagtggctaacataaaaagctgggattaagtagcttctcagttcttaaagcatttccacacacagcacaaattgcagtggtgcttttgcttttcttactacaaatatctgttgacacaacatgaatgtcacccagaaaggcatttttacctactacacatctatcgtggcaattcatttaggtcttatcaccataatctggctcaagggttagtgaaccttttcttaaaagaccgaacagtaaatattttaggctttagaggccaaactgcaaaatcaaggctgttatattggtacaatcattttaaaaatgaccacttaaaaatgtcaagattattctcagctcatgtgccctacaaaaagatacagtgggccagatttgatcaaagtttaccaacctctgatcaagataattaagaaagcctatttataggtggaaaaaaatccattaatttgaattttgaacttgtcccctaatcattcaaataatttacacaaaattcgatgtatttttttttccagaatccagcaatctacagtgtggtacaagatgcaagccagccactcgtatcttcagatttttcttccaagtaaatgcagcaaagcaatattaatacacatctatgttcacaaagtttttcaaaataacaaaatggaggttacattaaatttttactctgttacaaaataataatggtggtattaagcaataggaaaaactattccaattgatatcaccagttagctaactttcatatgcagttttgccatctctaattgacattttataaatggtatctttttctaagtgttccattttgattcataccaatctgttggcattacacacaaactggaagaaaatatggagcattctaattcaagtatcctaatttacatgctaaatcagaaggtcaaaatcaatctgtcatctttagaaccttgatcataggcccagaaataaaaggtagcatgttgatttctttaggggaaggggggttggcaggaaggataattgttaaaaaaaaaaaaagtaccaagtttcaacatgagtttagaacaccaaaatttagtgcactagaagataaatactataagaagtgctttggtatggtgagtatggctttgttgaagttgaaaattgttcttcattctctgatagtagttgagcggcagatggcctgaagttatcataaatatgtaagccctagaagtactctgctttgaagagcagccaaaacacaatagtgctgaacaacacagagcacacagagaactgtctgacacatatagagaaatgagaatctttccaccgcacagtaacatttctaagcatagaacatccgagaaatcaccttagcttctccatgtagaattaatgcatatagcaaccctgttttttaaaggttacgtggttaggaagttggcctttcaattaaattaccacattttcacaatatagaacttgaagtggagctttgattgctttcttctttggcaatttgctgtcaaaatccaagcttacagggatgctgagctgtacaatccaagagagaactctcagaagacggtttgttctagctttttttcccttgttcccttcttcctaattcagtacctgaaatgccatccaaaatgatctctactgaaaatgtccttcgttgccaaattacaaacgtagctcattttctatccactacagccagttattattttgtagttaccaggcttcagtaaataaatacatgtgagagccatctatctatttgttaatgcttattatgttctgtgctagataatgagaaataaatagatgaataatttaaagagaacaattcctctttctttgtgtttctacagaatgggtttgaaactgctgcctggttccacttgctccttcaaatgggaagagggagatttgatttgattggtgaaatgacaagagtccgacatccactggtccttaattctgtcctgggcaaggctgatttattcccagttgctgtgtttatgtggccttgctttgttcaagggacatgatgaaagccatgatcagacatgatcgttcataggggcctgttttgccatgtgtaagtcccaaggagaaaactcaaggcagggagggaagtactaagaagtccatctaggctcaagggttgattctcgttctctaacccagtttaaccagtggtgaaactgaagttttgattcctctctgaccctgtgtttgtttttcaatagcttcagtaagtgggaaaaaaaaaaaacagggatgtgactcattgtcttcctaaagccctaccaaataagatttctgccctcaagaggctcagggcctttaagggtctctacatctctgattctttttttttttttttttttttttgtgagacagagtcttgctctgtcacctaggctggagggcagtggtgtgatctcggctcacggcaacctccacctcccaggttcaagtgattctcttgcctgggattacaggcatgtgccaccacacctggctaatttttgtatttttagtagagatggggtttctccatgttggctaggctggtctcgaactcctgacctcaggtgatccacctgcctcagcctcccaaagtgctaggattataggtgtgagccatcatgcccagtctatttttcaaactttatataattaaaccatagtaagaaacaaggtgtaacccactgctccacgaaacatcatgaattcaattcaaccccttaaggaaaacataaaagtaaatcaccaatccacacttttaaagcatctctgaataaatcattatataaaaggtatcagttacacataaaacaacataaaccactgctcaatgaaataaaagaggatacaaacaaatggaagaacattccatgctcatgggcaggaaaaatcaacatcgtgaaaatggtcatactgcccaaggtaatttatagattcaatgccatccccatcaagctaccaatgactttcttcacagaattggaaaaaactactttaaagttcatatagaaccaaaaaagagcccacactgccaagtcaatcctaagccaaaagaacaaagctggaggcagcatcacgctacctgacttcaaactatactacaaggctatagtaaccaaaacagcatggtactggtaccaaaacagagatatagatcaatggaagagaacagaggcctcagaaataatgcctcctatctacaactatctgatctttgacaaacctgagaaaaacaagcaatggggaaaggattccctatttaataaatggtgctgggaaacctggctagccatgtgtagaaagctgaaactggatcccttccttacaccttatacaaaaattaattcaagatggattaaagacttacatgttagacctaaaaccataaaaaccctggaagaaaacctaggcaataccattcaggacataggcatgggcaaggacttcatgtctaaaccaccaaaagcaatggcaacaaaagccaaaattgacaaataggatctaattaaactaaagagcttctgcacagcaaaagaaactactatcagggtgaacaggcaacctacaaaatgggagaaaattttcacaacctactcatctgacaaagggctaatatccagaatctacaatgaactcaaacaaatttacaggaaaaaaacaaacaaccccatcaaaaagtgggcaaaggatatgaacagacacttctcaaaagaagacatttacacagccaaaatacacatgaaaaaatgctcatcatcactggccatcagagaaatgcaaatcaaaaccacaatgagataccatctcacaccagttagaatggcgatcattaaaaagtcaggaaacaacagatgctggagaggatgtggagaaataggaacacttttacactgttggtgggactgcaaactagttcaaccattgtggaagtcactgtggtgattcctcaaggatctagaactagaaataccatttgacccagccatcccattactgggtatatacccaaaggactataaaatcatgctgctataaagacacatgcacacgtatgtttattgcggcactattcacaatagcaaagacttggaaccaacccaaatgtccaacaacgatagactggattaagaaaatgtggcacatatacaccatggaacactatgcagccataaaaaatggtgagttcctgtcctttatagggacatggatgaaactggaaaccatcattctcagcaaactatcacaaggacaaaaaaccaaacaccgcgtgttctcactcataggtgggaattgaacaatgagaacacatggacacaggaaggggaacatcacactctggggactgttgtggggtggggggaggagagggggatagtattaggagatatacctaatgctaaatgacgagttaatgggtgcagcataccaacatggcacatgtatacatacgtaacaaacctgcacattgtgcacatgtaccctaaaacttaaagtataataataacaaaattttttttaaaaagtacaaaaccagagaagaaaaaaattaaaataaaaaaataaattatcagaaaataactcaaaaacaacaatttgagtacaaaaggtgggtcttgaatttgtgtgactttaagtacctgacaacattgtgaacactgtaaaaagcaatatgccaaggacttgggcagtatttcattttatagtttatgcctcagtagtcaggaaacagaaaaaaaaataatactttccccgaagtctgtgacatggcattttcttgttaagtaaggagaaaaaatagttttcctcaaatttactagtagatagaagaagagacagtcttttagcagtttccacacattctaattgcctgctttaaaaactgtcaaaagcaacaaacaagaaaaatgttttaattcaaatgacatttctgaggaagtacaagtaagcccaagccatttagtttatcattctatgttacatatttatgtcatatattatatactctattaagccttttgtaataaaagtttttaccctaactcttttacatacaagagttggccaagagtatataagatagcaatgatacacaaatatcaccaacattcattcaatagttgtttactgtaatggactaaatctttacatcccccacaattcatatgttgaaaccctagcccctgcaatatgatggtggtagaaggtaggacttctgggaggtaattagaattagatgaggtcatgaggatagagtcctcatgaatgcaatcagtgcccttataggagtcatgattgaacttgctttcccttctctactctctaccatgagaaaaaaacaagaagtctgcagtctgccacctaaaatctgaccatgctagaacctaatcttggcttccaggctccagaactgtgagaaatgaatttctgtcaagccactcggtatatggtattctgttacagcatcctgaaaggcctaaggcatttactgagtgctaacatgtaccagaaactagtctaggagctggaaataggagaatgaaccaaatgaagtcctgccaatgcacttctactttgctgatgaacatgaataactaagcatatcagacatgtccagcatgaagcatgctaactccttttctctgcaatcctgccccttgtttgcctcagctgatcggtctagggcagctaatccacaggctggctagtgacttgaatcatgtgcctgaaatttcaaaaacaaaatcaaaacaaaacctcaccatgttgggtttatcctcttccagtgcttagaatttgaacaaagattatcaaaagacaaaggcaattagcaatagaagctgaagctgatagttcatgtctgtctatctctagggaggacagtgaggccttgttaaggcataggcaagctgatattaccacgcagcggaagcaatgatgaagaacaataattcccaaatccaagccagactggccacaagtagacatttttgaaacatggggcattgtagcttgtcacaagaattgggtagacaatgacatttgatatcttacaatgctcctggagtcctgcaaaatgaagaatcatcccaaaatcttcactactcttaatgatctgcagggcattcacataggcaaaaacacacttgtaattataagagcttagatcctgacttgactttgcacctgaatacaaagtatgtttatatagtgttagaaatcactgtctattaaagttaggagtgccattatgtcaatccagagagttgttttgttcagagctttatcaagagacactcaccatttcatgtagctgcatcacctacataagattgctttgtattaagttcaccaacctaacacacctttgctgagctgcatttgaagctgtgtcattcacaaagatttgacatataattgcaagtatctggtaacaacaatatgtcctctggtgttgtcatgccagagcatctacatattgagctacagattattgtatgtgtcttcttttgtgtctcccttataatacagtagagcattatattggaagggtgtttaacatatgtatatagattatattatgtgtaaaatttagcacagaacagtaaaggaagtgctacaaaatgtttattagaaaaaaatggggtggggtttgatgaagttgaaaatcactaagatagaaaagaaaagaaaggggttaagttactagtcagagtagagaggaaggaacacacaggaaagcagagtctcacaagacagaattgttcacatacatgagcaagcccctaaaaatgacccttccactggcagtttccagctggtcctgggccctcaaccgtcccacctgagtccagcaattgaaagcatcctttgtctcctgtctcatgacctctctaatccatccttctatcataacagttgtcctagaatgaagcagtactaatgtcttcatcttatgcaaaagctttccaaatttccaaattatcttcaagtgttgactatctagacccaacctaccttaaaaaaataatctactgccttcttaaaccctctgaatgagccaccatagcctactttttttcctaatatgttatgagcagtcccaaattctatcttcatacctttgacttctctgatttccccatgacaaattccattcttatctctaatactctaaactctagactttcctttatggttcagttcaatttccacaaacacacacccttagtgagcatttcttcctctaaaaacctagagataacaattaagtgtggcacagcagtcagaataggttaagttacactgcaataacaaaaaagcccaaaatatcaatggctcacaacaagggtttacttctgacttaatgtcaaatgtctactgaaaatgagccatgtttctggctccatgtcatcctcattctagtacacaaatcaagggagtaggctttacctggaacattgctgcttatcatgatagtaggaaaagaacatagaaacccccactaactttacacttttgtccaggaggtacacatgtcacttccactcagatttcatttgttaaagcaactcacatgatcaaacatgtcaatgaggcagagaagggaggagcaacaaatattttcaaataaaattaaaatctgtaataatcaaatcaacttcatagttaacaattgctttcaaggaatgcccttttaccctagaacacagtgcaagtttcatggttagcaacaatccatttacaggtattctactcaaatatgatgatagaagtgagcttacacattttaaagtacagatcaaaacaatgaaagcacagaatcaatcaaaataaatgtttcattgaagccaccagtttttaaatttggtttaccagtgcaatgaaattccagtataacaaaataacttgaacattaaagttcactataacagtatgggaatagttacttgtctagaaatataattggttgccaatatgatttgtttgtgattttttttagttttgaaatatgcaaattttaaatagtgaaatctaaaatattattaatgtctccactatgttgattttttttttttttttttttgccgtgcagaagttctctagtttgatgtaatctcctttttctattttttcttttgttgccagtgctctgggatcacagccaaaaaaaattattgcccagatcagtgtcataaagcttttccccgttttttcttctagcagttttatggtttcatagtcttatctttaactgcattttgagttgatttttgtacatggtgtgagacgagaatctaatttcatccttctgcatgtggatacccagttctcccagcaccatttattgagagattgccctttccccactgtgtgttggcattgtgttttggcacctttgtcaaaaatcattggtccgtaaatgtgtggatttatttctgggcactttattctgtccccttggtctatgtatctgtttttacgccagtaccaggttgtttaattacttgcttgtagcagattttcaaatcgggtaacagattttctaatcatgatgcctctggctttgttctttttgttcaagattgctttgactattcagggtcttttgtggttccacatgaattttagaattcttttttcctacctctataaaaaatgtgattggaatttgataaggaatgcatggaatctgtacattgctttgggtaatgtggacatttcaacaatagtaattctggagctgttcctattcggccatcttggctccagtctacagctcccagcatgagagacgcagaagatgggtgatttctgcatttccaactgaggtaatgggttcatctcactggggagtgtcggacagtgggtgcaagacagtggatgcagcgcaccaagcatgagccgaagcagggcaagacatcacctcacctgggaagcacaaggcatcagggaattccctttcctagtcaaagaaaggggtgacagacggcatctggaaaatcgggtcactcccaccctaatactgcacttttccaacggtcttagcaaacagcagaccagaagattatatcctgcgcctggctctgagggtcctatgcccacagagcctcactcattgctagcacagcagtctgagatcaaactgcaaggtggcagtgaggctgggggaggggcgcccaccattgccgaggcttgagtaggtaaacaaagcagccaggaagctcgaactgggtggagcccaccgcagctcaaggaggactgtctgcctctgcagactccacctctgggggcagggcatagccaaacaaaaggcagcagaaaactctgcagacttaaatgtccctgtctcacagctttgaagagagtagtggttctcccagcacacagctggatatctgagaacggacagactgcaacctcaagtgggtccctaatccccgagtagcctaactgggaggcaacccccagtaggggcagtctgacacctcacacggccaggtactcctctgagacaaaacttccagaggaacaatcaggctgcaacatttgctgttcaccaatatccactgttctgcagcctccgctgctgatacccaggcaaacagggtctggagtggacctccagcaaactccaacagacctgcagctgagggtcctgactgttagaaggaaaactaacaaacagaaaggacatccacaccaaaaccccatctgtcggtcaccatcatcaaagaccaaagggtagataataccacaaagatggggaaaaaacagagcagaaaaactggaaactctaaaaatcagagtacctctcctcctccaaaggaacgcagctcctcaccagcaacggaacaaagctggacagagaatgacttcgacaagctgagacaagaaggcttcagatgatcaaactactctgagctaaaggagtaagttcgaacccatggcaaagaagttgaaaaccttgaaaacaaaattagaagaatggataactagaataaccaatgcagagaagtccttaaaggacctgatggagctgaaaaccatggcacgagaactacatgatgaatgcacaagccttagtagccaattcaatcaactggaagaaagggtatcagtgatggaagatcaaaagaatgaaatgaagcgagaagagaagtttagagaaaaaagaataaaaagaaatgaacaaagcctccaagaaatatgggactatgtgaaaagaccaaatctatgtctgattggtgtatctgaaagtgacggggagaatggaaccaagttggaaaacattctgcaggatattacgcaggagaactttcccaatctaccaaggcaggccaacattcaaattcaggaaatacagagaacaccacaaagatactccttgagaagagcaactccaagacacacaattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaagaagaaatgaaatcctttacagataagcaaatgctgagagattctgtcaccaccaggcctgtgctaaaagagctcctgaaagaagcactaaacatggaaagggacaacaggtaccagctactgcaaaaacatgccaacttgtaaagaccattgaggcaaggaagaaactgcatcaactaacgagcaaaataaccagctaacatcaaaatgacaggatcaaattcacacataacaatattaaccttaaatgtaagtgggctaaatgctccaattaaaagacacagactggcaaattggatcaagagtcaagacccatcagtgtgctgtattcaggaaatccatctcacacacagagacacatataggctcaaaataaaaggatggaggaagatctaccaagcaaatggaaaacaaaagaaggcaggggttgcaatcctagtctctgataaaacagactttaaaccaacaaaaataagaagagacaaagaaggccattacataatggtaaagggatcaatttaacaagaagagctaactatcctaaatatatatgcacccaatacaggagcacccagattcataaagcaagtccttagagacctagaaagagatttagactgccacacaataataatgggagactttaacacccggctgtcaacattagacagatcaacaagaccgaaagttaagaaggatacccaggaattgaactcagctctgcaccaagcagacctaatagacgtctacagaactctccaccccaaatcaacagaatatacattcttttcagcaccacaccacacctattccaaaattgaccacatacttggaagtaaagtactcctcagcaaatgtaaaagaacagaaattataacaaactgtctctcagaccacagtgcaatcaaactagaactcaggattaagaaactcactcaaaaccgctcaactacatggaaactgaacaacctgctcctgagtgactactgggtacataacgaaatgaaggcagaaataaagatgttctttgaaaccgacgagaacaaagacacaacataccagaatctctgggacacattcaaagcagtgtgtagagggaaatttatagcactaaatgcccaaaagagaagcaggaaagatctaaaattgacaccctaacatcacaattaaaagaactagagaagcaagagcaaacacattcaaaagctagcagaaggcaagaaataactatgagagcagaactgaaggagacagagacacagagaacccttcaaaaactcaatgaatccaggagctggttttttgaaaagaacaaaattgatagaccactagcaagactaataaagaagaaaagagaagaatcaaatagacacaataaaaaatgataacaggataccaccaccgatcccacagaaatacaaactaccatcagagaatagtataaacacctctatgcaaataaactagaaaatctagaagaaatggataaattcctcaacacgtacaccctcccaagactaaaccaggaagaagttgaatgtctgaatagatcaacaaaaggctctgaaattgaggcaataattaatagcttaccaaccaaaaaaagtccaggaccagatggattcacagccgaattctaccagaggtacaaggaggaactggtaccattccttctgaaactattccaatcaatagaaaaagagggaatcctccctaactcattttatgaggacagcatcatcctgataccaaagcctggcagagacacaacaaaaaaagagaattttagaccaatatcactgatgaacatcgaggcaaaaatcctcaataaaatactggcaaaccgaatccagcagcacatcaaaaaccttatccaccatgatcaagttggcttcatccctgggatgcaaggctggttcaacatacgcaaatcaataaatgtaatccagcatataaatagaaccaaagacaaaaaccacatgattatctcaacagacgcagaaaaggcctttgacaaaattcaacaacccttcacgctaaaaactctcaataaattaggtattgatgggatgtatctcaaaataataacagctatctatgacaaacccacagccaatatcatactgaatgggcaaaaatgggaagcattccctttgaaaactggtacaagacagggatggcctctctcaccactcctggtcaacatagtgttggaagttctggccagggcaatcaggcaggagaaggaaataaagggtattcaattaggaaaagaggaagtcaaattgtccctgtttgcagatgacatgattgtatatctagaaaacgccattgtctcagcccaaaatctccttaagctgataggcaacttcagcaaagtctcaggatacaaaatcagtgtgcaaaaatcacaagcattcttatacaccaataacagacagacagccaaatcatgagtgaactcccattcacaatcgcctcaaagagaataaaatacctaggaatccaacttacaaggaatgtgaaggacctcttcaaggagaactacaaaccactgctcaatgaaataaaagaggatacaaacacatggaagaacattccatgctcatgggtaggaagaatcagtatcgtgaaaatggccatactgcccaaggtaatttatagattcaacgccatacccatcaagctaccaatgactttcttcacagaattggaaaaaactactttaaagttcatatggaacccaaaaacagcccgcattgccaagtcaatcctaagccaaaagaacaaagctggaggcatcacactacctgacttcaaactatactacaaggctacagtaaccaaaacagcatggtgcaggtaccaaaacagagatatagaccaatggaacagaaccgaggcctcaaaaataatgccacatatctataactatctgatctttgacaaacctgacaaaaacaagaaatggggaaaggattctctatttaataaatggtgctgggaaacctggctagccatatgtagaaagctgaaactggatcccttccttacatcttatataaaaattaattcaggatggattaaagacttaaatgttagacctaaaaccataaaaaccctagaagaaaacctaggcaataccattcaggacataggcatgggcaaggacttcatgtctaaaacaccaaagcaatggcaacaaaagccaaaattgacaaatgggatctcattaaagtaaagagcttctgcacagcaaaagaaactaccatcagagtgaacaggcagcgtacagaatgggagaaaatttttgcaatctactcatctgacaaagggctaatatccagaatctacaataaactcaaacaaatttacaagaaaaaaacaaacaaccccatcaaaaagtgggcaaaggatatgaacagacacttctcaaaagaagacatttatgcagccaaaagacgcatgaaaaaatgttcattatcactggccatcggagaaatgcaaatcaaaaccacaacgagatgccatctcacaccagttagaatggcaatcattaaaaagtcaggaaacaacaggtgctggagaggatgtggagaaataggaacacttttacactgttggtgggactgcaaactagttcaaccattgtggaagtcagtgtggcgattcctcaagaatctagaactagaaataccatttgacccagcaatcccattactgggtatatacccaaaggactataaaatcatgctgctataaagacacatgcacacatatgtttattgtggcactattcacaataccaaagacttcgaaccaacccaaatgtccaacaatgatagactggattaagaaaatgtggcacatatacaccatgggacactatgcagccataaaaaaggatgcgttcatgtcctttgtagggacatatatgtagctggaaaccatcattctcagcaaactatcacaaggacaaaaaaccaaacaccgcatgttctaactcataggtgggacttgaacaatgagaacacatggacacaggaaggggaacatcacacaccggggcctgttgtggagtggggggagggaggagggatagcattaggagatatacctaatgttaagtgacgagttaatgggtgcagcacaccaacatggcacatgtatacatatgtaacaaacctgcacgttgtgcacatgtaccctaaaacttaatgtataattaaaaaaaaatagtaattcttccaatccatgagcatgggatatctttccatttatttgccacttcttcaaattctttcatcagtgttttgtagtttccagttgaaaaatcgtttatgtacttgagtaaatttatccttatatattttttgtagctactataaatgggattgttttcttgatttcttttccgatgtgttgctactgtacagaaatgctgatttttgtatgttgattttgattatgcaactttactgaattcatttattagttctaatagtttttatggaatcctcagggtttttcatatataatatcatgtgatctgccaacagagaccatttaacttcttcctttctgacttgggtaccttttacaggcgtatctctgagatattgcaagttcagtttcagaccaccagaatagagcaaatgttgcaagaaagcaagtcacacagtttttatttccccgtgcatataaaagttatgtttatattctactgtagtctattcaataactttatgtctaaaacacttaactgaaaaacacattattgctaaaaaatgctaacaataatttgagccttcaatatgtcataatctttatgctggtggaaggtcttgccttgatattggtggctgctgactgatcaaagttgtggttgtcaaaggctggggtggctgtggcaatttcttaaagtaagacaataatgaggtttgatgcatcaattaactctttcatgaaagatttctctgtagcatgtgatgctgtttgaaaacatcttatccacagaactttcaaaactgaagtcaattctctcaaaccctgcgttttatcaaataaatttatgtaatatactaaatcctttattgtcatttcaacaatgttcacagaatcttcacaaaattccatctcaggaaactactttctttgttcatccgtaagaagcaacccctcatccgctaattttatcataagattacagaaattcagtaacatcttcagactctacttctaactctcttgctatttctactacatctgcagttacttcctccacagaagtctcaaattcctcatagtcatccatgagagctggaatcaacttcctgccaactcctgttaatgttgatcttttgacctcctcccataaatcatgaatgttcttagtggtatctagaatggtgaatcatttccagaaggttttcaatttcctttggctagatccatcagagaaaataactatataaagcagctataatgctaggaaatgtatttcttaagtaataagacttgtaagttgaaattattccttggtccatggactgcagaatggttgttgtattagcaagcatgaaaacaacattaatctccttgtacatctccatcaggcctgttgggtgaccaggggcattgtcaatgagcagtaatatttgaaaaggaatctcttttttttctgggcagtagttctcaacaatgggcttaaaatactcagaaaaccatactataaagatatgtgctgtcatcctggctctactcataggcagagtagacttagcataactctgagggccctaggattttcagggttgtaaatgagcactgggttcaacttaaagtcacctgcatttcctctaacaagagagtcagcctgttctttgaagctttggagcctagcagtgactactttctagctaggaaagtcctagatggcattttcttccaatagaagtctgttttgcctcccttgaaaatctattgtgtagcgtagccactttcatcaatgatcttagctagatcttctggataacttcctgcagcttctatatcagcacttggctacttcatcctgcagttttcatgttatggaaatggcttctttctttaatcctcaaacctctgctaccttccaacttctcttctggagcttcctcacctaccttcagccttcaaagaacttaagagagttaggggtttgctttggattaagcatgttactagagtgttgaggctggtttgatctatccagattaaactttctccatatcttcaataaggctgttttgcttcaaaaagaaatcattcatgtgttcactggtatggcactgttaatttccttcaagaatttttcccttgcatccacaacttcactgtttggtgcaagaggcctagctttcagcatatcccagcgtatttcaaaatgcctttctcactaagctttatcacctgtagcttttgattcaaaaggagacacatgtgactcttcctttcacttgaagacttaggagccaatgtagggttatcaagtggcctaattgtaatattattgtgtctcagggaataggaaggcctaaggagggtgagagagatgggagaacggctggtcagtggagtaatcagaaaacacacaatactcatcaaataagttcaccatcttacctgggcacagtgcatggtgtaccccaaaacaattacaatagtaatgtcaaagatcactgatcacagatcaccataacagataatcataataatgaaaagtttgaaatattatgagaattacccaaatgggacatagatacatgaaataagcacatgctgctggaaaaatggcactgatagacttgctggacatagggttgccacaaaactttaatttgtaaaaattgcaatatttaggctgggtgtggtggctcatatgcctacaatcccagcattttgggaggccaaggcaggtggatcactcaaagtcaggagctcaagaccagcctgggcaacatggcgaaagcccatctctacaaaaactgcaaaaatcagctggcatggtgacacaaacctgcagtcccagctatctgaaggctgaggtgggagaaccacttgagcctggaggcggaggttgcagtgagctgaaattgcactactgcacacctgcctgggtgacagagtgagaccctgtctttaattaaaaaaaaaaaaaaaaaaaaaaaaagcatctgcaaagcacaacaaagcaaagtgcaataaaacaaggatgcctgtgtttctttgtcttgtctaactgctctgtctacaactccagtattatgttgagtgaaagcagtaagtgtgggcctccttatcttgtttctaatcttagaggaaaagctttcaacctttcaccattgagtttgggtatttgtcatctatggcctctattgttctgaaggaagagacaactcatggattgtatttgcaaaacaagaaccagacagggagctaataaccaaaatatataagaactcaaacaactcaatagtaagaaaacctataagcctgatttttttaaacagtccaaggacctgaatagatatttctcatataaatggctgacaagtcattctcaccatcattaatcatcacagaaatgtaaattaaagccacagtaagatatcccttcacaccagttaggacggctattatcaaaaagacaaaggctaagtgttggtgaggatgcagagaaaagggaacgcttacacactgttggtggggatgtaaattaataaagccattatggaaaacagtacgacattcctttgacaaaattaaaaatagaactaccatgatttagccatcccactaccagatatgcatccaaagaatatgaaaccagtatgtcagagagatacctgtactcccacattcattgcagcactattcacaataaccaagatatgaaatcaacctaagtgtacataaatgaatgaaggaataaagaaaatgtggcatatatacacaatgcaatactattcagccttacaaaagaagaaaatcatgtcatttggaataacacagatgaacctggaggacattatgttaagtgaagtaagtcaggcgcaaaaagacaaatattgtatgacctcagttacttgtggaatctaaaaatgttgaactcatagaaacagggagtaaaatggagcttgccagaggctgagagataagatatttgtcaaatgacataaaatttcagggagaataagttcaagtgatctactgcacatcatggtggctacagttaataacgatatattacagacttaaaaattgctaggctgggcacggtagctgacgcctgcaatctcagcactttgggaggttgaggcaggggaatttgagaccaggagtttgagagcagcctgaacaacatagtgaaacctcatcctaccaaaaaaaaaataaaaaattagctgggcatgatggcatgtgcctataattccatctacttggaaggattacttgaacctaggaggtcaaggctgcagtgagccatgatagcaccactgtactccaagctgggcagcagaacaagaccctgtttcaaaaaagaaaaagaaaattgctaagagaaatgatgttaagtgttctcatcacaaaaaaatggtaaatatgtgagggaatacctatgttacatagcttgatttagcctctccacaatgtatagctatatcaaaacatcatttgtacaccataaatacctatgacttttacttgtcaattaaaaaaattattaaagtctcatgttatgcacaaaattttaaaaatgtaaatacaccataattttagaaaatgcaaagaattttgtttcgaaattggtaaaccaaaggaattacaaactgtgtttatgctgtaccacaaggtggtaccaaatgatgtagtgtacaaatacccacggacttagtagtatggaaatgcattctgtaaatcattttagtcactaatgtgctgtgtgttttaacagccaatactcccaggttaaaatcttttacaaattctataataatgtcttccatacattcagtgatgctgaaaaacataaccaaaaatcaataacttttgaaccactgccaaaatataccacgctgttaatttcagtgaggactcacagctattagagataatcctaagatataaacacagcatcaaaacaacaataagatatgatggctgtagatttatacactatgtagacaacctccctgcttttttttttttttttttttttttttttttttttttttttgagacggagtctcgctgtcgcccaggctggagtgcagtggcgcaatctcggctcactgcaggctccaccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccacccgcctcggcctcccaaagtgtgctttttttttttttaagagaaaacaagtcctgaatgatacgctttgtgaattatatgagttcttcaaggcactaccttggcaataaacaccactgctaccctggattttcaaccttgccataaagagtgaagcctgaagggtgcattcccaagtactatacttctttcaggtgttttacccttatgttactttttattcaaagaaaaatgagaaaatattgacatatttaaaccatgataagtaactagcagctctctgtcttctatttaaagactgtgctgccaaatccatcacttaaaaaggtatttgcaaatgcttctccggtaattctgcaatggaaaccgcctgtagaaaatctctaccggtattaattttgcaatcctattgagcctcatgttaacaaaataaaaatgtattatgcttgctctttttatatggcaggtgtggacagctgtgaagagctacttgtttacttgtggctgccacagctgtctttctgaattatccagtgaaaacaaatattgacttttttaaaaaaaatgtaacccaaacagtgaatgggatataaactgttattgagtcaaaacaatttaacgagcatttggatgcctactatgtgcaatgccataagccagatataagcctaaatttcaccaaatgagctatttgatatgctctccaataagctactctattatgaactctgattgaagctcagttgtgtgtcctgctgagtgacaatggccagcacaatctacttggccttttttcttattcactcctggacaagaaatttgacttatccactcttttttatccaaaattacctccaagaggcaacattgctaaaattctttttttctctctctctctgagataaagtcacactttgtcacccaggctaaagtgcaggggtgcaatcatagctcattgcagccttgacctccctgggcttaagcgatccttccacctcggcctcccgagtagcctggaccactgaggagtgccaccatgcccagttaatttttgtcttttgtagagatggagtttaaccatgtttcagggaggctggtttccagctcctgaactcaagccatccacccgcctcagcctcccaaagtgccaggattgtaggcatgagccactgcgcctggctgctaaaattcttatcatgccatttctttcattgtgttaatgcattctaagatggaattaattttaccttcaccactctcaattctactctaaaattgtttatttgctaactcatctatcctggtaagtctgctttacaaataacattccaaactatgaagcgcaaataaactcagttgggtttaaaagaatggctttggcatttcccaaatgaataggagcagtcatttcctcttcctaacagtcctattgcccattcaacccctaatgatttatagaataccaaccttgactcttaatataagtatcaagatcttcaggtttcaccatgatttctggtggtcttttcacaatgcccctgcccaggattcaaacctgaggtcttcaggcttgaaggggtcgacagaatttggggaaatggggtgctgaacttggatgagataaaaaattacatctttatttcattaacctccaacaaaatctaacatttctttcaacgatgaatacaagcactaaaatgcagtagtattagcagtacccacaaacttgtcatcaaaagaaatcgaatacattcttcatctcacatctcagttattgcagatatgttgaagtgtcattgaatgctcatcactacttcaaattatggtagttttgaggcctgctacaagatttttttaatttttatttttagttctggggtacatgtgcaggacatacaggtttgttacataggtaaacatgtgccctggtggttcactacacctatcaacccatcacctaggtattaagcccagtatacattagctaattttcctaatgctatcactccccaaaccccaccctccaaaaggccccagtgtatgttgttcccctccctgtgtccatgtgttctcattgttcagctcccacttataaagtgaggacatgcagtgtttggttttctgttcctgtgttagtttgctgaggataatggcttccagcttcattcacgtccctacaaaggacattatcttattcctttttatggctgcatagtatgcccaacaatgatagaccgtataaggaaaatgtggtacatatacaagatctttttaaatgtgttaataaagtacaaatattactctatcacacttgtatttaatatctgatcattttatttcaatataattggtctcttctgtcctatttctgattttattttataaacataattatgagaagggtccatcagcttcaccatcctgccaaagggatccatgactcagagaaagaaccccagtggtatgccacagtgatcatacccaagtaccaggaaggaagctgaaagctggagaggctaaataactgccctaagttattttttaaaaaatcgtaacgacaacatagatcatttgtgaatacttcctataattttttctattactgctataacaagttaccacaaatttagtggcttaaaaatgatgtaaatttatgatggttctacatgtcacaagtccaaaatgggtttaactgggctaacctcaaggtgtccacagggctgcctgccttctggaggccctaagggaaaattatttcttcgcctttcccagcttctgaaacaggctgcccatgttgcttggctgtggccctgttccatcgtaaaagtacatcactccgacctccgtttccatcatcatatctcctctctgattccacctctcctgcctcctcctttcatgtaaaaggaccttggtgatgacagtgtgtccatttacataatctaggatcatttccccatctcaagatccttcattacatctgcaaagcccttttcaccatgtaaggtaaacatgctcataggttccaaggattcgaatgtgcatctccttaagggaccattattctgcctaccacacactaaataccagaaattcagctttatgtgacacagaatgcaatgtttttggaaatatcttcaggctcacagatgacaattttgaagctctgacttcagaattcaaggtcatgcaggcagcaaggggcagaactaggattcagtcattttagctacctgactctaacggcagctacttttaagtacctactatgaatcgggcattttacgcgtacgggattttcttaccctttaatttctcaactcgctgtccgatgcttgcttggtcaactctcacttacctcttgggtgcaaagtttaatgcttttttaatttttattaagttctggggtacatgtacaggatatgcaggtttgttacataggtaaacatgtgccatggtggtttgctgcatagaccatcccatcacctaagtattaagcccagcatacatttgctatttttcttgagggtttccctctccgtgctgcctcacaggccccagcatgtgatgatcacctccctgtgtccatctcttctcattgttcatctcccacttataagtgagaacatgcagtgtttggtttttctgttcctgtgttagtttgctgaggataatgacctccagctccatccacatccctgcaaaggacatgatctcagtcctttttatgctgcaaagtattccataatgtatatgtactacattttctttatccagtctatcattgatgggcatttgggttgactccaatctcattactgggtatacacccaaaggaatataaattattctattataaagatacatgcacgtgtatgttcattacagcactattacaaaagcaaagtaacagtttctttaatggctttctggggccttcactagagtgtgtgcagtcactgaattttatttttatttatccagtattaaccttaccttaatgaacacatttcaggatagggagaataaaaaggagaggctcactgagcagttcctttactctttaataaacctagtgtccagcataactcataagaatgaaaatgaaacctttgaaaggacagcttttccctatctgtgaggccttccaaagcatatctcaggtcaaatctgtgaccattctgcccttctatgcaaggctccatcttggattctattgaagacacaaaaaggtgtctatccctcctctcaaacagtttataacctaagggatgtgaagagggaataagtaaaacttcatcagttcaaacatgattcaggcagagagcaacactgtcagttacccaggccaaaggtcaacatcacaatgaggtttttcataataaaagaagccaaactaggaggaccctcacaacaagcaaggatgctgcagagctctagataatgaagtgagttttgcaaggtgagggagggttgttaagcattaaataaaaattaaaaagcacagaggctggaaatcatggcatagggcaggaaagttttatttgctccgaagggagaagatgccctaagaacactggacctgcagtcggaaggcccagatttgagaagccacctctgccactacctatgtaaccatagctatttgattacaccaagatttctcatgcataaaaagggataataagaaggtttactcagggccggccatggtggctcacgcctgtaatcccaacactttgggaggccgaggcaggcagatcataaggtcagccgatcgagaccatcctggctaacacggtgaaatctgtctctactaaaaatacaaaaaaattggctcggcatggtggcgggagcctgtagtcccagctgcttgggaggctgaggcaggagaatggcgtgaacccgggaggcagagcttgcagtgagccgagatcgcgccaccgcactccagcctgggcaacagagcgagactctgcctcaaaaaaaaaaaaaaaaaaggttaactcagaaagatattatgcaaaataagtaaaataatataagtgagcatgcataaatgttcctctgaatttgagggtagaatagtaggcagaaaggattatctggcaaggaagggaaagaggaggcacaaaatagtattataaacaatggaaggaggctcaagaatgaggagaacccacattccttctgaaactttaatacccttctactccaacctctttcttactcaggaatattataacaatcagatatgagaagaaataacaggtcttgtataatttcaaaaaatttctgtatttttattattatactttaagtactagggtacatgtgcacaacatgcaggttttttacatagctatacatgtgccgtgttggtttgctgcacccaccaactcctcatttacattaggtatttctcctaacgctatccctcccccagccccccaccccccaacaggcccctgtgtgtaatgttcctctctctgtgtccatgtgttctcattattcagctcccacttataactgagaatatgtagtgtttggttttctgtccttgtgatattttgctgagaatcatggtttccagcttcatccatgtccctgcaaaaaacatgaactcatccttttttatggctgcatagtatttcatggcgtgtatgtgccacattttctttatccagtctattattgatggacatttgggttggttccaagtctttgctattatgaatagtgccacaagaaacatatgtgtgcatatgtctttatagtagaattatttataatcctttggatatatacacagtaatgggactgtcgggtcaaatggtatttctggttctagatccttgaggaattgccacactgtcttccacaatggctgaactaatttacactcccgccaacagtgtaaaagccttcctatttctccacatcctctccagcatctgttgtttcctgactttttaatgatcgccattctaactggcaagagatggtatctcattgtggttttgatttgcatttctctaatggccagtgatgatgagccttttttcatatgtttgttggctgcataaatgtctttttttgaaaagtgtctgttcatatcccttgcccactttttaacggggttgtttttttcttttaaatttgtttaagttctttgtagattctggatattagcccttgtcagatgagcagattgcaaaaatgttctcccattctgtaggttgcctgttcactctgatgatagtttcttttcctgtgcagaagctctttggtttaattagatcccatttgtcaagtttggcttttgttgccattgcttttggtgttttagtcatgaagtccttgcccatgcctatgtcctgaatggtatttcctaggttttcttctagagtttttgtggttttaggtcttccatttaagtctttaatccatcttgagttaatttttgtgtaagatgtaagaaagggatagtttcagctttctacatatggctagttttcacaccagcatttattaaatagggaatcctttccccatttcttgttttttgtcaggtttgtcaaagatcagatggttgtggatgcatggtgttatttctgaggcctctgttctgttccattggtctatatctctgttttggtaccagtaccatgctgtttcggttactgtagccttgtagtatagtttgaagtcaggtagcataatgcctccagctttgttcttttggctaagaattgtcttgcctatacagggtcttttttggttccatgtgaactttaaagtagttttttccaattctgtgaagtaagtcagtggtagcttgatgggaatagcactgaatctataaattaccttgggcagtatggccatttccacgataaggattcttcctatccgtgagcatggaatgttcttccatttgtttgggtcctcttttatttcattgagcaatggtttgtagttatctttgaagaggtccttcacatcccttgtaatttggattcctaggtattttattctctttgaggcaattgtgaatgggagttcactcatgatttggctctctctttgtctattattggtgtacaggaatgcttgtgatttttgcacattgattttgtatcctgagactctgctgaagttgcttatcagcttaaggagattttgggctgagacgatggggttttctaaatatacaatcgtgtcatgtgcaaacagagacaatttgacttcctcttttcctaattgaatatgctttatttctttctctggcctgattaccctggccagaacctccaatactatgttgactaggagtggtgagagagggcatccatgtcctgtgctggttttcaaagggaatgcaatccattttgcccattcagtatgatattggcagtatgatattgtgattggcttcacagaattggaaaaaactactttaaagttcatatggaaccaaaaaagagcctgtatagccaagacaattctaagcaaaaagaacaaagctggaggcatcatgctacctgacttcaaactatactacaaggctacagtaaccaaaacagcatggtactagtaccaaaacagatatatagaccaatggaacaggacagaggcctcagaaataacaccacacatccacaaccatctgatctttgacaaacctgacaaaaaacaagaaatggggaaaggattccctatttaataaatggtggtgtgaaaagagctcttatcattttgagatacgttccatcaatacctggtttattgacagtttttagcatgaaaggctgttgaattttgtcaaagggcttttctgcatctattgaaataatcatgtggtttttgtcatcggttctgtttatgtgatggattacgtttattgatttgcgtatgttgaaccagccttgcatcccagggatgaagccaacttgatctggtggataagtttcttgatgtgctgctggattcggtttgccagtattttatggcggattttcgcatcgatgttcatcaaggatattggtataaaattctctttttctgttgggtctctgccaggctttggtatcaggatgatgctggcctcaaaaaattagttagggaggattccctctttttctattgattgaaatagtttcacaaggaatggtacctggtcatctttgtacctctggtagaattcagcttgaatctgtccggtcctggactttttttggttggtagggtattaattattgcctcaatttcagagcctgttgttggtctattcagagattcaacttcttcctggtttagtcttgggagggtgtatgtgtcgaggaatttatccatttcttctagattttctagtttatttgcatagaggtgtttatagtattctctgatggtagtttgtgtttctgtggtatcagtggtgatatcccttttttcaggttttattgcgtctacttgattcttctctcttttcttctttattagtcttgctaacggtctatcaattttgtagatcttttcaaaaaaccagctcctggattcattgattatttgaaggtttttttgtgtctctatctccttcagttctgctctgatcttagttatttcttgtcttctgctagcttttgaatttgtttgctcttgcttctctagttcttttaattgtgatgttagggtgtcaattttagatctttcctgctttctcttgtgggcatttagtgctataaatttccctcaacatactgctgtaaatgtgttccagagattctggtacattgtgtctttgttctcattggtttcaaagaacacctttatttctgccttcatttcgttatttacccagtagtcattcaggagcagattgttcactttccatgtagttgtgcagttttgagtgagttttttaatgctgagttctaatttgattgcactgtggtctgagagacagtttgttgtgatttctgttcttttacatttgctgaagagtgttttgcttccaattatgtggtcacttttggaataagtgagatgtagtgctgagaagaatgtatattccgttgatttggggtggagagttctgtagaggtctactaggtccacttcgtccagagctgagttcatgtcttgaatatccttgttaattttctgtctcgttgatctgtctaatattgacagtgaggtgttaaagtctcccattattattgtgtgggagtctaagtctctttgtaggtctctaaggacttgctttatgaatctgggtgttcctgtattgggtgcatatatatttaggatagttagctcttcttgttgaatagatccctttaccatcatgtaatggccttctttgtctcttcttatctttgttggtttatagtctgttttatcagagaccaggattgcaacccctgtttttttctgctttccatttgcttggtagatcttcctccacctctttattttgagcctatgtgtgtctttatatatgagattggtctcctgaatacagcacaccaatgagtcttgactctttatccaatttgccagtctgtgtcttttaattggggcctttagcccattacatttaaggttaatattgttatgtgtgaatttgatcctgtcattatgatgctagctggtaatttcacccattaattgatgcagtttcttcacagtgtcgatggtctttactatttggcatgtttttgcagtggctggtaccgttgtccctttccatgtttagtgcttccttcaggagctcttgtaaggcaagcctggtggtgataaaatctctgagcatttgcttgtctgtaaaggattttatttctccttcacttatgaagcttagtttggctggatgtgaaattctgggttggaaattcttttaagaatgttgaatattggcccccactctcttctggattgtagggtttctgcaatcagatctgctgttagtctgacgggcttccctttgtgggtaacccgacctttctctctggctgcccttaacattttttccttcatttcaaccttggtgaatctggcaattatatgtcttggggttgctcgtcttgaggagtatctttgtggtgttctctgtatttcctgaatttgaatgtggcctgtcttgttaggttggggaagttctcctggataatatcctgaagagtgttttccagcttggttccattctccccatcactttcaggtacaccaattaaatgtagatttgtttttctcacatagtcccatatttcttggagtctttgttcatttcttttcactcttctttaatcttgtcttctcactttatttcattaatttgatcttcaatcactgatagcctttcttgtccttgatcaaattggctactgaagcttgtgtatgcttcacgaagctctcgtactgtggttttcacctccatcaggtcatttaagctcttctctacactggttattccagttagccatttgtctaaccttttttcaaggttttcagcttccttgcaatgggttagaacatgctcctttagcttggagagcttgttattacccaccttctgaagcctacttctgtcaactcgtcaaactcattctctgtccagttttgttcccttgctggtgaggagctgtgttcctttggaggaaaagaggccttctggtttttggaattttcagcctctctgctctggtttctccccatctttgcggttttatctacctttggtctttgatgttggtgacctacagatggggttttggtgtggatgtccttttttgttgatgttgatgctactcctttctgtttgttagttttccttctaagagagaagcccctcaactgcagatctgttggagtttgctggaggtccactccagaccgtgtttgcctgggtatcaccagcagaggctgcagaaaagcaaatattgctacctgatccttcctctggaagcttcatcccagaggggcacccacctgtatgaggatctgtcagcccctattgggaggtgtctcccagtcaggctacatgggggtcagggacccacttgaggaggcagtctgtccattatcagagcttgaatgccatgctgggagaaacactgctctcttcagagctgtcaggcagtgacgtttaagtctgcggaagctgtctgctgccttttgttcagatatgccctgcctccagaggcggaatctagagaggcagtaggccttgctgagctgcagtgggctctgcccagttcaagcttccccgacactttgtttactctgtgaacatacaaccgcctactcaagcctcagcaagggtggacgccccttcccccgcccatctccagcatcccaggtcaatctcagactgctgtgctaccagcgagcaaggctccatgggcatgggacgtgccaagccaggcacaggagggaacctcctggtctgcctgttgcaaagaccatgggaaaagcatagtatttgggcagagtgtaccattcctccaggtatagtcactcacagcttcccttggctaggaaagggaaatcccccaaccctttgcacctgggtgaggcaacaccccaccctgcttaagcttgccttctgtgggctgcatccactatccaaccagtcccactgatacctcagttggaaatgcagaaatcacccatcttctgtgtcaatctcgctggaagctatagactggagctgttcctattcagccatctcggaagcgactataataaatttctattttaaagaaagttacctattcctcaaagcaccacagaatgcagattcagtgtacgtacagccagagtctagaatcttccatgcatgaaaatggagcttatgtgaaatacaacacttaactttattgtagcatgtctgaggagcttcaataaaaggaccaatataaagattattttgactacctaaagcatttaggcacttagggataaaaggtaagaaaaacaagtttttctaaaaataagtcaaataagaatgaacagtcaatagtcttttttaacttaaatagcatgtaaatagttaatttggttggaagaatcattttctttttataactttaaataaaagtttttcttaactgacatccactcttagccccctatccacaacaaacactttcatggataagttttaaaaatgaataaatgaactgatcacccctttcagtttattgtttcataaaatatagcagaggaacatgaggccagtgtcaaaggcatactatgctcttaccactccaagttagaagatcttaggaaattgctctaagtttcagttgcctcaactgtaaagtgttgaccaaaatgtgaagattcagtgaaagaattagtgtaaagcccctaacactcagttggaggggagaggcagacacatattcccaactcttcatgctccattagccagagttgatgctcaccctgacttctctccccaaacctcaggagcccctccgtaaagtaagaggaatgacttacataactggttgattggcaagtttggagaaaaggaacctagcattcaaagatcattccctggaaggatcccttttagggtctgcctacttaagcagaggctaacattttgatctgttctgttccatgtagtaaagaacctaccctgctaaggacatcctgaaaataactgctttagccatgcctggtagaatgaccaagtccactttcccacatacccaaagccatggtctctactcctcctattatcaattatacagctgaaatttcagctatctatataacttttttgttaatttatctgttggttgtaaactcagatatagaaaagagtgtcatttactgtgctcataaaacccaaacaatcgatacaaaatactaacagctattactatcatcatcatcatcaccatcttctgtatcctcctacttgatctttaccatcttatatcttttttgacatctccatttggatagctaatatgcatttcaacccaacatatcccaaatcaaacttctgatttcctctttcacctcccacacctattcctcccatacacctcctcatctcagaaacaacaaccccttctttctggttgctcaagccaaaaagacgggcatcctccttgattcccctctttctcttacactctccaccccatctgtcagcagaatggcactggctccatttcacaacattttcacagtctactccattcttactgcctctgctgctattccctttttccaacccaccctcacttcctgacaggattactttcaaaacctcccaatgagtctctgtttctgctcttgccctcctatgtaaagtgtaggtcagattctgtctccctctgctcaaaaccctctaatatatggtcatcctactcaggatagaagccaaaatcttcacaatggcctacacatgcaggggtgggaagtgcagtattcactccacttaacactctggccttatcacctactcctttccctcctctctcatggcctctgcacctgctgtgtccaccacctggaacacctggcccccagttatctttagtctttatccaaatagcatctgcttagtaaggccttccctggtgaccttatttgaaatagcaaactcccctacacccaccttgctccctcaattccttgactctgtgttatttttctcctcagaactaatcaccatctgacatttacttttttctctttgttcactgtctgcctccactcactatcactaagagctccttgagggcaaaatgtttccgcagaaaaagaacagtatgtacctgatgcacagtcagtattcaaatatttgctgaatgaatgaacgacgtagaagtatatgataaaaacaaatgcatttcttccttgttagctggcttctagaaggcataataaataatacatgccatgaataaataaaccccaaaattgtaaagttatgatttctccatctaaggtaaactagtcgggttagttgctcaagtggagcagagaaagatgtttttgtgaaaattttcactgcaaagcccagatgccatgtggctgtctaacatgcatacaaagtaaagtacaaagttgtgcagcttacaggtgacataattaggtcactgggggcaagaatgcttagaaatgatgaagaaatctgtaagactcctcaaatgagtctttgtgtagctgcagcagatgtgctttcttagttcccaagcatcaaatgccaacttcagcctttctgcagcctccttcctctagataatttcacttcagggctgccattttacttgtcatcttcacatatccctctttaaaattatgtgtgatgtttcaaacacacctaccaaattgccctttcactttgtgttgaagaactgtgcgcaaattacagtgtattttctcattatatgcaatattattacaaagaaacctaccccagctagatctgtggatttcagtttttcaatctcatgaagtattctaaaatgagaaactacagagaagaaagaagaaggtataatacccaatctcccgcttcgggccccttatgttttctggtgggtgatgtaagaattgaatattggttctgttttggaggaactccccatcacaaggagatggggtttttgctggattctcttgcctcaggaataatcctcaattccgcctgtcaccaggattgtttgccaaaccacagctttactccaaatgctgagaagagagtggtggctcaaaattaacaggggataatagctgtttgaaaccacaagtaacatttatgtccctacaaatggtacttatcaaacagttaagtgaactgctgactatgaagaagcctgtgtgtaggaaagtctggcttctagaacttcctctaagggtcactaaactgtatcattggttatattactttactctgaaatctttttgtagaaaaatgctattagtagaagtcagaaatcataaaataaccattcattcaatatatgtttattaagcacctactacattccaggaactcttataggtagtagaaatccagagagaactaaacataaaaatcgttgttctcatggaagttacatttcaatagtctttcaacagaaaatttatttacaatagtaagatttattactaatttggaacccactttgtatagcgagaaaacactcagattggagtccaggggtcagggttcaagtcctgactatgctaccagggttcaagtcttgactatgcttgctcccagatctttagttttgtgtattctcctaggatttgaatgaatgaaataaagtacccaggaaattacctgtcatgtggaaaatgattgataactctgagaacagtgatgataatcggtatagttctctaacacaggaattgacaaattatggcccacaggccaaatccaactggccatttgtttgagtaaataaagtgtgactgggacacaagcacacccattcatttatgtatcatctgcggctgctttcgcactacagtggcagagttgaataattgcaacagaggctgtatggccctcaaagcctaacaattttactatgtgaccccttgaagaaataaaatttaccaactctggctctaatctcttgctatgctaaatgatgtccaagaacaggcatcatcagcatcacccagctggcctgttggaactgcagaatctgaggccccactccagacctgaatcagaatcaacattttaacaagatacccaggtgtgacacatatgatctctggaagcccaagaaacactgccacaaagtgtgcccatgaggacgtaagtgatcttgctctactacatcaatatggtcaatttcaaccctccccttccttccactccagccaatagctaagttcagaataatgattgttttccaacttagtaaacatcagaatcacatatggggctttctaaaaatataaactcctggcacccgccccccactccagtgattctgattcaatgaatcagaggtgggggtcaaagattccacatttttaaaacaaatacccaaaggaaattcaaacacaagtgaccctaggatatcactttagaaatattatttttaaaaagtacacttatatatactctaggattgggacaaaggttaagaaatattctgcatgttcatcattatcaatgtttttcttttggatatataaaatatcaatgggagatttgtcagcaatagtttatattaatgacttttttgttttggtttgtgttttttttagttcaggatctgttttttattatttaattcttttttaattgaaaaattcaactatatctatggtatacaacattatgttttgaaaaatgtatacatcgtggaatctctaaatcaagctaattaacatatgcattgcctcacatacttatcattttgtgatgagaacacttaaaatctactctcagcaattttcaagtatacaatatattattaataactatagtcactgtatgactatagttaatatagtcacaactatgttgtattaggttggtgcaaaagtattgcagtttttaccatagaaagtaacagcaaaaaacccaataacttttgcaccaacctaataaaatagctctattgaactcattcttcctgtctaactgaaattttgtacagtaatgattcatggtgcctccatggctagatgttaattaagtgcgctaactgagctaccaaaaatactttaccacaattattatttttaatgtcaagaatacatttgtatgttttcatttccttattcaagaaattattgaacaccaaatgtttttgaagcatcattctagacagagcaaggatctaagaaatgaaaaataacccttgtagaatacaaaattgagtggcccaagcagcattctctttcatttgacaagtatttcgtgagaacctgctcaacagccaggcactgttctaggtcaggggtcagcagacattttctgtgaagggccagacagtaaatattttagggtttgcgggccatgtatagtttttgtcacatattattctctcaggttttttacccctttgttaaccctttaaaaatgtaaaaatcattcttcattctcagttatgaaaaagacataccataggccagattaagcctgtgggtcatagtttgccaatccctattcagggtgacagggacacagcagggaataaaacagacaaaagtccctgcctgccaggcgcagtggctcatgcctctaatcccagcactttgggaggccaaggcaggtagatcgcttgagcccaggagtttgagaccagcctgggcaacatggtgaaaccccgtctccacaaaaaaagacaaaaattagccaggtatggtgaggcgcacctgtagtcccagctacccaggaggctgaggtgggagaatcacttgagcctaggaggtggaggcttcaatgagccatgattatgccactgcactccagcctgggagacagagcgagaccttgtctcaaagaaaaacaacaacaacaaaaattccctgcctatgtggagattatattctagcagagggacacatataataagaaaataaatgctgtaaaatggggagcaattgtgtcctacaaaggaaaatagtaagggcataaaaaatgataggagagaacttttaacagagggtagccaaagaaggtgacatttaagcaaagacctgaatgaagtgagtaaacgagcactctggtttcagatacagcaagactttctcaagttacattattatatggggaatagtgttaacaccatttgagcacattagaaataatgtccaaaacaacaacaatgaacaaacaaaagtaattcacaataaaatggcctgcagtcccccaaatattgtagtcaaggcaggtatgaccctctgactacatgatgtaaatgagaaagattccaacaggtactggaaaagtcagcatcttctcaaacttcactaacacccggatgcaattcacaaccttttcacactgagaaacgtaaacctgtctcttaaaaaatcattcaaattcctcttttccctgacatatggcctggagctctgctttccaacctcttcttaatccattagaggagttaactttgagatgagttgatccttcactacagaagtttgttgcaaaggaggtgctgggtctctgaggatacagctaaaggggaaagcgtaacaagagcaacttgataaactggctagaaatttccgaggtaggacagagcagttgctggagtaggaacagaggcactgggctaggaggaaaatgggagagacccttgctgggtctatcatggaaatgaagcactagccacagacagatttaatacacaggcagaaagctttagagagaaatgtggctgtcttacgccctcctcttaacctcccttgggttccagggagaagctgtctatgccactgtcttctctccaaagagatgcctttgttccctcaggctaaagtcaccagaaaagatggagatggtgagactcaaggaccccatggcaaatggggctatgtcagtgagcattccctggacagaaatcaaggtgttggcacttttggttggttggttgaatgattgaatgactgattgatttatgacaaggtctcacattgctgctcaggctttagtgcagtggtgcaaacacagctcactgcagccccgacctcctgggtttaagtgatccccccacctcagcccctccatataactgggaccacaggcatgtgccaccatgcccaactaatttttgtatttgtatctcaacatggtgagatacatttcaccatgttgcccaggctagtctcgaacttctgagctcaagcaatctacccacctcagcctcccaaattgctgggactgcaggtgtgagccacaatgcccagcccacttactagttttagaaaaatcatttttaagtagtctccctgagaaatacttaagaaatacaaacacgtgcctttagaaggtaaataaaaactcttatgttgtttccttcaatacccaaagacagaagctggctgatgacattcacatatatagaatatagccatggagaaggaataaagccctggtccctcccatatagaaaaagtacagttccacagctggtttagcagtaaactctcttcatgcatggggaacacttagtgatttgtccttggtagcaccatgtctgccaaagaccacactgggcttactgcgcttgcccatggctagactaaccaaccactcttgcttcagctactattattttctgtaatactgaactaaatggagtttctttctaaccctggacttaccctatctcacattctgtacctctgctaccaatacgatagcactataatctgtgcaaaaatctaacatcattaaaaggcttccatctttcctctacaaggctaaatagaaggtgatattaaagaataaaatccatgtaatcccagcactttgggaggccgaggcgggcggatcacgaggtcaggagatcgagaccatcccggctaaaacggtgaaaccccgtctctactaaaaatacaaaaaattagccgggcgtagtggcgcgcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaaatccacacacattctccacaaaacttttaatttgcattaagtccctgtggtttcacaattggctggcactgttcttaccttctttcctgacaggacaaggccacctgacccacaactaaatcacaatgcgtgactatcaccctacacaattcatacactgtcacctccagttgatttactagaggggtttaagaggaactttttttctgatttttttttaattatactttaagttctgggatgcatgtgcgatctgttacataggtttacacgtgccatggtggtttgctgcacccatgaacccatcatctatattagatatttctccaatactatccctcccctaccccccaaccccctgacaggcccttgtgtgtgatgttcccctccctgtgtccgtgtgttctcattgttcaactcccacttatgagtgagaacatgcagtgtttggttattcgtccttgtgatattttgctgagaatgatggtttccagcttcatccatatccctgcaaaggacatgaactcatccatttttatggctgcatagtattccatggtgtatatgtgccatattttcttaatccagtctatcattgatgagtatttgggttggttccaagtctttgctattgtgaatagtgccacaagaaacatacgtgtgcatgtgtccttatagtagaatgatttataatcctttgggtatatacacagtaatgggactgctgggtcaaatggtatttctggttctagatccttgaggaattgccacactgtcttccacagtagttgaactaatttacactcccaccaacagtgtaaaagccttcctatttctccacatcccctccagcatctgttgtttcctgactttttaatgatcaccattctaactggtaggagatggtacctcactgcggttttgatttgcatttctctaatggccagtaatgatgagctttttttcatatgtttgctggccacatcaatgtcttcttttgagaactgtctgtacatatccttcacccactctttgatggagttgttttattcttgtaaatttgtttaagctctttgtggattctggatattagccctttgtcaggtggatggattgcaaaaattttctcccattctgtaggttgcctattcactctgatgatagtttcctttcctgtgcagaagctttttagtttatttagatccgatttgtcaattttggcttttgttgccattgcttttggtgttttagccatgaattctttgtccatgcctatgtcctgagtagtattgcctaggttttcttctagggtttttacggttttaggtcttatgtttaagtctttaatccatcttgagttaatttttgtgtaaagtgtaaggaaggggtccagtttcagttttctccatatggctagccagttctcccaacaccatttattaaatagggaatcctttccccactgcttatttttgtcaagtttgtcaaagatcagagggtttggcgttatttctgaggcctctgttctgtttcattggtctatgtatctgctttggtaccattaccatgctgttttggttactgtagccttggagtgtagtttgaagtcaggtagcatgatgcctccagcttcgttcttttcacttaggattgtcttggctatatgggctctttttcagttccatataaaatttcaagtacttttttctaattctgtgaagaaagtcaatggtggtttgttggggatagcgttgaatctataattactttgggcagtatggccattttcacaatattgattcttcctatccatgagcatggaatgttttcccatttgtgtcctcacttatttccttgagcagtggtttgtagttccccatgaggacgtccttcacatcccttgtaagttatattcctaggtattttattccctttgaggcaattgtgaatgggagttcactcatgatttggctctctgtctattattggtgtatagtaatgcctgtgatttttgcacattgattttgtatcctcagactttactgaattatcagcttaaggagattttaggctgagacaatggggttttctaaatagacaatcatgtcatctgcaaagacaatctgacttcctttctccctatttgaataccctttatttctttctcttgcctgattgccccagccagaacttcctatattatgttgaataggagtggtgagagagggcatccctgtcttgtgcgagttttcaaggggaatgcttccacgttttgccattcagcatgatattggctgtgggtctgtcataaatagctcttattattttgagatacggtccaccaatacctagtttactgagagtttttagcacgaagtgctgttgaattttatcaaaggccttttctgcatctattgagataatcatgtggtttttgtcattggttctgtttaagtgatggattacagttatttattttcatatgttgaatcagccttgcatcccagggatgaagccaacttgattgtggtgaattagctttttgatgtgctgctggatttggtttgccagtattttattgaggattttcgcatcggtgtccatcagggataatggcctgaaattttctttttttgttgtgtctctgccaggttttggtatcaggatgacactggcctcatgaaatgagttagggaggagtccctctttttctattttttggaatagtttcagaaggaatggtatcagctcctctttgtacctctggtagaatttggcagtgaatccatctggtcctgagctttttttggttggtaggctattaattcctgcctcaatttcagaacttgttattggtctattcagggattcgacttcttcctgttttagtcttgggagggtgtatgtgtccaggaatttatccatttcttctagattttctagtttatttgcatagaggtgtttatagtattctctgatggtagtttatatttctgtgggatcagtggtgatatcccctttatcactttttattgtgtctatttgattcttccctcttttcttctttattagtctggctagtagtctatctattttgttaatctttaaaaaaaaaacagctcctggattcactacttttttgaagggtttttcatgtctctatctccttcagttctgctctgatcttagttatttcttgccttctgctagcttttgaatgtgtttgctctcgcttctctagttcttttaattgtgatgttaggtgtcgattttagatctttcctaccttcccctgtgggcacttagtggtataaatttccctctgaacatcgctttagctgtgtcccagagattctggaatgttgtgtctttgttcccatcggtttcaaagaacttgtttatttctgccttaattttgttatttacccaggagtgattcaggagcaggctgttcagtttccatgcatttgcgtggttttgagtgagtttcttaatcctgagttctaatttgattgcactgtggtctgagagaatgtttgttatgatttccattcttttgcatttactgaggagtgtttcacttccaattgtgtgatcaattttagaataagtgcaatgtggtgctgagaagaatgtgtattctgctgatttggggaggagcgttctgtagagatctactaggtccgcttggtccagagctgagttcaagttctgaatatccttgttaatgttgtctcgttaatctaaattgacagtggggtgttaaagtctcccgctgttattgtgtgggagtctaagtctctttgtaggtctctaagaactgctttatggatctgggtgttcctgcagtgggttcatatatatttaggataattagcttttcttgttgcattgatccctttaccattatgtaatgcccttgtgttttttttaatctttgttggtttaaagtctgttttatcagagactagtattgcaacccctactttttttttgctttccatttacttggtaagtattcttccattcctttattttgagcctattttgagcctttgaacctttgcacatgagatgggtctcctgaatacagcacaacaatgggtcttgactctttatccaatttgccagtctttgtcttttaattggggcctttagcccatttacatttaaggttaatattgttatgtgtgaatttgatgctgtcattatgatgctagctggttattttgcccattagttgatgcagtttcttcatagtgtcaatggtctttacaatttggcatgtttatgcagcggctggtaccagtttttcctttccatgtttagtgcttccttcaggagctcttataaggctggcctggtggtgataaaatctctcagcatttgcttgtctgtaaaggatttcatttctccttcacttatgaagcttagtttggctggatgtgaaattctgggttgaaaattcttttaaggatgttgaatattggcccccactctcttctggattgtagggtttctgctgagagatccgctgttagtctgatggtcttccctttgtgggtaacccgacctttctctctggatgctcttaacattttttccttcatttcaaccttggtcaatctggcaattacgtgtcttggggttggtcgtcttgaggagtatctttgtggtgttctctgtatttcctgaatttgaatgtggcctgtcttgctaggttggggaagttctcctggataatattctgaagagtgttttccagcttggttccattcaccctgtcactttcaggtacaccaatcaaacgtagatttgttcttctcacatagtcccagatttcttggaggctttgttcgttccttttcactctttttcctctaatcttgtcttcatgctctatttcattaagttgatcttcaatctctgatatcctttcttctgcttgattgattcagctattgatacttgtgtacgcttcaggaagttcttgtgctgtgtttttcagctccatcaggtcatttatgttcttctccaaactggttattctagttagcaattcatctaaccttttttcaaggttcttagtcttccttgcattgtgttagaacatgctcctttagctcggaggagtctgttattgcccatcttttgaggcctacttctgtcaactcgtcaaactcattctccatccagttttgttccgttgctggcaaggagttgtgatcctttgaaagagaagaggcattctggtttttggaattttcagcctttttgcactggttttttcctcatcttcgtggatttatctaccattggtctttgatgttcatgacctttggatgggctttctgtgtggatgtcctttttgttgatgttgatgctattgctttgtttgctagttttccttctaacagtcaggcccctctgctgcaggtctgctggaatttgctggaggtccgctccagaccctgtttgcctgggtatcaccagtggaggctgcagaacagcaaagattgctgcctgttccttcctctggaagcttcatcccagaggggcactcaccagatgccagccgctctcctgcatgagatgtctgtcgacccctgctgggaggtgtctcccagtcaggaggcatgggggtcagggacccagttgaggaggcagtctgttccttagcaaagctcaagcactgtgctggtagatctgctgctctcttcagagccagcaggcaggaaagtttaaatctgctgaagctgtgcccacagctgtcccttccccgaggtgatctgtcccaggaagatggaagttttatctataagcccctgacttggtctgctgcctttctttcagagatgccctgcccagagaggaggaatctagagaggaagtctgcttacagtggcttttctgagctgcagtgggctccgcccagtttgaacatccaggccactttgtttacactgttaggggaaaaccacctactcaagcctcagtaatgacggatgcccctcctgccaccaggcttgagcatcccaggtcaacttcagactgctgtgctggcagcaagaatttcaagccagtggattttagcttgctgggctctgtcggggtgggatccactgaactagaccacttagccccctttccagggtagtgaatggttctctctcactgatgttccaggtgccactggagtatggaaaaaacctcctgcagttagctcggtgtctacccaaagggctgcccagtttgtgcttgaaacccagggccctggtggcataggcacccgagggaatctcctggtctgcaggttgagaagaccatgggaaaagcacagtatctgggccagagtgcactgtccaagaggaactttttttaaaggccaccagttacaaattagcagatttgaacacggtaaggtgtgaaaccacttggtcataaaatccatggaaatttctcaggtgtatagcatgctttagaaacatttaccaccctcgtggacaatccctgctttgaacatgccctccaaaggttaagtgaaataaatccatgcagaattcattcattaaacattttcaagtttctactttgcgtcaagacctaatgctaagaacagctctcaaaaagataaatattactgctgctaacagctatcacttttgtagcatttactatatccactttacatacaataatgcatttaatcctcataaatgtattaaaaggtagatgctattattatcttcattttatagttgaggagtttccacagctattaaatagcagaaccaagcttggaatacagagtctgactccagtgcctgcaacattaactgtcacactataccacctggcaacacctgtgagaatctatcttctccatacttaagtagaacacacacgaaattaacctgtccagcatttcctgatgtcctacctcatacatggctctaaggctaggcatgggatgagagacaatgaatcagagagtgtcttctctgctctcagatagctatgtatcaacgaataaaaaatgatggtcttgctttcattttttagttctttagacacaagatataactggagtttcctgtgacctatatgcctttttccccaggaaggaggtattcttaaatcaatatagtaaaaactgtcagcagccttttcaacctactttacagcctttccagggtccatggttgatcaactcaccttggtggcaatgataccatgcacttggattaaaggtataaatggacaagcatatttaatatcattactttcttcccagtagtccccatgcccttttaactttccccacatccagtaccagtggctcagacagtaatttctgttgccaactccagagagcaatagaaatctgtcctgcaccacttcctaccccaaaataaagtccctagcccctctgccatgtcctccagcatgaccatcttggagtgggaacatgcacagctcctggtgcatgcaaagtgacaggctgtctcctttccacctcatcagctcacccaacagaaataaacttcattctttggaatacttcaccaaggagaatgctaactttaaaaaaaaaaatgtacctagcgagaaaaataaacacactcctctgaaatttctccctaaaataaatagatttcctacacctagcatgagctatccttctagaatggaataaaaaaaattcttcctgataaaaatacaatgataaatatagagttttccatgatatatttttctttgtctcttctagcagtaagatccttgcctaataacacatatttccttcttctcagatctcttaaactctttttgtccagtagattgatgtaaaaggtggtaattcattgtgccatatttaagatcgacacaaattcttctatgcttctctgatgaagacatgaggtttatacccccttcctttgaatctgaatgggctctgtgaaagttttcattaatagaatatggcagacatgacactgtgcccatttatcgcccaggcttcatgagataacaggttccaattcctggctctggaatgcttgttcttgaatcttgagccactaacaagaagtacagtcaccctgctggagagactctgtgagaggccctaagactacacagatcagcagaggcacccagctgagcccagcattccagctgtccttgacaaggtagcagaaatatgagtaaagccatcttggacccttcggactagcccaggtgtcagctgactatcaccaagcaacccagtccctgtggagaaccaccacctaaccaggtctgccagaattcccaatctataatcatgacgtataatacaacattaagtcatgaagttttggagtggttgcttacatagcaatgaaacactgaacaccagccctttcacaaaaccccagccttcattcacattgtatcttactcagtttcttctctcacaaaggatccattactgaaaattcattcaacttcaacagccctcaacaggttcctctaatcacatgccagccccattcttcagtccttcgaaggattttttttcttgcagttttattgaggtataattgacagtaaaactgtataaatttgagatgtacaacatgatgatttgataaaggtacatattgagaaatgattaccacagtcaaggtttttggcttgccagttgccatttaccattgagttgcaaaattgcctcttttcccatgaaacaaccagaatctataccctcctcttcctcaaatactacctgacgcacaaagcgctcttaaaccttcaaataaatgcaactcatttatactaaacactcaggggtaggtatcatacaacagtaatattgcctaaggtagggaattgaggactccaggcattgtttcagttgctcatttcttttcattcattcaacaataactaccaagcatccacaatgtacacaccactgttctcaggacaagggacacagcaggtaaataaaatatagcccctatccccatggagtatatgtcttagtgagggacaaaacagacaataagtaaaataaaaacatgaaaatttcaaattacggtatttctggttccagatcttagaggaatcacaatactgtcttccacaatggttgaactaatttacactcccaccaacagtgtaaaagcattcctgtatctctgcaacctcaccggcatccgtttctttacttttcaataattgccattctgactggtgtgagatattatctcactgcagtttttgatttgcacttctctaatgatcagtgatgtcaagctttttttcatgtttgttagctgcaagaatgctttcttttgagaagtgttcgtgtcctttgcccatttttaacagggttttttttttcttgtatatttatttaagttccttgtagattctgggtatcagacctttgacagatggacagactgcaaaaattttctctcactctgtaggttgcctgttctctctgatgatagtttctttttctgtgcaggagctttttagtttaaatagatcccatttgtcaatttttgcttttgtagccattgcttttggtaattttgtcatgaaatctttgcccatgcctatgtactgaatggtactgtgtagactgggtatatgctcaagggaatataaattattctattacaaagatatatgtacccatatgttcactgcagcactattcacaatagcaaaaacatggaatcaaccccaatgtccaccaatgatagactggataaagaaaatgtggtatatatacaccatggaatactatgcaactataaaaaggaatgagatcatgtcctttacagggacatggatggagctggaagccattatcctcagcaaactgatgcaggaacagaaaaccaaacacatgttctcacttataagtgggagctaaacaatgaaattacatggacatagggaggggaacaacacacactagaacctgtcggggggtgcagtgtagggagggagaacattaggaaaaatagctaatgcatgctggacttaatacctaggtgatgggttgataggtgcagcaaaccaccgtggcacacatttacctatgcctgcacatgtaccccagaatttaaaataaaaataataaacataaattcaaattatgctactatgaaggacagagcatggtgaccgtagaaactgggtgaaaagagagagatattttagccaggaaagacctccctaaggaaaataaagtttttaaatacttgctaggcaaatattaccatctcaaatctatcaatatgcacactctcccagacatagattgcacaacttgccattacctgatagctaataggattagaaactagaatttcaaaactcattgaaaggttatagtaggcgggaaagaatcaaaggaagacaagaccagaggaggaaacaaaatgggagagagatcaatgaggctgtatcctgggatggtggcaccagcaatgtagggaaacgaactgtggagacaatattgagatcagatctataggacaagggtgagcaaaggttagcttgcctcagatgaccaggagggctccttaaaagtacagattcctggactcccaccaagagactctgactctatctgtctgggtgggagcccaggaatatgtgttttaacagctccgcagtgattctgatgcaagtggccaaagaccacactttaacagtccctacctgaagtcttaacaactgatacgtgatgaagatgagaagaaatgaagagtccacactgactcttgcatctcaagactgacggaggccaatacagaaagaaggagatctgtaggaccaaagtttggagagagaggactcttttgtgccatgtaatgctaggagggaccatgcatctaaaggaggagtggctgacagaattaatgagtttggaggataaactgagcctgggactttcttctccctctctggggcttgcattcccagaacatactcgtatttggtcagttctgagccaagtggggcctattcctgtgtggaggcctgtggctgcctagctctgccagcaactaggtataaaagtccaccaaattccagagagaagcattagcgaggctccttggctgcaaacctaaaggcagcctgtttcaacagtgcgtaaggtgatatactcacctccacctgcctgactccatgactgtctcaaccaactcagggtatggagaacccagggtagggggtgtaatttaccaggcctcccaaaaccccaattaaaacttttgagttgaattggccaagtttagcttcagcataaaagtcaatacacacccatgatcaatttcttttccaatttactagccttaaatccttagtcattgaaattcactaacaaagttcccaaacattattatgtcacccttatcttagcattgtcacctactaaaaataaaataatacataaataaagcaaaccaatgagactgaaatcctgggatcctgtgagcactggaaaaagaaaaaagaaaagaaaaagaaaatctacctcatctacctcatctcatattcaagatcagactagttaatccttttggatttaaaatcttacatgtttcccaatagtgttctgaagtaattcctccttaataaactcttctctcttctcaggaaaactgagggttcttaaacaagaaatgcaaaggttcaattatgattcacttgaatcatttgcaagaacagagtaataaagtacaaagcaatgattcctgaataagtaaattatactttatgatgtcagatagatataaacttagagtgtcacaatgtttatatctttattagctttaattactattattatctactatagagttaaggaaaaaaaacttttttttctctgctagtattctaaaaataaatcttcaagtgttaatagacatgagtcagttgtgttttgaatatgggaaagtgtgactccgtaatatctatcttccttcccttaccttcaaatctattttaagtaatattttaaatgcatggtttatcatttttgattaattttccccgaaatgcctacctttcctcctctctgcctactggtagagacttgttcttaaaacccaggcaagtcccatgtctcttttgaagaaggtctgggaagaaggagaggatgggtctctcccttccctgggtcactctctttgctaattcctatcctacttctcatttatacaatacagttagcacccttctacattttcctccagtgtcttaccatctgttttccataatatgccccctttattaattattcatttcaatgtaataaatatttactgattgtctgctagaggcaaagaaaggcacaacaaggtagctaagggcaggtaagaaggccccaagttggaggcattctggatcctccacttactatctgtgtgacttttggctagctgttcaactgctgtgtctcagttgttactgttattattattgctaagcatattcctgggctcagagcatacagaaataaacagggcatgatgcctgtcatattttcaaactcattcagtgattcagcaaatatttactgagcacctattatgtatgaagcacagggaatataattaggaaaatcctctttcaatgagaaactaataaatgaaaatataattattttcattggaaaaataaatgaaaatataataggatgtcatataattatgatttatatcaagaattataaagcaggagtatgggagagtgacttggtggaagaggagacacctaaagagatgacatttacatttaagccaagttctcaatgcaatggaggaatgaccatgaaagagggctccaggtggagggaacacaggcctgagacgagaatgttctctgacagcaggaaggctcgtgtggctgaaacaaggtgaacaagaagagaatggcagacgacatcagggatagagccaggactcaggctgcacagggccttggaggtcatgaaaatgactacagactttattctaaggactatgggagccactagaggattgcaagcaggggaggtgacatgatcagctatgtggaaaatgttctagattcatatacattttcactaatggtcaaaaggccgtgtgttcacagctgctcttgtgagttatctgagctcctttctgggcaagcaccaagtcttaggagtcttgaaatgtcatacagttccacagaataaagaacaaatatatggttaaagccttaccaattggatgagtggccttagcctctcatttgacttggttttgtttttgttatttttttttttttaatcaccaagcaccctctaatacattcttctctctggttgtgtattttattagtttttttaatttgtttgtttctttacctaaccaatttgcaaagacagttgaacagtaattctaccttcacagaggtgtgctttccaacaaccttacgcttctggaaaacagacttgaaaaacagaaaagaaatattttaccgagctctccaaaaatcaatcacaacttcccaacacaaagcctctatatttcacttgtacctgtctggatacacagcagttcactcttagttaacatataattctaacacccttggttccaaacccatagcagagtaaaaatcataataggggacagtggaactcttaggggccagaacaatgacaatgataagtaacaaatgactgtatgaaagctaagtaagaaataaaaaatgtaagtcacaacagaactatgctggcttatacaactcaactcaaaactaaatgtttctaaaccaacaccaaagagttcaattatgttctgtatcttctaatttacaaaaaagaaaaaatacaatctagattacttctatgcaaagtggttaaaatcagcaaagttttggtatatagtaagaacaccttgatttattcttgtactttatacataatgggaagacaatttggtttcaataatgaagccagataaattgctaacatagaacatatgtcagggagtcaacttttcatttaattccacaacagttataagaatgtactttcaaacattctgtataatagtaaaaatttagcaaacccaaaatgcccatcaagagaataagggttaaatgcactacagtacacacatactatggaaaaacagccgctgctgaaaagaatgaaactgataaacatgtactgacgtagcgtttgatccctaagacaaactgataagtaggggggaaaaaagttgtagaacaatatctagagtagacgtcatgtatcttaaaagacagagacacttctatatatgtatatacgtgtatataaattcactgaaaatgactgagtagataaacagacacaggtaaatgccaacccaacatcccttctccccatcttccctgcaagcagaaacatgattcattccaaagtggtcaagtaaccctgttctgaccaccgaatgccgtcagctttcactgggcgtgacttccacaaaggtaccattctcctgacagaaagagccaagctcactgccgtgtacctgttttcctttgccctttcctgtctttcttgctggaatgcagacacgatatttaaaactaaagagctgtgttcccaccacaacaaaactcccaaactaagatggtgaggcagaaaagaagattgagtgtggatccttaatatttgtaccagttctggactacccgtccagagctggtacaactaccctcacccagactccgtggtgtaaggaaaaaacatgctgatttggttaaactactcagttgattccatgcagatgaacacaaccctaactgattaacaatccaaacagggtagtggttacccctgaggagaaaactaggtaggagcatggcgggagaggaagattgagaggtctaaggcaactttatctactttccaaaatgttttaaaataagaatgctttattatttgtgtcatttttaaattaataaagtaggcatgccattctgaaattccacgtctaaatggcacaaaagtgtaagataggcaccacagttgcttatacaacattactctccaaagattatattcccaaacgctttacctattccctcttagaaaagacttccagagtctttcagtcttcatcttggcctgtatttttaacccattaggcatcctcttggggtaacttcagcaggctccataggtacaacaaccttcacgtgatctttaaattagctccataatagtgataatgaggcaggaaccttgagataaaaagcagatattacaggttccactttcgcttctagcactaatgattacatggaaagtcgctcaacccaagttatagcttccacattcatatggaaggaataacaacaagaattatacctcactcctactcagggacatgcaggtaggaaccacaacacagaaacaaaacctaccgctggagcagcactgttgtatggaggggaaggataaagctttggaagaaaatgggtacacctggaatccaagctccaccatctgctggctgggtgaccttgagttacacacagaatgggtctgagcctcaacataaacatgacaggataatagaacagacctccaggatcaaggataaagtcaaatgggacaacacgcagggtagaggatttgacccagtgcctgttaataatactaaaataataattactattaaacttgtcatgtttaaaacacttttcttgaattaaatttcctgagcattcttgttatccttatatgttcgaaatgtggcaatcagattccctttcaaaacagcatttaacgatttctcccaatttgtgcaaactgccaaacgttgtcatgtaggctttctgaaaacatgcagctatctgggtggcacaaatgttaaatactgcagcatgtctaaaggacaatagttcctcttaataagggactatcatggcctgctgatttgctaagtacattaagcacacatggagcactgcaaacatagaaaaacaatgcctgtaccctagaggatggagataatttgaaaagaagataaacaggaaataatgttaggtgttaggtaatgaggaccaatggatggcaacttttgatcacccagaaaatgctctcaattgccatcaaaatgattacaaatcattgaaattacaatcagctttttaaaaccatgaatactttactaatttatcattatctaaagatacatgtataaatacattgtgaaatgtaaatacatatacatatattaaagtgttattaattttccttgaatgttacaagtcctgagatgaagaccactctgacatagcactggccatcacaaacataatttgttccaaagtgttcaagactgttccgaccaatgaatgtaagatttcactggacatggctttagcactcaatagctttggaaactaacatcattcaaaacaaaaaaaaaacaaaaagaaaaaaaaacaaagaaaagaagaggtgggagagagccatattacctgaagaaatacaacatattaagctctgattctagttcagagaggttgtaatgcctagagcaggccaattgacctccatctcatcccatcattcagtaatttaaatctgatttctggttctccatctgcttgtcaaacatcaagtctccagggagagtggccctgcttttcctcccctctgtggactgtcagatgccactcacttcagcaatcagtatggcagtgtcgccatctttccaggtggagccagggagccagcacttaagtcatctgattcatcgcttctccaccttttggctaagatcaagtgaagtcatgtgattcactcgtaagaaagaaggctcactcatgagcaaatgcatcgtggaaatgcacggcatcctttctacatgcaccatcccctcaagtctctctgctatgaaaaacatcaagaacagaatagtatccatcagcttacacaacttctcttttgtagttattaatgctggaacgcagattaataacaccgttaacgcagtgtacctcctattttaatgaatgtctatgtaaagcaaaatgttacttgcttttcccaattgatgggaaaaggaagagaaatcatcactttacttaccaattttcctttttgaccaattgaaaattttttttcaaccgaatataaaaatatttgacaggttagcatgtactaggtactattccaagtgacgtgtgtgtgtgtgtgtgtgtgtgtgtgtgtgtgtctttaaggcgtatgcattcacatagatgcaagtggaattctacacataaaaatgtaggtacactgttgtccccttttaactgaggaaactagtgttcagagaggttaagtaacctgtgtaacgtcacacagctagtctgtgcagaaccagcacttgatccctggctattttgaccctagagcccaaactcttaaccactgtgttctaaggtgacaaagaaacttgaaatttgaaatataatctaattatttttttcttcattctggaatatctgagtcaaagttctcaaattcacttgcagtttcaaggggtcaatgtaaatgacagagacaggcctgagggtgacatagagaatgaaaaatgtcccatctgcaagagttggggtggggagctggggggcagccagaagccagctgcagaggactgctacaaaaaaaaaagaaataatctgttattatttcagtgttgtgccaatttaggattattatgtcaaatcttgtgattttcacacaatgcaaccaattcaaaaaacagttattaaacataatctgagccaaacaaaacatatctgtgggcctacattacctatcagccaccactttgagagctttgcttcaacccaggccttgaacaaattttctgtggaaaaattatgtatcactgacaataaatcattgataatattcacatttcattgcaaatatctgcttgagcagctctgaaaaacttgaatcccttcctccccctgagacacttaacctgtttcttaattcatgtctccttgctgcgaagttttcctttggtcaggtagaaaatgaccttgctagttctgtttattgtttaacagaactcagtctcaaaatccctgtcataatccataataaaatagagagggcaaaacttaatcagctgtaaatgtacagtagttagcattcaccacaaaatgctaataatatttcgagaatgccatttctcttctggccttttgaccaagttggttaatggactgagacttgggaaataatggaaataatttaggctgagaacttctcagccatgcatcaaccttgaactgaatgccacgcagggaaagcagcactaaggctgtggcccgggtttggcaagcagagctcaccaaccagtatggacacccagaatgctaataaaaggaggatccagtgtttcaaacacaaataatgaatatccaccaattgcacgcctagcaagaggttttcttagaataccacaaaattaaaattgtatggctaatatttaggtaagatccttgaatcctgtggttttaaagaatcttctgcaagatagttcaactctcagtaacatgtactccattgtacctgagattttaggaagtgggacctttcctgaacatcttagactggggagttggccttaggacctaaggtcccaacttagtgttggagctttttaacctaagatattgttaattataactgtcaaattacaatttgacagagtcaatttgtaattgtttatcgacttcctttccccttgaaatagttcctggtaacctgctgaaatgttcccattattgtgtcattagtgtatcaatttctctgaaaacaaagtaaactgatgaggcgaaagcttgttccacatggcacctacctaatgaacagaagggtttattcacttaattattagttatgaatatcaagtgcactattgtcactctttaggttttcacctataaaacattaaaaatctagcatacaaatgaatgtatttgctaagaaaacatttaaaaccacagcggactctgaaatatccacccaccaagctactgggtaacttggatgatgcagctataataatcttagttaggtagtgctccttttcctctctctctctgttgaactatctaagtaggatgttggtaaatggtcttttaaaaataaaaactttggattaaaaggaaaactgaatcccttctatatttttgttactaacaaataatgcttttgtaaatttgaatggaaaacctcttatatgtattgctactgggttgcagttatgtttttgagcttaatttaaaatacactactcaaaaatttcatggaagatgaattccaagaatcaaaaaaaatgcatttcaaagctaaaaataaaaattaaatgaagattttaaaatacaaataaacgatagttcaagtccacgttacttctttaacacgtaggtccctaacccaataagctaaatcacatcatcattgggctgtgacccgaaaactaagtgaagcagagaaattattttctaaaatacttgcctttaaatttcttcctttcaaagaagaaatctcacacacagtttctgggactctaaagtggaatggtcactgtggtcagccatctgttagcattttgtgatgttaaatatgcaccccccccccgcccccacgactcagcaatccttcccatctgtacatcccaggaaaattcctgaacagtttcctaaagggacacttacatggatgatcaccaaagcatttttgttgttgccattgtttccatttgtctttctctcgggggtagtggggagctgaagcaacctaagtgtccattgctaagggaatccagaagttacctgcgatgagggttcactgtgaagtattctgcagcaattggaatcttagtacatccttcactaccaaaaactaacttggaaaaaccttcccacttgtatatgaaaagctgagacgacaggctgcaggaaaaattactttaggaaagaaaaatgtcctgtttgattcaatattctctcattcagttagttttcgttttttaatcttcttttgccaggcatcttatgaaacaaaaccaagacacctgcccctaacctttagaaactcttgtccaggaagggagacagacacaaattattttcttcacataatattataataaagaccacaaaagatgcatggacccatgtagtcaaagcacccaaggtgctgcctgtgccagaggacacagagaaaggacgacatggttgaattcaccccagagcagagtgagccaacccccccagcccagctcaacaccctcagggaaaaataccacagccttggaagacttcaaacattcacttacttctcactccacaagcagggagaaaagggaagtagaaggcagtggaaaatcaagcctcctgtgacccgtcattggattctcactggctggaaatgcacactgagaagacgaaggtgggtaatggacatgtgatttactagacatagtgctggggagaggggatattgccacaaaaccttcaataacatatccccacatcattcacgtgcaagctccaggtccccacactgccatattatgcaacttgttccacatctgcctcctgctgagcatattttcctcttctccctttttttcagccacataggtaagctggtgaacttgaggttatgacaggacagcttcccaagtgaccaccacacgctttccctgtggggaaatagttttctgatgatgccactagatgtctgggccaccaccgacacttaacaagttaggggacttgctaaaggcaggtaggctaagatttcctgcaaacgctcacagcaattcttcatttttttatgccatggtgaaacctatgaacttcttctccaaacacatattgtaagtgcataaaacaaaattcataggactgaaaaggaaactggttacattaaaacactccaagttaagaatctaagcaatttataaatgccacttatagggtgattgcgggtagacagatgtgttgctgttcgtgccaacaagcatttagcagcataccacataatggttctcacaaggatgtctctttttagcctaattaacctgcttattaacatgttcctgagcatttccagtttagcacataacatgggatagtcatcgacagagattcctcttctaccccttcaggaaggcctgaactacaaacgtatttccaatagtgatgtgcaccactctaccacccttgccaccttctgagctatcaacagcatgattgagcagggtgaggaccactgtcaagggcctgggagcagagtcaagtcatttaaacccccttgggctggtaccgtctgagatgtctggaaactgacatctatctcagtgctactaaaaccaccactagccacaactgctaagcaatttgttacatcatggcctcattcagcctccaagcttaaaagaattttcacacacacacacacacacacacacaatcattttgctggaggttccccagctaaaatgagtaagaatacattttactagtaagaataaagttcaagagccaggcgcagtggctcatgcctgtaatcccagcactgtgggagtccaaggctgaccaatcgcttgagagcaggagttcaaaaccagactggggaacataggaaaaccccatctctacaaaaaaaaaaaaaaaaaattagccagacatggtggtacgtgcccatagtcccagctagctacacaacaggctcaggtgggaggatcacttgagcccgggaaggtgggggttgcagtgagctatgatcataccactgcactccagcctcctaggtgacagagtgagaccctgtctcaaaaaaaagatagaaaaataagataaagctcacagtatatttccagtaagaaagtagttgcattcttaaacaccgatttcaaaaatgcataaatgatacaccattgataggaagtcataagtccttttaagtctatttgtattttttccatcaaaatgccatcaacacatgcttggaaaatgagaaatgtatagacaagagacactttatccaatccagtcaattattcatcccaagatggacatgaggactcttaagaatctgccccatccctaatagtccaaagtctataggctgtgaacttaaaatttcatctaacagctgtaaaaactgagaccaagagagtaaacaatttgttgtagtaatttttcatagtctacacaactattgtggaagaagtgccagtcttccagcttctgggttgatattcttattattcagagctgcacagatgtgatctgtttaaaatattcttatctgaaaagctctatggctgaaattattacaccctttattttaattcactaattcaaactaattagtctgggaataccaatctgacttattaaaatgcctaaggcattttaaaataaatctattactttcaagtattctcagcaacttcacctaagtaacaagagaacaatgtataatgagcacttttttacctactaaaaatgcattacatgttttatatacaaaaattaactcaaaatggatcacagtcctaaatataaagccaaaaactaaaaactgtctcaaagaaaacagaaaacaacctgtgtgatctcggattgggacaaatatttctaagacaccgaaagtaaaatacataaaagaacaaactagtatattggactttatcaaaataaaaacttctgctcctcaaaaaacattgttaagagagtgaaaagataagccacatactgggagaaaatatttgcagtttggttatttgataaaggaattatatcaagaatataaaaagatctctcaaaactcaatactgagaaaacaaacaatgtgactttaaaaagtggccaaataatttgaacacacttcaccaaagaagatagacaggtgacaagcaaatgaaagatgtgcaacattattagccattaggttcatgcaaattaaatctgcaatatgatatcaccacacacctattaaaaatggctaaaattaaagatacagacaatacttagtgctggcaagaatatgaagggactgaaactctcattcactgctggtgagcacgcatcggtacatcactttaaaaatgtttaacagtttcttaaaagtcaaacatacacctaccatatgaaccagccattcttctcccaaggtagttaccaaagaaaaatgaaaccatatgtctgtgtaacacttgtacaaaatgttcacagcagctgtatttatgatagccaaagttagaaaaactccaagtgtttatcaacaagtgaatggataaacaacgtgtggcacataatggaatactactcagcaataaaaagaaatgaggttgtgtgtcaacttaaaatgttttagttaaaaaaagaacccatatatatgcagcaacatggaagaatcatagaacaattatgcagaaagaaaccagatgaaaaagaagatgattccacaaacaaaattctagaaaatgcaaactcatctacagtgaccaaaaaaaaatctgtggttgcctagggatggtgggaaggaaagaggagctgattacaaaagagtataaggaaacttttggggtgaagggtttattcattacttttattattaagatggtttcatgggtgtaaataggttaaaatttaacaaagtgtacactttcaaatttgtgcagtttattttatgtcagttataccttaatagagctgttaaaaaacaaaaataaaatatgtgcattgacaatggcagaagcaatctggcttcattctactccacaagaaaccaaaaacaaatattcagcactcagattatcaccagtaatatcccacaatttattttttttttaatttttctttaaacactggctttctctatgttgcccagtgatatggtttggctttgaccccacccaaatctcatcctgaattgtagttcccataatccccatgtgtcatggggaggacctgatggaaggcaattgaatcatggggccaggtttttccctgtactgttttcacaatagtgagtaagtctcacgagatctgatggttttataaagggcagtttcctggcacatctcttttgcctgccaccatgtaaaacatgccttttctcctcctttgccttctgccatgattgtgaggcctccccagtcatgtggaactgtgagtcgattaaacctctttttctttataaattaccctgtcttgggtattgcttcatagcagtatgaaaatggatgaatacactcagtctggaatgcagtggctatacatagacataatcatagtgtgctgctgcttcaaactccagtcctcaagtgatcctcctgcctcagcttccaaagtagctagaactataggcacttaccacaccagctagagctcaaatttgaggctgagatgttccctgaaaccacagacaggtgaaaaactccagacagatggtaagagaaatggacttttctatctgcaatgcacctccctcaaatctgccaagcaccatgtgcaaaaaaattcacccagatttatgatttctacactggaaaaaagtgagactgaggtggacagccagcttccaaaccatcttgggttcttgttcagggaaactattcctgcttcaacccacaggaaacacagcaagtgccggtagggagaaaatcccctgagggtgctagaaacaaatagaggatgtaagactagtgacctcagctcacaaaactcagccctttatcttagccaaaaaagatgccaaactagagtggttgttcagcagcaccacactgtagaaggcacattccacagttcttctgggcatgaacccctagctatacttctcacatggcaggatattcccattgggacccacactcccatttcaagactggcagagctctgaaccttagtgagattagaggcaaatctgggcttcaggcaccatctagtgccaaaaaggaagcagcaatctaggattaagggaactcaacaggcaactgcaaagaacctctaagcaaacataccccagaaagaccaaaacaagccagggagcaaagacagaaataaataattaactcttccatacaaagcaatagacatatattcacgagaaataacagcaaacaaggaatcatgaactccctaagcagacaaaacaagcagccagggatgaaccctaatgagatggtgatgtgtgagctctcagatcaaggattcaaaatagcagttctaaaaaaaaaaaaaaaaaaaaaaaaaaactctgcaaactcacaaaaaaaaaaactcagaaatgtatcagatgaacaacaacaacaacaaaaaacaaatcctggaactgagaaattcatgtgttggaccacaaaatgcattagaagttctcaatagcagaatgaataaaaccagaaaaaagtctgtgagctcaaaagcaggctgtttgaaaatatacagtcagaatagaaaaaataaaaaaagaatgaaaaggaacaaaggacacctacagaatatgaggaattacctcgaaagaacaaatctaagaatcactggtgtctaagacggaattgagaaagagcaaggggtagcagcaaccttattctgaaagataataacagaaaaatttccaaacctagagcaagatataaatatccaggtacaaggatgtcagagatcaccaaatataaccaacccgaataagactaccaaaaaagcagataataatcaaactctcaaaggtcaaggaaaaagagaggatgctaaaagcaacatgaggaaagcagctaataacatgttgaggagctctgaatcgtctggcaacagacttctcaatggaaaccacagaggccaggaaagatgggacaacatattcaaactgctaaagaaaaaaaccataagccaagaatactgcacccagaaaagctttctttcaaacatgaaggacagatgaagtctttcccagacaacaagagctgggggaattcagcactactagacttgtcttacaagaaatgctaaatggagttcttcaatctgaaagaaaaaaacagtaatgtgcaaaaagaaaacatttgaaggtaacaaactaactgctaaagtaagtacacagataaattcaaaatatcctaatactgtaattacagtgtgtaacccactcatgtcactaatatgaaaactaaaagacaaatctatcaaaagtaacaatgacaacagcaacttattagggataggcaatattaaaagatgaaaattgagacaacgaaaagtcaaaatgtggaagggatgaagttaaagtgcagggtttttgtttttcatttgtttgtttcttttctttgtaatcacttatcgtttatttaaaataacttgttatatctataagaagttttctgtaagcctcatggtaaaccctgcgaggcaaaaacctataatagatacaataacaatgaaaagcaacaaattaaaacatattaccagagaaaaaaatcacatagccacagaggaagaagacagtaacaaaggaagaaagagaggagtcacaaaacaaccagaaaataacaatatgacagtggtaagtacttccatatccaataacaaccttgaatgtaaattgactaaattctccaactaaaagacatagagtggctgagtagatttttgaaaaacacaacccaactataagctgcctacaagaaattcacttcacctataaagacacacatagactgaaagtgaaaggaaggaaagctattccatgcaaatggaaatgagaaaagagcaggagtagctaaccttataccagttataggcttcaagtcaaaggttgtaaaagagacaaagaggttcactatataacgataaaggggtgaattcagcaagaggatataacaactgtaaatatatatgcacccaaatatatatataatgtacagatcatccagacagaaaaatcaacaaagaaacatcagagttaaactacactctagacaaaatggacctgacatttacagaacatttcatccagctgctgcaaaatacaccttcttctcatcagcatatggaacattctccaggacaggtcacatgttgagtgacaaaacaagtctcaacaaattcaaaaaactaaaaatgatatcaagtatttttttctgaccacattggaataaacgtagaaatcagtaataagaactttggaaactatacaagcacatggaaattaaacaacatgttcttaaatgatcaatgggaaaatgaagcaagaaggaaatttaaaaattcatgaaaggaatgaaaatgtaaacaaacatcccaaaatctatgggatacagaaaaagcagcattaaaagtgaagattatagcaataaatgcctacttcaaaagagtagaacaagttcaaataaacaatgatacatctcagtaaactagaagacaaccaaccaaatccaaaattagtagaaggaatgaaataataccagagcagaaataatgaaattgaaactttaaaaaatacaaaagattaacaaaaagttgtttttttgcagagataaaaaaattgaaaaacgtttagctagactaagaataaaaagagggaagacccaaataaatataatcagaaagaaaaaaaagaacacataacaactgataccacagaaattcaatggatcatcaacagctatatgccaacaaattcgaaaagctaaaagaaatgaataaattcctggacacatacaacctgccaagattaaaccaggaagaaatagaaaactcaaacagatcaataacaaataatgagattaaggcagtcataaagcatctcccatcaaagaaaagcccaggacatgatggcttcactgctgaattccaccaaatatttaaagaactacttataacaccaattatactcaaactattcaaaaaaatgaagaagaggtaatatgtgcaaattcactctacaaggccagcattgcccttacaccaaaaccagataaggacacaatgaaaagaaaactacaagccaatatccctgatgaacacagatgtaaacgtcctcaacaaaacactggaaaacaaattcaatgacacaataaaaagatcattcaccatgatcaaataatcaatgtcatcccagggatgcaaagatggttcaacatatgcaaatcaataaacatgatacatcagattaacagaatcaaggacaaaaaccatacgatcatttccacagatgttttaaaaggattcaacacaattcaacattcttttatgataaaaactctcaacaaattgggtacagaaggaacacacctcaaaacaaaaatggccatacgtaacaaacccacagctaacatactgcttggggggaaattgaaagacatttctctaagatctggaataagacaaggatgcacaaatttaccactttttttcaacataacatttgaagttctagccacagcaattagacaagagaaagaaataaagggcatccaaattggaaaggaagaagacaaatcattcttgttcatagatgacatgacattacatttagaaaagcctaaagattccaacaaaaaacactgagaactgataagtgaattcagtaaagttgcaggatacaaaattaacatataaaaatccatagcatttatatgcaaagaatctgaaaaagtaatcaaggcaccaacatcatttacaatagacacaaggaatataaaatacctagaaataaattaaaccagagatgcaaaaaatctctacaaagaaaactattaaacattgatgaaagtcaatgaagaagacacacaaaaaaagaaacacgcctatactcatgggttagaagaattaatattgttaaaatgtcaatactacccaaagtggtctatagattcaatgcaatctctatcaaaaaccagtaacattcttcacaaaacttgaaaaaacaatgcaaaaattcatgtggagccataaaagacccaaaataaccaaaacaatccgaactggacaaaaagaacaaagctggaggcatcacactacttgacttcaaaatatactacaaagccatagtaattaaaacagcatggtactagcataaaaacagacacatagagcagtggaacagaatacagaacccagaaataaatccacacatttacagccaactcatttttttaatttttattttactttaaagttctgggatacatgtgcagaatgtgcaggtttgttacataggtatacatgtgccatggtggtttgctgcatctatcagccaaccgtctaggttttaagcccggcatgcattgggtatttgtcctaatactctccctccccttgctccccacccgacaggccctgatgtgtgatgtttcccttcctgtatcaatgtgttctcattgttcaactcccacttatgagtgagaacatgcagtgtttggttttctgttcctgtgttagtttgctgagaatgatggtttccagcttcatccatgtccctgcaaaggacatgaactcattcttttttatggctgcatagtattccatggtgtatacatgccacattttctttatccagtctatcactgatgggtatttgggttggttccaaaatctcatgccagttagaatggcgatcattaaaaagtcaggaaacaacacatgcggtagaggatgtggagaaatgggaatgcttttacactgttggtgggagtgtaaattagttcaactattgtggaagacagtgtggcaattcctcaaggatctagaaccagaaataccatttgacccagcaatcccattactgagtatatacccaaatgattataaatcattctactgtaaagacacatgcacacgaatgtttattgcagcactatttacaataccaactcatttttgacaaagacaccaagaacctatattggggaaaggacagtctcttcaaaaaatggtgctgggaaaactgaaaaaccatatgcagaagaacaaagctagacccctatcgctcactatatacaaaaatcaaatcaaaatggagtaaagacttaagtctaacacctgaaactatgaaactattagaagcaaaaactggggaaatgcttcaagacattggtccgggcaaaaatttttttagtaagactttgaaagcacaggtcacaaaagcaaaaattttctgcattgcaaaggaagcaatcggcaaagtgaaaagataacctatgaaaaggccaaaaatatttgcaaactatccatccaacaatcaattaataagcagcatatataaggaactcaaacaacttaacagcaaaaaataaaaaccatccagttttaaaatgggcaaaagagttgaataaacatttctcaaaagaagacatacaaatgaccaacaggtatatgaaaaaatgctcagcatcactaatcaacagggaaatgcaagtcaaaaccacactgagatatcatctcaccccagtcaaaatggtttttatcaaaaagacaaaaaataacagatgctggcaagaatgtggagaaaggagaacactcatacatcattgggggaatgtagattagtacagccactgtggaaaacaatacagtggtccttcaaaaactaaaactaaaaggaccaaatgatccagcaatcccattgctggatatctatccagaagaaaggaaaccagaatatcaaggagataactatactcccatgtttattgcagccatatttacagcagccaagatatgggaacaacgtaagtgtccatcactggatgaatggataaagcaaatgtggtacatatatatatataatggaatattattcagtcataaaaaagaataaaatcctgtcatttgcagcaatacggatgtaactgaaggtcattatgttaactgaaataagccaggcacagaataaatactgcatgctctcattcatatgtgagagcttagaaaagtagatttcatactggtagaaagttgattggtggttaccaggggctaggaagggttgggaggagggagagatgaacagaggttaatagtttaaaaaaatgcagttagagagaagaaatatgaggtagtgttcaatagtatggtacggtaactatagttaacaataatttagttttagttcaaaatagctagagaagaggaatcacaatattcccaacataaagaaagggtgaatgtttggggtgatcgatgttgcaactgtcctggtttgatcattacacattgtatatatgtatcaaaatatcacatgtaccccaaagatatgcacaactattatgtagcaataataaataagaaaatgcattaaattccagacataataccaagctctttagataaattgtctcatttcatgtcacaaaaatacttttaggtaggggatgttgtaatactcacttccaggaagaagaaactgaggctcagagagattaaataactttgcccagggtcacataggtaggactttgcagagagaaggcacaagcattttgacttcatgttaaataaatgcttccaaagcacttgacgattttttaagataacgtgaacagctccttggtaaatatatttacaccatttatttgcttagcaaatcccttttcatagacagcatgggtaaatatcagccgtatcatctcaaggctgatctttcatcacacattccattacaaattctaaaattagtagggttcaaacttaggtctcagtgacttatagaaacaatccaggttctgatgtgtcacacacctatgaggcatgcatcaggctcattagaaaacaaattccagatcagtacaacataaggtaggagaggctaacaaccttgctctcacctggagagatcaaacaacgtcatacttgttttccaggagaagacaaatagaaacagacacagacacacacacaacagacagacacacgcagacatacacacacacacacacacacacacacacacacacacacaccctgggccagaaaaatgctgacctagccattctgtgaatgtttccaatttctagatggtatcctgaaagcaactaactagacaagtaattcatattaatagctgctctctccctttcaatttgggtattatttcctattggatatgtttagccggcaacagctcaaacatatagactatgcatagttagaaatcactgtcctccacggggcaacacttacttgaaaagcctgtaaaatgaccacaggacacttgcagggagggcagaaaacagcaacatgttcacatgttcatttctctagctcaaatccaaccagcctttgaaagtgccacttgaaagacaagcctcccactatttcttgcaaatgctttctaaacaacaaataagactttccagagcaaaggagacttttccaaaatctgtaactgtttgactttggggaagaagacacacctcttgactcctttatgcacaaccaagttcggattgctgaaatctcccacacccttggatggctggtatttattcccagccctttcccaggtagctgtgcaatgtcagtgatgagctactgaaaaattgcctgctgctaacaacactgttgctattcacttctttcatttcatgcctatattatatttttcctgaaacaaatttctctattgttccctctctgcttctaggatcccattacccaatccccaacagctaagaaaaaaacagagcccagttggagacacccaacaatctcaggcccttctaaccctgtcggacttagttatagttcttatctgatttcagacataccctaaaatataagcattgatggtacttggccttagtagtcaaattgtttttaactcttgcaaacacagtcttctcacaatcaatcctttgtaatgggtttttaaatgtcccttcaaaaatattatttccagtgttctattctgagactaccatatggaccaaaatatttaaagcatccaagcaacacctaggaaaatacaaaacgtcatttttcttcctgccccgtctctacccctgctgtttctttttaccaatgattttattttccttatagggaacaaatgattccaatttcctcgtatagcactggcatacagatgaggtattgacctgtagctttttaaaccccaaattgtaggctttgtttagatgagtctaaggccgtggcttgaaagaagaaaaagggaaatttcttctcaagggtaaggagaatcttttcccaaactacccgaggaactcttcaaagacagttgcctgttctgccctaaagactcaaagagggaagggtgaaaaagcctactctgccaagtaggatggctcacaagctcatttgaggaactgaaattctttactcccgtcagtaatacaaccctttctttacacacacacacacacacacacacaaaggatgtaaagcatgctcatttgtcagacatttcacaaagctgaacttgccagtggcactgggacttgaacttgcagctgaggaggtgagaagaagccaaatatgaacactgcatataatgtgttcctttcccttcttattaaaagctgagcccatcaagatggcactgaagaaatataatatggggtacaacggaggctagtggaatccctcaccatggaagcttttagcattcaaaaagctgagctggtacaaaatgagtaagtattttcacagtccttcccaagaggtggaaatggaggtcaccttgacagggtgacaactctcctcagcctaactatgtcatagcaagactgaaatggagacatcaccacccacatcaaactgtaccttgataggagctagagtcaaacttccagtttttttttttttttaacttctgaatcatttgttctcatctttggctgcaggtctgagtaatcaatagtacggttgttaaataatacaggtgcctgcactctactttgtaaggttcagatggaatctcgctgcagtgggccctctgtgtttttcgtgcaaaagctccccagggagagaataaagtaaccactatcttatggatgcctttttccattgctaccaaaacataggacctttaaaccattccacagtcttttctttttcttgctcataaaatagtgtatgctattgtggagttgcctgcatagcaatacatccatagatttactgaaataaccattcactggaagtgggacaggaagaaggaagatagagaaaagtacaggagaaaccatattaaaatggtatcatcaggtttcacttaccccagtgggtaagtgctcattattgatcaaaataagtttgctagtgggtaactttaagacttaatggttgatatcacatgcataaacacacacacactgtcaaattacttttgccacttccctctccctaaaaatatgctcttgcagagaataacagcataagctattcatcaggaaacagaactcttccccattctttattacttgaggttacgaatcccacttacctggtactttttctaaatttagtagtcatttgttttaaaaaaaaaaaagagagagagaactaaataactaaataaaacataaaagaaattaagtgaaataaagagagataaaacaatgtgctctatgactgacccatgaaaattaaaataacccataattccaatctttaaaaaagcaacattaagacctaactcattattagttcatgggacttatcatagtaggctctaaccacatgtgactattgagcacttgaaacgtggctagggtcacatgttaaaatgataatattttgaatatattgggttaaataaaatgtgttagtgaaattaatttcctctgttgccttttacttttttcagcgcagctttataacatgcaaaattacatgtggctctatttagctatgataagccttgcctaccccctagtgtcagaacttaggcaatgcaggcaaatcatttttcaaacgcatctgtgttaagtacaattcatttctgccggcaaagtacaagtatagccgcctgtacatacaattttatcattttcacaaatgttatctcaaatttaagcctcagagagactcctgtagtagatgttatattccccactcagttagtatttttgaaattaccaggtttattgtagaaaattagaactaaaacagcgtatgctatttagtcaagagtatttgcagggttcctataaatttcagccatcataggggacagaaaacatgggatcaaacttggatgcaacaactgctcttcaaaaaatttaccctaagttaaaaataacataaaccaccaaaacacacaatcacaacatgcatattttgcataatcatttataacagaaaaaaaaacagaaaacctaaatttccataaatttgaacagtacagaacctctacaaaacagataacattcaaaagaagaagacagctctaaataaggataactagcatttgagcactcactaagcaaacacagttctcagcatttcccaggtattaattgattccttattataaccgtgagacttattttttattatttttattattctcattttacatagaaagaggctgagtcccgaagaggtttcataacttgcccaagaatgaaagaagaactgaagcaaaactgaagctcatgctgcttcctctgccatgagtaataaaatcttttgtctcgggccgggcgcagtgtctcaggcctgtaatcccagcactttgggaggccgaggtgggtggatcacttgaggtcaggagttcgagaccagcctggataacatggggaaagcccacctctactaaaaatacaaaaattagctgggcgctgtggtaggcgcctataaccccagctactcaggaggctgaggcaggagaatcacttgaacctgggaggcagaggttgcagtgagccgagactgcgccactgcactccagcataagtgacagagggagactccatctcaaaaaattaattgattaattaaaataaagtaaaatcttttgtctctgacccaagcatctcatgccttctgcccagcatccacgaaactatgaccagctaacctgttagcttgcaaggagggtaaaagctcagacccttcacaattcttgacatctaactacttcccaatcagtgatacatcctctctacagcagatttaggtcaaggccagcaaataaaagggctctcaacacccttctgggtcactctgttccccagcttgttgaagcctttctctccttaaggttgagctgaaacctcagtcttcatagagcaactttcttcgccacagtcagcttactagaacaatgaaaaaacaagcctttttctcttatgcatgagaaatcttcaaaccctgaaggctctgaccacatctacctacccatgctcacagtcttcagctgttcctggaatgcgaacctttccacactcattctcgatgcctccaaatgtgaaaacagctgccatttatggaatgtttactatgtgctaatcccttcacctatttttccttattagttatcccaataactccaaataaaataggcatggatatcattccatttttacagatgataaaacaggttcagagaggttaagtggcctggataaggccacacagccaggatgtaccagaaccagaattaggtttgactttagaccccccaacatttgatttcctttcctgcctcatttccaggtgtgccccagtttttccagggactttatgccaacagattttattaaatagtcaccaagcaccacagcattttgtggaattgaaatagtgcagtccaggttatattcaaagttctctagggaaatggaactattaaagtgaacgtataaatcaatagcacccaagttctcaactttctcagctccatcagaaaactagctatgactccatctttaaaggataaaaatctgaatttttgaagtctcctagtattcacaggaataaatcttaaagttgtaagatgctttgtgtcccaactactcgtgtctataccagatgaaatttctaggaagatccctaaatctttaattccacaggagttgagtttctgaaacttccttccagaaggcatctttccactgcacaaaacatatttgctaccctcttgtggggaaataaggcactgcttacagccaaaaaaaaaggaacaaaaggacaaattgctagttgaagaaataacaagagttagccctggcctccttttaaaagaaacgaacctgccaattggccccttcaccttttctacagcttgaagctacacagtcccatatgtgtatgtgatctcctgcctgctcaattatgatggaaaatagactttaaaaacaacaaaacctgtcttttgcgttttttagttgcttaaaaatactactggattctgtggaaatgtattaatgccatttgtcttcaagaaagagtctcaccacccaacctgtgaaaattaggtgggttttcattttggtttttttaatgcttaaactaaaattacatctctgatacacacctaccgtaacacccatctgccaaaactgggggggagattcccacctttcttctgtgtctcttagccaggtaggtggagatagggttgtaaaatacctccttgtttacacacagcaatcaacatccactcttctaatccaagccataaaaagcatccaacttctaactagggtttcctagtgccatcatttctttaattggccagcactaaccatgaagcccatgggacagtgccaggagcctctctggacactcagacacagccgtttgcagataacactctgcaacttgctcccgctgtcagacttcctataatatacccacagtagagtgaaaatctgaccagagtttctcaggatctcggtgcactgccccaattaattctggtgatcctgagttctccatcagctgagcactaaactgggacaaaaatgccacatggacattgcaaggatcatggactttcattccctgaagatcattagataaaatttatagcatgaatgggagtgggtggtaatcctactgaaatgcttcacttgtcaactaatctgactcttaaactccactcaagaaaagagataagattgaggacctcaaacactatcctcgtgaacaaactcataaaaataggcacagcacaataaccaactagctgtgggcacttcacagcagccaaatggtattgattttatgctgatttgctgaaacttcaatcattatttttctcatcttcttggaactgtcacttgaggagggaaaattgagttgtgtgagattttaaaaattatcttgagccttaaattatgactaaccttaaaatatcagaataacgaagtggaaagtatgacatgttatatatttggtggtaagaatatctcatgaactttccaaacacaagacctttggagacagaatttataattctgacccatacgtgatttagggttcaggcatcactctttcccaaagaagtcaaaacatttctggcactgccacgcctcagattaccaaagctgagagagtaaattaattgacaacaagtccattgacacatatgaattattcaggaaaacacaatttgctggggagtttccactgtgtcactttaaatgttgatgtaagaaagaaaggacagaaacacacacacacacacacacacaaacacacaaactgatcggtagctgatggttttgatctcgcctttaaaaatcagcaatgcagagatatgagtctcactagaagttatcagaatgactgcctctaaatctttagacaacacccattttaagtcccttacaaaagttaccacagctttttctcttttctttttttaaaaaatcatgtagcatattttctccacatctctcaaaaagatcttaaattatctgactattcccttcactaaagccctgtaagtgttagtttaagtttatcataaagatgttctacttctaaggaagctgcaggagtggatggatggatgggcagatggactgacatgtatgcacacacacacacacgccaaccacacaaattgctgatggttttctgggattccttgagaaaaactgctataaaaataaaagtgtgcccaagaaaacaaaagtttttaaaagcctgaaaaatatttttaaaggactcttaaagcactaaaccattaaactgtgttactccgccatatttcatgcttcctctagttatttacacaccatcagaagctcacatcagttatctgtgtctaaaatgtggactctgacatttggaggggttttattatctcagcagtgcataatgagcttaaagggcttacctgcatgtccccggaggtgctggcttgaggcggacatcagcttacagcacaccattaacacgtaggctagaaagagccagtgcgacagcaacactgacttagcacagactctcatcctggaggaaaagcagggctggagtcagtgagggctgaggaaggccagactccctggcaagcaccattctaggaaggcgggagaaagcaggggcagatccctggagctggaattcctttctcccaagaaaacagaagaccaatcaaaccttatttgcacttagcattaactaaattttcaataaaaacctttgataattaagagttttccaagttagcactatgcatcagtgagaagcttatttatgaatctgcaagttgttgcctgagttaccctaatagagcatggggattttattctattttataccatgagatgtaaaagcaacacacttagagccagatccaaataaaatatatatgttttctggatctgaaagaatccatggagattttgcacatgtggtccaagaactttctcctggtttctctgactgtaccctaaggctttctggtctggaagactaggttcatagttgattaaaccaatctcaactcctcctttgggaaggagtatgggcaaatacaggtgaatataaaataaatttaacttcgtatgatggacagtatcaaaacagttgctcaaaaacaattccgttcacatgacaattcagttgcatggtctattctaaaacaaaagagtaaaaaaaaggaagatatcaaaaacattattcccagctgcctaactttctgccattttataacatcagaagggaattaagtagatagaactcgattaactttttttgtttgctttttttatattaacttttgaagcaaaactcaccgcatttggcatctgaaattccggtgctaataggttcttccttacacatgcctcatggcatctattattaccacaatggatcaaagaaacccctgtttaatatatgcaaatgtatacacacttatgggccgacaataaaaacatggtacctgagtttggcttcttgcctgagtcacactataggcaagacccctaaggaagtcctataaggaagcatctccagctcccagcaacctagcagtgcctctacgaaagtcccagtcccctactccacgaaaacacatcaaagcctcaggggaattgaatgccacaccatacgccgaggcacacacatgttctgctgccaacattctctctccgtgacctctcacaattccgtcaaatagatcttgttaaagggtgtattgctcattgatttgagatttggtctgctttttaagtagccaggccaatcatgtttgaagaacttggtgttaaaggcaacaaaaagcactggcttctttttgcccttttaaactgtttcaaaatggttttaaacggctatgttgggtaatttgcaatgcagcaataaaaaattaatctttcatttatgtgatgccttgaaattgtcccttttggggccactaattatgacaaactggaagccagggtatctgatccagcctgcaaatgtgttttgtttgatctgtgctttaaaaaaaaaaaagaaagaaattgaattggttgccaacacatacaatgtccagattgcaaatcagaatccagattctcttgaaaaattattcctggcatccccgggctcacatttccacatgggagtaacaggctgccgtggtcgcagctgcccctagaagggtctccacagtccctcccactagtcagtaccttgggcccaaccagcccaactcatttacatgtggccatttgaacttctgatccttgggtaagaggaataagcctttgtaacaaatagattgatagctgatattggggtaataactggaattttaaaacattatgtgtgagacagagtgttacattaacaaaaaataaatcatccaataccggaatttgagcctctggacttcccccaaattatgtgattgataatagcatctagaactcaggtaagatccacgtattattttctttgccacctttcaagctgtttctagagtttctgtcctcttcatgtgtgtacactgaggtggagatggaaggcatgctttgagaaacgaaaggcccttcaaagcagagaggctccatgtttctgtgtaagtttagaatgttagcaatgtctgaagcaaattaccaaacttagaagtttaaaacaacaatctatagccatactaccctcaacccacctgatctcagaagctaagcagggtcgggcctagttagagcttggacaggagcagtttgaaacaacaccgatatattatcacacagtttctgtaagtcaggagtctggcatgttctggctgggtcttctgctcagaaactcacaggctaaaatcaaggtgtcagctgggtgtgtcctcatctggaggctcaactggggaaggatcacttccaagtgctctcaggttgttggcaaaagccattttcttgggactctctgtattccccgtattcttgctattgaccaggaactgctctcaagcccttcatgtctttgccacatggcccctgcacgtgctccttcatggtttgaatctcttcctccaggaaaggctcagtccccttttagggcttatctgattaggtcagccccacccaggatagtctctcttttgattaactaaattcagtgtatgtgaaaccttaaaaacacctgtgaaatcccttcatctatgccttacaggtgtaatttaatcaaagatgtgaaactcatcaaaaccacaatgccacccacactcaaaggaaagcaattaaaatatttaaaataatgtcccactgttggcaataattgaatgaaatatctctaatacaaagagaaagagtttaacttgataaaaccataaattgatcgataatttgatcatgtatgtcaaacgtttacaatccagcagatcacttataggatttaaccctaaagaaataaccagcaacgtatgggacttttttttattgtttatactattgaaaatgatctggccatgcatggtggctcatgcctgtaatcccagcacactgggagaccgaggtggaaggaacgcttgaggccaggaattcaaggcaggagcgagctatgattataccaccacactccagcctgagcaaagagtgagaccctgtctcaaaaaaagaaggcaggcaggcaggcaggcagggaggcagggagggaaagacaaaaaaaaatgatgatccaaatgtttaacagtatgagactggttaaacaaattatgacacagccacaagatgggatgttcttcagtaatgaaagtgatattataaaatgaaaataaacaagtttattaaaaagaaacaaaagtttattttaaatatatgaattatatgacagcctgggcctgtcttgccttcagatccattcctcccgcttcccctatattgagggctggagggccctctaggctgcatttcccaggctcccaggtcagctggttactggctgggttcagtcaaggaaacgcaacagctggagcctggagaataggaaaagggataggccaggacatttctccccgccttctctgtctttggcaggatctgtggggtggccatctctccaccatggctccagttcctgccagaagggtccactgtggttctagtttccactctagtttccttcttctaggcactgcctccccacggtctaactgcttccatggttcccagccaggggatggcagtggcttcctgtgtatcttccgctcagtttctctgactctcccatcatatgtataaccagtctcctgaattcacttcccactggacaaaaatggaagttggagataattcattcccaagacatgcaatttacccaagctcacagagcagtgaaaaagccagcagaatggtttctgttttcctggttggattccaacaacaaatgccttaaatcaaaagtctcaagggcacacattccaaatcctgggcaatgatccctaatctatcttcttcttacgtggacaattctatgtaacaagttgctgggttagtagcaataagttccctgtctctaaaacaagtattcacttaacaatagctcaacaaccattcccccagagaaatgccagggcagagtggtagggttggggccagaaagctcttcagcaatagatttgtatttcttcattttttcctctactgaataaaccaaagtactattttgcaaactgaaataattttcatttcacagatgaaagctaaaatgaaaaaatcaacatttccccaaattcccaaaaagtgtaaaagcaggcttctaaaacggatcatcaactccaggatactcacttttgctaaattctcaatactttgtaaagatatcatgtccaggtgaacgttaaaataatcttaccttggggacctcataagatgtggttctagtcaaacacacttattccaggatatatttcagagtgactccaaattcccatctgttgctagaaccaatcatttctgccgttccaaaaaattatcgtagctcagaagacctatgttaaaaaggccaaaaaaaaaaaaggaatcaattagcattttaatgttaaaatgaaactaatttccagtagcaaaataatggtttttaaccatgacacctgcagtttcaggcaagtggcagacagccaaacatatccatagttgtaaggtgtcctactattagggaggaaaagatatagaattctacagtcattaattagccacatattagttaacaccacatagttgtaaagaactttctgcagcaggaagggtattcaaaatttaacagagggtcccaaatcatttgaaatgcacaaatttcactctcccatttcattgaccatcaggaaaaatggaagttagagataatgcattcccaagacatgcaatttgcccaagcccatggagcagtggaaaagccagcacgaagatctgaattcctggatttgtgtgacataagcctgaagatgatgctagacaatctatgaggttgctttttgaaaaaatattaataggacaccaagagaaaaagtgtttccaatataatccaccataccaaaatataaagaacacttgtgaatactgtagttgacattccctcaacgcataaacctaaaaggatttttctacttagtgaacacatttgtaaaaggactcagatgaccctaaagcaaacacatcttaagaaaaaaacagaacatgaaactataccatttgtaaagatgctaagttaaatacatccctcccagtggtaaagatcagagaaaaattatgatatgtgttaataaatattcaagttgcaaatataacataaaaatgatttttgaaatgaagtctaattactttagaatcctgtagaaccaattaagaatccaccaccaagcacaactgagatttttctcttagataacccaaagataattccacaagtttgattagagaacactttcggtgataaatttgaagactcaccactttggggctgcatgtaagagagtatgggccttgagtaattagttcaacaagagagaaatggctttaaatagctgtataaacacaagttgctcagaaaaaacaacttgaaaatgttcatctcccagatcctccaactttattaagtgtgtttgtccttacgtccacccaacggcatgatgtgaccttctgctatcagaaagaactacacaatataattcatcagaactcatcataatgaactccccacatattggaaaccaaaatgacctttcctggctaatatttttcttattttcttcacacaaaaggaaccactgggtattcttttttcaattcattaaaaaaatagatccatcagtggaaagtaatgcgacctaatagttcatatgcaagacaagaagccaggagtttaattttaggctgagcagtaactcattcagtcatattttcccagagtgtacctgaggcacttacttgaaagaattaactctttcttgtcatgtcttagtctgttttctgctgctgtaacagaacagaaattgagtaatttaccaagaaatttatttctcacagttctaggggctaggaagtccaatagcacaaaggcaattaaatttcaacatgagttttggaggagacattcaagccataacattccacctctggcctcccaaaactcatgttcttcttacatacaaaatatattcattccatctcaatagcccaaaagcatcaattcaaaagcccagtgtccagagttccatctaaatcagatatgagactcaagattcatcccacctcaaatgtcctccagctgtgagcctataaaatcaaaacaagttatctacttccaaaacacagtgatggaacaggcataaaacagacattcccattccaaaagggagaaatagaaaaagaaaagaagtaactggttctcagtatgtccaaaacccaacaggtaaaacaacatcaagtcttaaagctggagaataatgtcctttggctctgtatgtcctgcatcctggacatgctacagcaggaattaggttgccaatgccacgggcagccctgcccctgtggctttgctggacccgatccactcagcagctctcttgggttggagtcctatgcctgcagctctcccaggctggagttgtacacctgcagctctacatttcgggagtctctggggtagcctcgctcccatgactgccccctagtacatgctctctgtggtggctcctcccttgtaacaactttctgccaggaccccagactgcctgatacatcttttggaatctatgtggaggtgactatggccccaaggctcatgcactctgaacttccacaggatcagtaccatgtggacaccatcaaggcataccacttgtgccctctgaagctctggcactagctgtacctgggcctgcttgaggggtgctgcattggaatttggggagaattccaaggctgcatagggcattgaatgctgaggtcccacaggtacccctcttgaaatcttgccctcaaggtgctagctttcctgaaagatctctgaaatatcatcagggtaattttctcattgtcttgaacagcaagcacctggctccattccagctgtatcaatcattttagcaatctcttttgcctgaccacacccttagtattctctcccaaatatgctgttttattcttcacatggccaggcagagagtcttccaaatctttctgttctgcttcccctttaattgtaaattctgcctttaactaatttctctattcactcattttactgtaagcacccaaaagaagccatgcagcaccttgaacactctcctgccacatatactagatcattgctcttaaattccatcttctaatggaatcttataaaacacttccatcttctaaaaccttagtgcatggacgcaattcagccaaattctttaccatgttaaaacaaggattgcctttactctggtttccaatacatgtttctcatttctgcttgagacttcatcagaatggcccttaccgtccatatttctaacaacattctgatcacaacctcttaagtgatctctaagaagtctcagactttccctacagctattctcttctgagccctcaccagagccacccttaacactccattcacagcaatacagtttttcagcatttacttcaaaactgttccagcctctacccattacccaactccaaagctgcttccacattttcaagtatttgttatagcaataacgccattctctgtaccaattttttgccttagtctgttttctgctgctgtaacagaatacctgaaactgaaacagaatacctttaaaaaaatctatttctcatagttccagaactgggaagtctaatatcaaggtgccagcatctggtgagggccttcttgctacattatcccatggcaaaagatggaagggaaagagtgctcaagagagggagaaagggctgaacttgcttgtataacaatccactctcacaataaggaacacggccctcgagataatgacattaatccattcatgagggtggaggccttatgacctaatccacctcttcataatcctacctcttaataccatcacaatgacaattaaatttcaacataagttttggaaggcacatttaaaccaaactgtgtcacttctaacttcagtacattcaagatcgataactttgtgcatggcaccaaaagaaagcatttacttgcaatcattttattcctctgttgttcccaactataacacagtcctttctatcagtctgcttcaaaagtcatgtgtttttaaagagtctcagtgttttcaatgatgaaagacattgcccatatctagactaagagaatttttttagaacatgtctggtcattctcggaatgaactaaaaagatggtggatgctgggctgcatttttcatcttctgcccgatgtgtgggtattatgtggagacagttactgatttactacaaaagagcagaaagcctatttatgtctcccggtaccaagaaactttgaggttcccaggcagaagagcccattcttcaaatgtttaatttatttccatgttacacaagaaagaattctacctacacttgatttcttatcaaggaaaatagagaggctgtgccttcctcgtctgttgatctacttgccttcattattggtgaggtgaattccctcagagaactattctttcagaatacagtcattcacttgtagatgagcaccttcagaatacctcttcggtctgctacacccacctcactccacatatgaatctgcagggcatcacatttcccccatcttttcactctaaaactctacaatgatgaaataccagttcctcttaaaattgaaagacacactgaccttaaacctggatctaactatgaggaaaatcagatgaactcaaattggagcaacatcctgcaacataatttctctgcattcctaaatagtatcaaggtcatgaaagacaaaaaaaattaaaataaccatgagaattgtctcaaataaaggcaagaaacatggcaaccaaatgcaactgtgatcttacattggatcttggaccaggaaaaaatagtcatcctcagaatgaactgtacacccacacaaaaacaaggacacatatacgtagccataaaggacattattgagaaaatcaacagtatctgaatatagcctgtagattgcattacagtgttctatcaacattaaatttcctcattttgatcctcatactgtagttaagaaagaaaatgcacttgttattaaatacatcctgaaatatttaagaataaagaggcaaatgcctcccatttattttcaaatgactttaagaaaacatgagcgggaagaagtcaagaagaaagagagacagaagagcaggatagagggaacgaagaagagaaagggaattaatgaatgcaaaaactaataagcaaaaggtaagcaattggtgaatcggggcacaaggtatatgggaattctttgtactcttctatgaacttttcattaaattggaaattataccaaattaagacattacatacgtacttaaaagccttcagtttataaaatatactaaaatgattgagagcttattgccaattctaagcaataaggggagtgaaagtttgaatgttgtggttaattcaactctctgagctttcatccaagcctccagagaaggtttatttgtttttattttaaaaacactgacatagcgcctgctaggaaccatgcacttgttagtcattttaaaatataaactcactttaaaagaaggatttatttacatcacgatatggcataggtagaagtggcttgtccaagctcacttagctagtaagtggctgagccaagattctaatttatgctgtctggtaccaaggtacctacagtttcagttctagtaaaagtatttccaaaaaataccagtcccttttcatgctttagtaaacaggaggaaaataaatctttcttcaggacttgaagacattggtcatcaatctgacattaaaaattctgtctgtggctgaatttgtgtagacaattggactgaatttgtcagcagatgctcggattgtgcctatgatggtttacattaatgcctaaataaatattgcctcatctctgaaaagctagtgaaaaacagtggcacaggcttctcatttgctacagatttattaaaggttaactaatgtcatttcccaaattaagaccaagtatgcaagaattatatacagcttgagggccttcaccaccatttttttaaacagatggaaaacagctgcacttctgaatagaactctctaaaacgtttcagtgaagatataccagagccagaacatcatacatgaaggctaaattacttcggttgatttctatgaaggaattcagcaccaaaacattaaaaatggatttttgtctgtgcatccactcaaactcatctcctaacacatttgaattcaaaagcatttttgcaaaagtacacagcaaaacagaatctgcttaataacaaacaaatagcccaagtgctactaaaccacactgccctttcccgcctgcccactcaccagggaaacctccaagcccatcttgcatcacctccagagtgaggaggtttggataattagctatttccagactcaccatcagttcatctctgacctcccgggctgggatctaccgggatagcctggtgccttctgtactcagccccttgagtactagggcacaagtaggaataattttttcagctaatgatgtaagaggtgacaccctaaagcgtttagatattgtggtaaatcatttttccacactaatttccacccagacagaagatgatggaagtgaaaaatgtttcagaaagcagcaatctgggtttggggagtaactagagggttttatgagtggaagggtagggatggggggagactatcccactaagtgatgtctttccattctgggataatcaatagaaatctcgaagcagaacttgcctacataaaaccattcatcatttctctagacagaaatgaggtaatatgtttccatttccagttgcttaaataacacaatcacattgaattgtctttagaaatctgcaaacagcttttccaccaaagcatgcacaatgaaatgtaacttctctcttgacaaatatatcctgaaataaggcaggtattaatgatcttcttatattaaagagtgtgctgatgaaagtaaatgtgcttaacaggttaccaacgtttatgtgaatatatttcaagcacctgatacacggcagaacctccactgagccatcatttataatgatcacatatgtggaattacttttgtaatttagagagtattcattgttacatgttaaagcagacatgttttcccaccaatatgtggtatatacctgtcataaattgctttttattgcttccttaaaaacatcagtgaagaatttactactgaaccattttacaacatgctaaagtatgttgtaaatgagccattaaagacaataactgtctattaaatattaaagaattttataaatggcattttaatttcaagtgttaccaataccatctcatctaaattaggtggtagagagttgttttagcagagtgagaaggtttgaggggggtggatgatgacaaatcagttaatgggtatgacgtacattaatcaggtgatggatacactaaaagccctgccttgaccactacacaagctatacatgtaacaaaactgtacatatgcccataaatatgtacaaagaaagaaataagattcttctcccatttttaaaaaacgctcttctagtcagagatgatttaaataaatagacatgctatgtttatatatggtttacactctgtcactttaagaactgagaaattccttaaaaccacacagcatcttcatttaagtgcactgataaattccttcctaatggatatatggtcaaaccacgcatttcgttaatgaagaaaaactctagccttcaagtgaccgtgaagtaaaaagtacaaaagcaatcattgctaagtaataatgaataactgagatccagtatacataaaactgaaaacttagctggcaagttacataaaataaaatgcgctcaccaaaatcagcagcacccagcatggctccacaacttgttgtccaagtgaaattgcccaggtctggggctgaacaaatgttaacggtaatgacaatttagccataaatctctcaaggcccaattatccttactgcagagggtttatttcttttaattggaccagtttttaattggaaattttcctctcatttctcatttttcaaatattcaaaacagaatgtctaaggattttatttaacataatcaatagccaacataaattttggagattatctacaagttgccaagtacttgaattttatctgaaaagtttttacatgataggatctaacttctacataaaaaatatttgtaaacattaaataataggtcttctaatactatcatcattactatgggcaagtgggagtctatttacttataaccagaatgtaaagttcttgaggggagaataatgtcttatttctcttctaccccagctgctagtataatatcttgcataccgtggaagttaaatatgttttgttaataaatgaataaatgtaagcccccagtttcactcccaaatgaatggtcatttaatctctatgcttcccaaattcctcatctgtaaacaaatacagtttaaccggatgacctccgaggtgccttccagctgtaacaataactcacagagcattttaggaaaagtacagtgtgatttagctactgttaacaaacagctcatggacatatatacacagtaaatgcagccatgagtggattacatggcaagacaaagcccgtcgcagacaatattggcctttctaatctattagtgggataaaggcttcttaaaagcttaatctaaacctgtattacatttcaaccttaaaatcatcttttgtttgacaatggtgccctcctgtggacaaaacaaggaaatattttgactatgctaacatttttaactggtttataatatgtatgtttttattataataattacacctttaaatttttaataaagccatatttataaatagaatgcaaactatccttaaataaacaaaagatataatttaaataacactatcacactaaatagtattaccaaaagaaaaagttaaatcaaaatatactaacagcttctaaataaaatggtaattatttctatggaatactacacataataaatgcaggcttaatgggattcagtatttgttggttcttcctgttacttgttactttttttttttttttttggagacagagtctcactctgtcacccaggttggagtgcagtggcacaatcaggggtcactgcgtccttcatctctgggactcatgtgatcctcccacctcagcttcccaggtagctgggatgataggcacgcatccccatgcctggctcattttttgtatttttagtagagacagggttttgccatgttgcccaggctggtctcgaactcctgggctcaagcgatcctcctgccttgggctcccaaagtactggcgtgagccaccacgcctggccatgttacttctataacacaagtctatgctacaaactatcaaaggtcctcagctatttaaagatgttcaaacatccagcctgtgtgtactgaaagcagactcagcgctggcattatactgggacatgctgggggaaattaacaagactgattcttgtcaattcaagacaaatctaactggaaagacaaaaacacacaaggagcagccaacagagtaggccattcaatatttggcagtgtgttttagcataatgaaaaagaatactttaaccatgtgaaaaagggtaagatcactggggactgctgtaatccaggaaaacttcctggaagaggcaacagcacagaacagtaaaagtaaagatggaaaggagtaaaagaagtttgagggtgtttttggttttgttttgttttgttttgttttttgtaacagagtttcactcttgttgcccagcctggagtgcaatggcgtggtctccgctcactgcaacatccacctcccaggttcaagcaattctcctgcctcttctcccaagtagctgggattacgggtgcataccaccatgctgggctaatttttttttttcttttagatggagtctcactctatcgcccaggctcggcttactgcaacctctgcctcctgggttcaagcaattctcctgcctcagcctcctgagtagctgggattacaggcgcccgccaccatgcccagctaatttttgtatttttagcagagatggcgtttcaccatgttggccaagctggtctcaaacttctgacctcaggtgatccgcctgcctcagcctccaaaagtgctgggattacaggcgtcagccaccgcgcccagccttaatttttgtattttcagtagagatgaggtttcaccgtgttggccaggctggtcgtgaactcctgacctcaggtgatccacccaccttggcctcccaaagtgctgggattacaagtgtgagccaccgtgcccagctgtttttggttttgtttgttgttctttaggacagaaaaggtctgtatatgtgcatgggtttgttttgttttgatttgattaggtgggggaagtggaagagccactaaaggaaaccacagaactcatgtagagaaaagagaaggggagatacagtgggtagggggaattagctatgcacagggaacttagacagaagagctagcacagcatccatgctctatttctgtgttcaatgggtcacctctgcatgattaattcaacaaggattttttttttaatcaactctctgtgccagagcctgtgctgagtactggacacagagggtagacaagatccccagtgtcctggagcttgcattatagcatgtggagacaaacaggtaaacaagcataaataaggttaactgtggactgagagaagcattacagagaaaacaaaagtgaacaatgtgatggagactagctgagcttggaggaaaagaggttagctacttggagtgggtgttcagggatggcctggcctcactgagaaggtgactgtgacatcatggtgaattacataatgtgactttccaagggaagcatattccaggtaaatagacagcacaaagagcctgaagctaaaataagcttggtgtgttcaggagcggagaggtagctagggaggccagaggggagtaagcaaggcaaagagaggtaggaggtaatgttaggtagcaggtgatggcagagaggtatccagggacagaccaggcagaagcttgtaggccatagtgtgctgttagaattttattccaaatgtggtataagagttttaagcaggagagaaacaggagatggtttaggttttcacaagagccctccagctgctgggtagagaatgtcctgatgtgggggcaggatcggaaacagggagtctactgcagccatccaagcaagagatggtgatggcttggagcaggatggtgacaacacagcccaagaaaaactgatcttccaaggccaaaagtagcaccgagcacacaacaggttctcaataagtctgtgaatgaatgaatgcttgagtaagtgagcaaaatgttattaccagtcttgcaatatgccattggttttttaacctctctctagagctgatgtctgtctcatgggcaaatacaacaaatactgacatagatggcctcaagagaagaaaaagtggcaaaacaccttattgactgcttgttcgcaggctaaggttgtgacgagaagtacaagagaatgaatttggccagctatctggagagtagggtacctgtgaagcccaggcctctaaatggggtcctctcacatccctgctgggtatctcagacactccatgtgggagcaaactaccatatgggagaaaactaccgaactaactataaggtccaagtttcaacaatactcatttttatcttatggacactgtacttcatacaatctgttgtttttgtttagttttgtttttattgagacgaagtctcagtctgtcacccaggctggagtacaatggcgcgatcttggctccctgcaacctccgcctccgggtttaagtgattctcctgcctcagcctcccgagtagctgggactacaggcacacgccaccatgcctggctaacttatgtattttagtagagatggggttttgccatgttggccaggctggtctcgaactcatgacctcaagtgatccgcccgcctcgacctcccaaagtgctgggattacaggtgtgagccaccacgcctggcctaatctattgtttttcactcttcactttggctgctaggaagctgacagccaaatttatagttcatcttcagtaagtgaacaggacctttcaccatgccttttatatattaatcttatgcttaattttgcatatccttatttttggccaggtacgggggctcatgcctgtaatcctagcactttgggaggccaaggggggcagacacctgagatcaggaggttgagaccagtctgaccaacatggtgaaaccccatctctactaaaaatacaaaaattagccgggcatggtggtacatgcctgtaatcccagctacttgggaggctgaggcagaagaatcgcttgaacccgggaggcagaggttgcagtgagctgagatcatgccattgcactccattctgggcaacaaaagcgaaactccatctcaaaaaaaaaaaatatttatttttccctttatctctcatttcaatgattattcttaaagtcactctcaaatctgttttgatgaagacatacacaaataaatgaatatatcaacaagacaccacacactaaccggtccaaagttcagattgtcctaagagtctcttcattgactccccttttctttacccaacctacttgccagaacaaaactcaacacttcccccttgacatggttacctcaggtgaaagcattctttccaaatgaaaaatgttacccagactgtacctcacaggaagtcacagacaacagatcacattgggattcattgactgatttcctggtagacagcaaggttgcaaggggatgagacaaaggactggtcaggtttggtttaaggtaaatacgaatgggaggaacaaggtccaggacatgtggcacagggaagtgagtgcaatcaggagagctggagaaggacaaggtgaaaaaggggtgagatgggaaaggaccccaaggagatacattttatagcttgagcaaaggtcagtcttgaccagcagtgattcagaaccagtcgcttcatctgagattaaaatcaacttgttatgtatgatccaagaatccggaaaagttttcacaggccctagaaaatatggaaaggcatatctgattgttttgccctcgtgtttaagtcaagagaagagaatcaaataatctgttataatgataatgatttagcatatgtgggccaggccctgtggctcatgcctgtaatcccagcactttgggaggccaaggtgggcggatcacctgaggtcaggagaccagcccggccaacatagtgaaaacccatctctactaaaaacacaaaattagccaggcatagtggcatgcgcctatactcccagctactagggaagccaaggcaggagaatggcttgaacctgggaggcagaggttgcagtgagccaagatcgtgccactgcactcaaacctgggtgacagaatgagattccatctcaaaaaaataaaaaataataatttagcagatgtgtactctgggtcaaatatcggaccaatcaagcactttatcgctcatcttgttgaatccttagaataaccctgtaaggaagtctgttttgttttgtttacatctctgtttaacaggagagaaaataagtaaacccgtttacttacccaagtatacaatattagtggtagactcaggattccaaactaggctgggagattccactacctgggaagaaaagggagtgtcgaccagaaaaaaagcttgagaaaacaagaaggggaattgaagtagggtagtaagtggtcagccaagaccttccgaagactgaagtttggacactacagaaagcccaactcagagtatttctcaggttgaggatgcagttgttaaagatggagtcttcccaacactggccatagctgcgtaggaaatacatcacataaatttcagccacatatctactttttcatgtgtaaactttatgaaataaatgaaatacctttaaaatatttccaaagaaaatttagcatccaaactgagatactaagtgtaaaatacacaccaaatcttaaagccttagtagaaaaaagaactacctcattaataatttttaatattccatgtagaaatattattttagacatagccagctaaataaaatataatatgaaaattaaacataaaattcaggcacactggtataaccaaaagtggttttccacagacaataatataccctggatttttttttttcttcatttcaaaaaaagttttggcatttacggaaggcttcttaaacttcttccatggtttgacatcattgactcagataaaggcctaggaagccattcctcctattcaggatctaaaaaagcagcagttcacatttataacgcattacaaccagaacttgaggcctaagaaatttctatgtcgagtccacagtttcaaacgcaaattcactcatcaaggctttgttcaggcatcagggaaacatcctggcagcaagtatacctatataaggaaatattaggtcacgatcccataactccaacacacaagagatgcaccacacactttaggagacttccaaagcagaaaaacacaagagactagggagaatgacctctcttcctagtttatgccttcaaggtattaaatgtactattcatccccaaaagaagaaatgcatataaaaactcagatcaccataatatgcagtgtaacataaaaattaatatctggaaagcaaatttattttcaccacctaaaagacatttaacctttaattaaaataataggcctggcatggtagctcacacctgtaatcccagcacttttagaggctgaggcaggggactgcctgagctcaggagttcaagaccaacctgggcaacatggcaaaaccctgtctctacacacacaaaaaaaaaaaaaaaacacaaaaattagctggctgtggtgatcccaggtactggggaggctaagacatgagaatcacttgaacctgggaagcacaggttgcagtaagccgagattgcaccactgtacttcagcttgggtgacagagcgagactctctcttaataataataataataataataataataataataataataacaataataataataataataataataataaagctgcctggaaaccattaattccatagtaactttggtaactggggccagaaggaacagaagcaatataattccaatagtatccagctttttccagccttcctgccacagggtctttgcacatggcagtccttctgttcagaggcaaacacattcttctgtcctccactaagttaactcctactcatccttcatatctcagggcaaatattactgcctcagagaagcactctctactcactagctaaaatcccaaattttagtcttttcttcttggtactctctagaactgcctttttatactctcgtgagaattccctatcaaactggagctccgtgagggcaaagatcaggcctcttctctcagtattgtttctcatctctagcccttaacagagcaagttcaaagcactcaacaaatacttgctgaatcaatgaatggatttgaacacctaaacttaatcaggctatcccatttcctttacctaataaatttggttttgcaatcacagtttccaccttgcagtgaaatttttaaccaaagatactttcctagacattgacccaattcacaactactgctttcactaaggaacatccccagcccccatcaaaccttctaagaaagggcagggcagcatggtttgctatgtagttcagccacccatggctaattcaagccaagccaagggaactttcctcttcctgcaacttagaattgagaatgagaaacagctaataattccagaattagctgtcaagggagaaatatataaatttaggaggtatgaggtggccagcttttcctcatccatgcagggggtacaaagaaagccagacttcacagagacaagagtgacacagatgcacacaaaacagaaataagactagaagaggatgatccaggtccctgaaggtcattctatttttagttccaagactttccttggcctgcctttgtgccttcccttgaattcctcaagaactcctacagctatttcacttaaaaaaaaaaaaaattcttatctttgcttggcctcgctggagttctgtattgatctaaatagaattagcccatttcatagataggaagaaatgagcccccagaaattaccttcccaaagttacaaagctaattagttgtagagctgggctttatacccaagccttctgagacaagggaaactctgtctatgctacccaattagtagctactaaccacacatgactatttaaatttaaatttaactaggtaaaatttaaaatcaagttcatcagttccaggaacgatatatcaagtgctcaatagctccatatggtaatattgtcatattggacagtaccgttctagaacatttatttctactactgcagaaagttatattgaatagcactagatccttgaaggataagccctctctatttgtaaaatctgaaacaaactgcaaaagctgactttggctgataccaaacacagtggaacacactggaaggagggcagatcttgccaacccaaggcttgggttcttgtcctcactgtttacatcctttcagtgggcaaatcattagacctctctgaacctcaagctctttatctgaaaatagatttggaaataactaccagggtccgtccaatgttcaaatgaggcatggtatagtgaagggctctgtaaattgcacctgtactaacaatagttgttatcattaataacagcagcagttaaaatcatttctagagcctatataagaactctgctgtaagaattttcaatgcattaactcatttaatcccctctaatgtactttgaggcagttgctatcagtatccccattttacaaagaaggatatgtggaggcagagaggtgatgtgatttgtccaaggtcagctaccaagtggcaaagctagaatatgaagccaggttcccaagtctgccctcttaaccatcgggcaactctgtctttctaagatctcaaagcaggtattccacaatcaatgcattcactcttccctctcttttacccataccaccattttctttcagataatacctatatcattcacttttttttttggagacagggtcttgttctgttgttcaggctggactgcagtggcatgatcatggctcactgcagccttgaactcccaggaccaagtgatcctcccacctcagcctccagaatagctgagactacaggcacatgctagcatgcctgaaaaacttttgcattttttgtaaagacatggtttcaccatgtttcccaggctggtctcgaattcctgggctcaagcaatccacctaccacaggctcccaaagtgctaggattacagtcatgagccactgtgtccagcctcattcatattttgtatgcacactctagttacaaccttgtcttttggtcttcctctattaacatgtttcccttatatgtatatatttttgtacatgggtatgagaaacaaccagaaccttatcagacatgaaaacacttgacatccaaacaagaagcaggcctgttcatcctacaatattatgcaaagtagcaatcagcaaacagatcctgcttgagaaaacctgacaacccaagttagtaaaatcactttccaaagtattttcaatctaataagtaatttcagacatcattggttctcccaatcaatggccatttctataatagacgaaaggaactgaaaaaattaaaaaaaatcagggacaggactctggagagcatcccagcaccctccctcttcttgttaacatttatctgtcctgtaacaatggcaggcacagtgctagccaatgcttttactcaaccaatgtcttccttcctagcatctcttggtagtcagaagctggagcaaagggtcgcccacccacctagaaaacaggagcttcagcataggctataaagcaactgccagcctcgagaatgggattctgaacctggggtccttgcacagaatcaggggtccataaaccgggatgagaaaaaaaaatgacatcttaatatttatgagcctctatttgaaattcatctgttccttcaattataaacgtcagcaacaaaccatttagcagttcctatgacttggccgcaaatagaaatcataggtactttcaaatctcattaaagtttatcagcaagacctcaaaatgtgtgtccatcaacaacctcataattatatgtagttaacaggcttgcttgaagatcatgttgttaaatgaatacagaagcacacatattctatatcataaaatgttttaatgttttgatcactacatttccatataatggcttcctttgaaagccagtgaattttgtttaatgtgggttttttaaactttcattttaggttcagaggtgtatgcacaggtttgttatataagtggattgtgtgtcacaggggtttgatgtacagattatttcatcaccctgttttatgtgtttttaaaacattattatgagacaggatccactggcttcatcaaactcccaaagggaccgatggcacagaaaaggttcaggactctccatcctcagaggtgacaaaactatacctttgatgcgcaatatcacagctgcctcctccctctttcctcctttccatcccatgtgagcctaacctataacccattaatccttccagaagttggaaagaaaactgacagatgatgcaatgacttctgtataaggcatacaccagtcacaaaagcaccagaaaactgttgcagaatggtttttagaaagttaaaaaaaaaaaaaaaacaatttgccatgtatagaaagctccatcgtttcaagtgcctcttgcaaccactatcctataatgtattccaacttgctactgtagaaatggcctcattatccccacagaggtccttcagaaagcctatttcaaagcaagcacctctgaaagttagcccacaatctaaaagcctgtgctataaatacacatgccctgggaaagcaacagcaagcttgattccatgattgcatctttaagaaggaaaccgggagagccataggctagcgagttgctcagtaaacagctgtgagaaaaaggagatgacgtttctaagatatttaggatgacaggtgtcagaagtccacagacaaagagatctttgtcattatgaaagataaaatgcgtaagcaggcaaataatagtaaagaggttcataaaagtttcccaatttatattgcaagtgtctacgcaggctatgacaaaggacaggcaacaatgaagtgaaattatcaatatgaatggggtcttagggtaggttttccccaaagcagagcctgggacaaggacttaacagaagaatgcatgatcaagactgctgatatgagcaacggaagctggatgccaccaggggctcccaagaagcatagagatgctcccagaatcatccaccgaaggacaggaggtgaggccatttatttatcaactcctcacttctgctgactcaggggcattaacttccaggttaatggcagttaactcatgggctacttttgctggtccaccagtgccctggggaatgcccagtgaggaaggtggcaagagaattggtgaatgctagggatgggaactggccttgcagctgtggccaaaatcagtggaggctgaggagatgtaacatgaggtaacacaggtggctgctacccataaccaaatgcggaatgtaagctttttttcctctatagcagctccccctgcattacattttaaaatccatccactctccaaacatttttgagccccaactatgtgctacacactacctccagacactgggacagcacaatgaccaagccaggcaagatttctgcctttttttttttttttttttttttgtgagacagtcttgctctgtcgccaggctagagtgcaagtggtgcgatctcggctcactgcaacctccgcctcccgcctcctgcctcccaggttaaagcaattctcctgcctcagcttcccaagtagttggaactactggcgcttgccactacacctagctaagtttttgtattttagtagagatggggtttcaccacgttggccaggatggtatcgatctcctgacctcatgatccgtccgcctcggcctcccaaagtatttggattacaggtgtgagccactgcgcccggccggtctctgctttcatactccttaaattcataaaaaattaatatgtcagatactgactttaaaattagatcaaagaaagagtgatgaggaaagggaaacacacagagaagataatttagcaaggggagtcagggattgtcattttcagttggagcctaaatgacaaggaggagacagaccagggacatgtggaagaaaagcatttaagcagtgggaacagcatgttcaaaggccctgaggtgtaaagatcactagtcagtgcgatctcccacaaggtagggagaagggaacatctgttataatcaggagttctcattggtcagggggtaaacgtaccatggaaatttattttcagatggtgataagatctgtacaagaaacagggtcctctcctggagcaggcttccaagcaagccaaagcttttgttgctttctttgtttcttgctaaactgccatccacggatcactgaacgtgaagtttcactgtgttaactgggcctaaaccgaagtgaaaatcccaaactgcctgagtcccagggcatttgggaaaggtaaaagcaaaagtaaacaataaagtaaattcccatctgaggaagaaaaggagcaagtgggaatgcatagacatgaagtgaaataatgttgtatgtacacagcaggtcagatgtggaagtaggatgtggagtagacattcttcaaaggaacaagtgtcgttcctcaaaatggcaaagctggcactgcctctctgtctcttgttcatgtcctgggcgatgatacattgattggcataacagaaaatcaggtattgattacacatgtccctccctgggcattagaattgaagaccttgccagttgactgctttttactttcaattattcggggtcttttactcttgagggactcagtatgcaaataataatagctactatgagacagcttttatttagcactaacgatgtaccaaatactatgttgaaaacttgtttacattagttcatttgaatcttgcaacagccttctgagacagggactccctaagagacagaaaggttaataatttgggaaaggttgcaaaactgataggtaggtaagctgggatttaaacctgtgagggtctggctccagagtccttctcttatcaacagctctaggactttgttaaatcagtgtcaaccagagagtggactttccaaggcgctggtgttttaaaggtgctgcctttaaaacttgcctgtatgtagacagcaccctttatcttgtacagaactcactgtcatctgggccaggcatggtggctcactcctgtaatctcagcactttgggaggccgaggcgggtggatcacctgagtgtgggagtttgagagcagcctgggcaacatggagaaaccctatctcttccaaaaatacaaaatattagctgggcatggtggcgcatacctgtggtctcagttacttgggaggccgacgtgggaagatcacttgagcccgggaggtggaggctgcagtgagccaagattgcaccactgcactgcaacctgggtgataaaagtgagagcccgtctcaaaaaaaaaaaaaaaaaaaaaaaaagccaggggtggaaggggagaaagaactcattgctgtctaaaaaccagtttccatggtacattacacccatcatgaaaaggtttcaataacgtgattttagccaagagggagggaagcaaaaaagcaagggagagaagatttggagaaattgattctctgctaatatccaaagtagccacagaaattaatgcttgttgtccaaagagaaggtggaggcaaagatatgcaccaactgtcattctcagtagaatagctttgtttctagccagctctttaaagtcccctgctttggagaatgcctggatcctcatatgaaaactcttcagctgctgatacaagtgtcaggaaggcaaaaggctagaatgagctgaacccggcagaaaatgcaaagagctacaaaagggctatttttgttatgctcagggcaaggagaacaacaagacgacataggtctgacgcctggagagggtgttgtgatactaacagtgacagcaagtgcagttactcagcctccagtctgcatctgtgttccctcaagatagaggagatgctttccatacaggggagaggggacactgtttcagggaagtgagatccaaaataaggtaccacgattgtcagagtgcctgccctctctaaataagtctgaggctcctggccctgatgaattaaagcccaggctactcatggcatgaagtctgaagtagccacaacatcgatggtaaactctaaagaatccaggagaataggagatgtaccagcgaataaaaaggaataaaaatacaagttgtgccaatcacatatcagtaagcatcatgccaatcccagacagactgctgtaatgcattattaacaagggggacagggtgaacactcaatgcagcaacgattacttggaatcagcatggattcgctaaaaataattcataccagtcaatgctcattccattttttcatactcactgaagctggtgatcaagagattactatggttataaaatctggaattcagcaaggcattctgactaggtttttcatataactgactccaatgcaaaaatattttaaaatgtaggctggacgtaatgaaaataggtagactaaataacgctctaaaagtactgattaaccatatctacatcaatttagaatgtccctcttagagactccctaagagacacagaggttaacattttgggaaaggttacaaagctgataagtagggaagctgggatttaaacctgtgagggtctgcctccagagtccttctcttaacaacagctctagggctttgttaaatcagccctaatctctagtgggaagccacgaggctctatccagagcctgtcctattcacgttcttatcaacaactcagatggcgatattgccatcattccactaaatttgggaatgacctgaagctaagaagggaaacagccactctaaaaaatcagaagcaaaagtgaaaaaaaaaaaaatatccatcaaggtgcccaattcacagaaagtaagatggaattctccagaggtaaatgcaaaacattaagcatgagtttaaaactataagtggacaaacagtggagagaagaaacactgctctccgcatggaaaaggactgcacatagaatgtcttgatggtaaattcaagatgagtaagtcatacaatatggttggtaaaaacattcatcttatgtttcattaacaaaagtatactactcaaaagtacagaagggctagttcagttatactccgaagtagctagaccagaatcaacaatatcctatttttcagttccatttaataagcatgacaacgatccagggttcattcagcatccatggcccagatggtcaaaaagccagaccagccccatctgacagcgcttcccaccacaatgaaacattctctatctccaatgcagtagtcactacccacatgtagctactgagctcctgatatgtaactactgtagctgaggaactgaatttttagttttgtttaattctaattcatttaaatttatgtatctgcttgtagcttggggctaccaagtcgggctgcacagctctagacaacgccatatgccaaatggtggaagtaactcaaaggatggcaaaccccccaaaaaaaaaagggatttggggacaaaatgacaacagaatttagtatctgaagttctgtcttgtggaagaggaattagaaatactgtttgcaacccaccgggcagaattaggacttagagaaattacagtaagagaatatccatggcgctgaagaagtaacagcttaacagttacaacaatatcaattctatgagggcaggacctgtcgtcaccatactcaccacctagcacctaacacagtgcctggcaccaagtagtccctcagtaaatatatctactgaatgagtgaatggctcaatcaacccatgaaataggaaactgtccaaatggaacataaacacctcaaaagactatgaattccccgcctccccaatctggaggagccccaaggagctggctgacaacttgctagggatactatggaagatccaggctccaccaaaaggtagctggactaaatggcctttaagtgctttccagatctgctaaaagccttttgcctctactatcagatgggactgggttcaaatcctgacacgtaattcacatgactgtgttacttatctaatgctgcataatggattatatgcacttagtgacttcaagtaatatacatttgttatctcacagtttctttgggtcggaagcctgcgtgtggcttatctagatgctttgtttagggtctcaagaagctgcactcaaggcactgggaaggcctgctttctcacctggaggcttgggggaggaagacttccatactcacagggttgttggcagtattcagtccttcatccttgtgactgtaggactgagagcttcaggggtttttgctggctctaagccagaggttaagctgttcctaaaggtcacctgcagtcctttaccacatgggcatccccaacacacacattcacttcttcaagccatcatagagtctctagagctaggcagctagcaaggcagagttttatataacataatcatagaagtgacatcctatcacctttgctgtattctattggttagaagcaagtcaggttccacccatctcaaggggaggtgattatacaaatgtgagaacactcagatgtggggatcataggggcccaccctggtatctgtctgtgacagtgaccttagcaagtcacttaacacactccagcttctcatctataaaaatgaggcaactaatagtacagtggaatcatgataggcaccctaaatatgcaaactcactttaggatgtaaccagagtcaggtctgtctcctcaatggcattgaaacctcacaacaacaaatatagtaagatagatttaggttaaagaggcttaagattaaaagagaagcgagccaaccctttaagccagagatatacttaagaattctcaagccatcatccactctatagaactttgatagaagcagaattcattcaacattcatttattcaacaaatttgaatgcccagacttctgcacgtagacattccttttgttccttcctgtggactagctcagcaattctcaaactttagggctaagaattgttctgcagggttgtacacaaaaatattttatgggattttgcagggagttattctgactatatacgatttttctttgcatagttcagcaccaaatctcatgtgcaatcagattccattgtaccaacctcataggtttgttctaataaaacatcaataaaaggttaacacaatgcttggtacttaattaagtgcttgataaatatcaactcttacctcctattaaactacaaagcatgtaaaaaagatatgatagattttgcctgaaatattagttcattttaattttgcattctccaaaagagggtcaaactttgaatttttctcttctgctgaatttacatttcaataactgtagccccaaaacatgttaagggcacggttcacattcaaacagctcgctgctgaaagcaaagacactgctgacgtttgggaggagagcaattatgccaagccaatcgataaaatgaactgtaaagatgaatcctccatgatccatttttttcctataaaagactgcatttggagacttaacagctttcccccatgtttctatcatcttctcgtaaggcaaagacaaaacatcaaccacagaaaggtgctgtccaattagaatcaaatgttcttttccaagagatttacattccctgtgtattttgatggaaaagacactaacaaagacttatgtgtcaagcactgtgctcaacaaggtcccatgctagctcatttacacctcacacaccccaggtgatgggtatgatcaactcagatagagaaacagaagctgtgagagaggttaaatgatttgctcaaggccacacaaatcgcccaaaccaatcatttgttcaaaaaatatttgagtcttctatgggctggacaccaccagccactgcatggcttatacctaaatcggagaacaaatcaggaagggagacacaaaaatacaagttcacctgtaaccatgagttagcagggaggggataaggagggaaaactgcttaatttaagtcggtatgtcagaaacggtcaaacagaaataaaatgccacaaaccttcctaggaagggtgtgcatacgtttgggtgtgcgtcagccagtggggctgccagggctcaaagctcttattagtggtaatacgtttccgacccacacggagggctctagtgcccagatcatcagcccaagcgctgggaaatcatttcaattctccacacctcacctccgaagcatcactcccctcataagcccccttggatcaatgcttcatcctctgcattccagtgaatcactgatccttctccattctttgggtccgagctcacagaatatttcctgtactttcgttctgtttttcacctgacaccaccccgcaactcactgggagagtcagtctgttattttccccattgtctgtatcccacgaaagaggagcccactcctaaaggggaatatgagccagttttgcttttctacacctgccggggcccctttaatcatgaaaccacagggaagacctgaaaaccaaaatcccccttccacttttaccagtctcatctaatctgggtctttttatttgcttgcagaatagtacatcaaaagaaagattggggagaagggggaaatagccatgattaaaagactgctgcaactcaaggacagaaccaaaatgttagatgcctgacttcactactggccgctaattaaatgcaaaacaggaacattaatttgaaatgggatgagccacactatattgggtttttattttttgctgcaaaatgagccgccccttggctccctccccgatcctgccgtgttttcgcagtgttggggaccagatgagcgagcgagcggcatgccgttaatcaagtcttactcatctgtgtgtgccgctgcattcaaagagaattaataacgggcttagctgaaaaccgggaggaccaaggtgctgctggctcctgttcaagtgctcccagattcatggctgttcttttaagccccaagagatcaaactcagttttacttctgtgatagcttgaaaattgcaaagccccaagaataccctctctggggcttcagaaaaccactggagagcaacaaagtcaaaaggaaaaaactgagttttctagtattttcctctaggtggatgttaataaaaagtaagatatagattttactctaaggctcaaggtatttacccaggttcctgaatagagcatggctgctggaagaagtgttactgaaggtgatgtgggggtaggaattctgccccaaaatatttccccaactgggttatactattagagatcaattctttggggttctttaggaaatgcctgtcctagaggaattaacacgaaaagactttcagctgctaattcatttaaactgccctaattacttatatgaataaccaccaaaataaataatgaatgcaatggctgcttctacctaatgaaaacttcctgtgtcaaaacactgtgctgtgtgctgtacatgcatcttccatctaatcctcacctgttattttcttccttttacagaggatacctgaaagagctaacatttttttgcccagggttgcacagataggactcaagccaagatttaaatccaggagagtgactccagagccagttttctaaaggccacccagttccacctccttgtatacccggtggctgggcggagttgcaaaataaagctggccatcagggaacagaaaggagggcatggaggaggtggtaccgccagctagggcagcaaagtgcccaagaagaagcggaaagatgtgatggaaggggcagggaaaggctgccaaagacaaaatgtgttttatttagcagaatggttaaaagcagagcctttcaagctggaccacctgggttccaatggcagttcaagtcgtgagctgctggtattcaatttacagtgctgtttgttccttgcttgccttctctccagcatgcaagtcctacagaatgagaaccatttggagaaattatctgttactaatctgatcaatgtctgaaagacagtctcaattagagacagagagagaaagaaattcgagctctagaactcactaggtgtgaccctggcaaaatacctcatcattctatacctcagtttcctcacctataaaatgaagacaataatcctacccaacccaattaagtgtgttaatacatctaaaggattttaaatagtgcttggcataaaataagtgctatatgtgtggtagctatgttttcttttaattatcaattctggcaagaagtagtcctgactccaacagtctgaaaaaaacaaggaagtgcaacaaaaatgagtgcttacatctgccaaaaacatgtatgagaatgttcacagaagctttatttccctagccaaaacctaggtgaaaaaaatagatgttcaacactagaataaagtagcctattcttacaacgaaatactatgcaacaatgaagaagaactactgttacaggtaacagcagacatagagttgggcaaaaaacttagggaacaatataaactatatatttccatttataagaagctgtcaaagagaaaaaagtaagttctactggtagtggtgtgtatgactaggagggttacaaaggaccaatctgggtgctggaaattctgcatgctatgtgagttgtggtttcatgactatgtacctatgtgaacattcactaagctctagtaattaagatttggacactttattgtaaattgcacctcaagttttttaattagcaaaaggtattaaatcagtatatgtgatgtgaccttatgtgtaaagttagtaactaagagttttaaagtttatttaaattgtgatgcattcgtgatgcacttcatcaattaagctacaacatcaaactcgttattaagatgagaccaaatatgtctacttcaattagcatatttaataaataatgtagtaaaaaaaccatggaagcggtgtgcaaattagtgacgtttggacttcactagactatggagaagtgggcacacagtcctttattccagcagggatcaacaaactttgtccatgggccaaatccagcccactgcatggttttgtacaccctgtaaactgagaatcgtgttgaccttcccaaatggttgggggaaaaaaagaatagtatttattgatacatgaaagttaaataaaattcatatttcagtattcataaaatgtattagaacatggtcatgcaacattcgtttacataccatcgcaggctttttcccactataacagtagctataacagagttcatggggccacaaagtataaatatttactacatagccatttatagaaaaagtttgtcaatccctgctgctcaagtggatacctttcatcattgtcagtgatgcggtcccatgaagtcacctccctgttctaattctttcgtactaagaggctattctcaaatacccaccatgattaattccttggctccaaattctgaagcccagtgagtgtctaagctctgagttcttaggacaagctctggcccaatggcaactagaacactattacaagatctttgccaaaaaagacaatacaattacaaactatcacaagcaaacattatgagttagtctcttgtaccacattgaaaaagtgtcctttttttctggaatttttactgtgctctcaagttagttcttgctttaaaaccaaccaactgtagagtcctcttctatgttttcaagtcattactgcatctttaaagtagaaacatttagggtcattgttggacatgtacagacagaaaataattgggctgctaattaggtgataagaaaatttaactctcaaaatggtgatggaagatgaattttcccacctctgaactttcaataggcttcagaatttggagccaagaagttaatcatggtgggtatttgacaatagcctcttagtaagaaagaattagaacagggaggtgactttatgggactgcattttttcctccacatgggaatatccttcctcctgtctccattgtagctaaatctccctaactaaactgatagttcactgaatatgaaatccatattagaattaataatcatacccagcccaccactttgtgcaaaatgggcacttaagatacatatgaagtgaagaaaaatttataagagaaatttctatctccattcaataaatatggaattgaccaagatatgctgaatttatctgctcatctccttagactttaagtgactatttttctatctgcaaaggcaataactatttttgacagacaagttcaaaacctaccagtgtgaatgtgtacttttggaaatagggtaaataccttacaattgtgagaaattctttcttgtggaatgctgtttaagaaatgttgtgaggttcccactgactccatctaatgttaatcatttatgaaatactgtggttcagagctcagcaagtgaagtcatttcaggcagtaaatatacgtttcctgtcaaaacatatcaaacggataagacttcaatttatttgagaataagttgtaactcacttcaatattggcaatttggaggattctctgatggcttttaatagccttgacagttttcttcttcttgcccccaaaccactgagtatctctccatttgatccttcccagaaatggccctcagtatctgtcttcgtagtatccatccctccaattccaaatccgttgtgtggtttcctttcccatcactcggattttacagaactcaagttagatctacatgtaactcgaagtattctggatttacagattattacctcattaaaactaggtcccaacttcatttatgactgcattctgcctgtatcatttcaccccacatgtaacaatgccctagaaaataaaagctttgatacaaaaatgttgttctttttgcaaaaattaagcctagtggtagaacggtcaaggcaggtacttcagcaccacagaatcaccagggcctcaggcagcttctgtctttctgttctgcctttttcccttctgcctcttatcctcaaggtcacttcatagcccaaaatagctgttggagaaccaactattacatcacattccaggacttagaaaggaggaagatccagaaagggctctacccctggattttagaagactcactagaaataaccacccaaaacttctacatatatctcctatggctaccctggtgaaagagagtctgtaaaacatagtcctgattctgtacagcttgtgtcttactagaaatcagggttccaattactaaggtagggggaagaatagatgtgacgtacgtagctagcatctcttccaccctgtattgcatatatccattttgtatagatggaccaccaacaattaaataattgaaagaaatgtagaaatgtctccagcatgggccctttcatcacctaagggaaacttccagaagattccaccccaacctcttggagggcaactttcacccctagtgaggaaacactgatgtacttctcagattggacatgggggtgtattgcatatttcctcatcaggttaatgtaatgacagatttcagatataaacagcacctcaactgcacttactatgagactgtggtggttctacagtttgagtttttagggctttaaaatctcacaggtgtttctacatcatccaagctcaaagcagaatcagagacctccccccctgtgtgtcagtgtggaacagactgaaagttcccaggaacgaccgggcatggtggctcacacctgtaatcccagcactttgggaggccgaggcaggcagatcacgaggtcaggagctcgagaccagcctgaccaatatggtgaaaccccatctctactacaaatacaaaaaattagccgggcgtggtggcacattcctgtaatcccagctactcgggaggctgaggcaggagaatcacttgaactcgagaggcagaggttgcagtgagctgagatcgcgccactgcactccagcctggacgacagagcgagactctgtctcaaaaaaaaaaaaaaaaaaaagaaagttcccaggaacaatggtatttacctagaaccaagtgggaaggtagaaacctaagctctgaattcaacacttctgagttttcactctgacacccagtttgtggacgatcaggacaagttggtagatggcaacgtggcttctggcagatctttaggagtaatgataatgtgcgtttatacaatgagctgtagttttcgaagcattttcacatagtcatcaattggaaactcccatcagtactttatagcaggccagatctttgtagctttgagtaggttagggatttattgcttaaggttttctctcatgagacaacatttgagacttaaataatgagaggaagccagacacacatacacacacacacacacacacacaaacacatttcacattccagggaaaggaaatcaggtacagagccaccgaacaaggaaggaacacattcactgtatggtaagaaatgagagatggtcagtgtggttacctcagaggaagggggagaggtcgcaaatgacactggagaaaaaatcagcgcactgtcaaccgtcatcctctgaccctacttctaatgtaacttttgcttgtcctacctccagatagattttcaacatgggaatcttatccatcttctgcctctgtcatcctcactcaatctacttctaaaaatgtctttcaagaaacgaaaaagaagctcttgttttcattgcaagctatgtctaattttaaaatatatacaaaattcctaaattataaaacttcatttgatttttatttgctcgagacagggtcttgctctgtcacccaagcgggaatgcactggtgcaatcacgggtcactgcagccttgacctccttggttcaagcaatccccccatctcagccacctaagtagctggcactacatgcatgcatctaaccatgcctgcttaatttttgtatttttttgtacagacatggtttcaccatgttgcccagattggtctcgaacttctgggctcaagaaatctgcccactttggcctcccaaagtgctgggatcacaggtgtgagccaccatgcccagcctcttccatttgctttaaaaccagatttttataaactttctgtaaccagcactttcaaattgcaattcactttgttttttaaaaataccatatacacagacatatacagcatcctatttcctgtataccaagagtaaaccttcaaaatatccctctgtaagaacgaaattccaaacccctgccataggattcacacttagtaggccttcaattctgtcaccttccctgcagcttcccaagtccactgcttcaaccagttaggaaaaacaatttttaaaaaacatcttggcatccatcaaccagcattttcaagggcaagaaaacagcagcgcccaaggagctgtctgaggtgcttaaggttaatggctgtatttacatagccatcaattcactttacaaagaactgccccagtaggactgtgcagctccagcaggcagcccccgtcaggacagagcagacaggagtctctaaacaaggaggaaaatgcctgataaatcttaatgacatcgtcttgttttcattcacttacttatcaccttattttcagctcaagagtctcgagcccctgatcgaacaaaatagactacacttccatttctccatgagtcactctctaaaactttttgggactgtagtaaattacaatggccttaccttttatgatgatgcataccttgcaccagcgctgtccgatcgggcagccactacacatacatggctatttaagtttaaagctaaattaattaaaattaaagaaaatttaaaatttgcttcttgagtcacattaaccacatttcaagtactcaaaagtgacatgttgcttagtggctctcacggtgaacagcaagaagtttggaacatttccaccatcacagggaagttctattgaaacatacaggaatttgtaagattctacttacagattttattgataatgtctaggacttgacctgttctggagttaacatatctgaattccaagagaacataatgataagagactttctgcagtccccacgttttccagacacattcccaagccactagtgcattggtgtttttaatgctctaaaacacaccctctgaccaggcaattacacttctaccctagaaaaatgcaaacacatgggtaccaagagattgtaattatgagaaggctttaaacagtaaacaccacatctcagttaacaccatatatgactttgttcaagaatggtatcatcatactctctgtagtagaaaaaactgggaaaaatctgaatgcccatctgtagggaaacagctaaataaaatacagtacattcatagtggaacactatatggtagttaaaggaatgagtgagacctgtgtatgtataaacgtggataatctccaagacaccagtaagcaaaaaaatacaaactatagaatcagatgtataaaatgacactacttaagtgaaaaaattcacacacaagactgtatatttagtaaccatacataactaacataaatagcaaagtttaatatattttgatattttcacattatactttttaaataaagttaaatgccaaatatgcttcctatttctgttgattagttggcattgatacaaatcaacttcaaatgataagagagaatctaccaggtcttcatcagtccattcttcctgctcatgtttggatttctttgaaacataatgtatactaaatattttaaatatgcgcagaagcccaaactcttcatagtatctgagaagggagagatagaaatgggttgtagagagagttagaagtgatttttactttttctctaatttttttttttttttttttttttacaacttgtgtattccctgcaggagttctacaaagtcactgtgaccctgtattatgaccagtggcaccactatcccctacaatgcagcctaagtggctgtaataacactaagcagccattcccagccagcagacagtaccacccacacatgccatgttctacagtaaatcaaagactatggttttctaaaagcagatattgttcttaaaaaaattaggacaattttgttgtttggatgcttctgctgtttagtcttccatagaagccatctccagcagggccttcgtctgccactcaacttggaaacctcatcttctaactgtctggggttgagtgctggggggacaaaggccaaaagggtcggcagccagggaggagaactgtagcatcttgacagttgggcagagatgaccaatgtgaaaacctgccgaggggacaacagtgactgatggctcctaaggaagtattagtacaaacctagtcgcacgcaacaccctgctgcccgcaagaggggatcacagttccacaaaccagctatgtaattaaaacacagctctggagacgaaggaggttaaatgactctgacccagtccatccgctctgcttggtggttgccaattctaaccttcctgccaacacccacacatttctataactcagattatctccaaaatatttcacaaacttccaatttttttaaacaagtgaagaaaaaaaagcaagctctttacatgtgttttcttattcaaaagagacttcagtttgcaaacttttaatctttttagacagtgcaagacaaagtgaaatccactgaaggcttttcatttaagcaaatgcagaagataatttattcctccaagtggcaggagaaagcaataagccaggcatctgtgcaaaactttccataccccctcaagtcctataactctgtctacaactccatcttctggtcctgactaaatcttcgattattcccagaacgaatgaaatcttaaatccacatcagcttttaacatctgccgagtcttaactatacaggaacaaaaacggaattcctgtatgtcacctgccgataggattacaatttaaatcagactcaaaagtatatggaaattgaagccttgttttttcctagtccaatgtagacatcagtcagatgacggaagttggcaataggctggttacatgctacgtacagcaaacctgcctcaacatccatttaaacaactatgcaattcttattttaaaaggcctcaactacagaaaacacatcttatgctctaaaagaaacgtcaagacattatcaaaatcagtttctcgggcacaacactgatccaacgaacatttaatttgtacttttggttcagtaatttaaatcaaccttctgaatcatactatttagacaagcttaccaacatatgacaaaatgagaaactctcaacctaatcaaaacaaccttatttttataaaaatctctgtattaaaatttttaaactctgaaaaatgtattgtgtaagaaagtgttatacaaagtgtggtccaaagcttggaagcatcggcacctcatgggagcctcctggaaacagaaattcacaggcctcatcccagacttattgaatcacaaactcttgaggtgaggccagggaatctgttttaacaagccttccaggtgctccagcattggtctaaagggtaatattaggaatgtcaagaatactggaatttggggaccggtataccaaacaagatcgatcatgtaaaatcaatttttaaaatccaacaaagttcagaatttgcagaggatcaaaaaaaaattgcaatcagcataaaccctatattcatctcccttccttccttacttctaagtaaatgaggatcatgaaacttacatatggatatagtcaattgcttgtaagttcatgtctatttatgctgtggttcagaaatatttgcacatcaaaccagaatctgagtttacacttgggatcctgagtcttttgtagatgtgaaaagagtaaacttggaatcaaaatctctcgaagaaacggttttctaggaatcctgccattcctttttctcaggatgaccttaactttcagtcttgaggaattttttcctttcctgattaatacttcataggatgattagtatattttgtacatgtgtacatcaggacaagctggctcatgacttttcccctactactgagaacaccagagcttggtgctccattgtaaaaggattaactaacatgctaggccagtatcaatggcagagcttactggcactgtctgctcccccaactcacccatgaggaacatggttctaaccattgccattttcctttaaaatagcaaagaaacctggcaaataaactacacacatctgactcaggattccatgaggcccagctctcccactccccttccccatacaggcttatttctgggtctttagaatcaaattagaacaccctgtcagacacctatttgtgcaaacgttaatttcaagtatatttaaatgtcttcacatcttgctattgctcatcacatcaagcagagctgcttctactgtgtaatcacaataatgaataaacatggggtgcttaaaaaggactgaggcaccacaaaactgatcaattgttaattctataaagtgactaaacgtgccttcctttgtaataactccatcaagctgtgttttgggtgggaaggatgcccacgtcctctgcctactgtctctgtaaaacaaaaatgcaatcatcagtcagatcctacctaaggcttatcttaatcttgattatttcctcatattgtctcaacccacctctcccccacaactccaacgagaagcaaaaattgtcatggcatttaaaaaaccatgggctgcatgattatcaattgacaaaggatttgaggcagcactaatattaacagcctcaatagccacagtgtgtatttattgcctgttattattttgataaaataccaatttcacaatgaacatctgacctacaggaactccagatctcggtgaaattcctttgtgtggcaggaggaggactgttagagcttctccttagggtaaacacacttgttatttacctcttcttcccaaccacgcctgggccatatgcatgaggagtttgtccaacgtttcttgagttcaaagaatgaataatctactaagagttgtgtctctggaccacactgcttgggttcatactgcgtccttgccacaaactaccagtgtggcttccaccctgagtgcttcatttttctaatgcaaagaagggtgatgattgattgtgtctaccttgtaggacttcaggagaattaaatcagatagcacaaaaatattcttagtacaataaaatggcacagctaccatagaaaaacagcatggtggttcctcaaaaaattaaacacagaattatcatccaatccagcaactccacttctgggtagagactcaaaagcactaaaggcagaactaaaagcatcttgaacagatgtttgtatacctatgttcatagcagcatgacgtgcaatagccaaaaggtggaaaaaaacaaatgtccattgaaggacaaataaaaaataaagtgtgggctatacatgcaatggattattcagccttaaaaaggaaattctgacacatgctacaacatggatgaaccttgaagacattatgctaagtgagataagacagacacaaaagaacgaataatgttatgtctccatttatataaggtacctagaggagtgaaactcagagagacaggaagtagaaaggtggctgtcaggaactagaagggggaaatgggaaattcatgtttcatgggtacagagttcagttttgcaccacgaaaaaggttctgtggatggaatgggcaatggtagcttaacaatgtgaatgtacttaacgccactgaaatgtacacttgaaaacggttaaaatgataaattttatcttttttacccaaactgaaacaaaaatgcttagtataacacccagcaacatccttactcaacaaatgataactattgttactattataatttttttaaagctcaacaaggcaaatattaacaaacattctccaacgcaaaaatggccagcatccagagaaagctctgatgaaagacacacttgctaagtaagatttaattccatttaaacatctccttacccactccccactgcctctctaacccccactggtaggcactccttgaccttcatggggatgtttaaatgttaaccaatgagctttctaaatctcctcagctgcatatcagcacctaagctttgaggtgggggaaattccgcatacaaggagaatgagattggtaccaaggggcagactcacagccatcctctggcttgcttaatggagttccgtgcttctaagcagacctagacaaagcagacaaagagcaggacagagtgcaaagaagatgtgaggtttttatcctgggaggactgagcccatggtaaccaattttatggctcttttgatttgggtccatggatatctctgtgtgtgcgtgtgtgtgagtgtgtgttgagaaggaattaatccaaaaatatagatgaagaaagctgcgactctgatgtgaagccgagttgcataatcagttctgaaggcagagaaaaggtaatagatgtttacattacaatctggctcctactggaagagctgccaaatgatttaaatagtaacaaagattactattccagtgatttgttgcccccaacgatacatacagagaagaattcaccccagtaattttttctttggatggccttaattaaacatcacactgtacaaaatatttatggctttcagactacttaaaatcttaaactagacaccactttaaaaggtagaattgaaggacttactccattactgacatatgaaacttgatgtctggtaaacaggatgcattacaaagaaactcaaaatcccttttaacttttggatgttttatgactaatattaagataaatttttaggtagaataacatatagccatgaaaaagaatgacatatagctctcttcactgatttgtcatctttcctggaatcactccagagcacatctgggtctcatgtaaaatgatcaccacaacgtaggaggtctctacaggcaaggaatgtcggcctccttccctagccacaggttcatcaaaagccctctaatgggcctttgctgagtaaacaaagcaggacacagatcatatgatgtatgaaccccgttattcaaaattgtcaggtctaagccgggcacagtggctcatgcctgtaatcccagtacttcgggaggcggaggcagccagattacttgaggtcaggagttccagaccagcctggtcaacatggtgaaaccccgtctctactaaaaatacaaaaattagccaggcatggtggcgcacgcctgtactcccagctactcaggaggctgaggcagaattgcttgaacccaagagggggtggttgcagtgagctgagatcatgccactgcactccagcctgggcaacagagactctgtctccaaaaaaaaaaaaaaaatcaggtctaaatatatgtgaataaaagcagcaggagggaattggaaataggtttaccaaagtttaaaaaggaattgtctctgggtggcaaaattgggtgggtttcttttttttaactttccttttatatttttctgcaatgtttgaatttttctaccccaggtatgtactatttttataaattaagaaaagaaattttcaaaacagaagcctagggtgatgaaaagaactgtggcctatgcatcaagatacttgggttccccgacagaaataaagagctgcggacattggataagacacttttcactactctggaccttaaaagttgccattagagcagagtttctcaactgcagcattcctgacattttgaatcaaataattctttgcggccaggcgtggtggctcaggcctgtaatcccagcactttgggaggctgaagcgggcagatcacctgaggtcagaagtttgaaactagcctggccaacgtggtgaaacccgtctctataaaaatacaaagattagccaggcatggtgacaggtgcctgtaatcccagctactaaggagtctgaggtgagagaatcgcttgaacctggaaggtggaggttgcagtgagccaagattccgccattgcactccagcctgggtgacagagcaagaatccgtctcaaaaaaataaataaataaaaaataataattctttgctgtgggagctgccctgtgcacaacaggatgtttatttagccagtattcctgccctctacccacgagagactgctctcccataccatcctgccccaaattgtaacaatcaaaaaaatgtctccagacattgccaaaactcctctggggagcaaaattgccccccattggagcaattttaagtttcccctccacttcgtggtctgtaagtttcttccttgctgaaaacctttgttaatttttagaagctgtatttaaagtctgtggttttaggcccaatgattcccaggttagtaactacagtgtactgcagacttatcaatattttcatcacactagagaaaaagatgaaatagaaatgaagaaaatcaagaaataaaactactaattttcagagaaaactttagaacacatggcacagatgtgaaactaaaagaatccaaacagacacagtggtcattaaaaaaaatgaataaataataactctagcttttgacagctccgccttttgttaacgtaactgaaatactgtagaatgttctattgctttctagtttaaaatgaacttatagcactagcaaagccaacagagtagtttgtgtgtactgccatatttttatctttttaaaaaaagcttagtgttttctctttgcttcataagaaatacaagtatagccaggcacagtagctcatgcctgtagtgtcaacactttgagaggccgagacaggagggttgctttagcccaggagttcgacaccagcctggggaacatgctgagactctgtctctagaaaaaataacaaattagctgggcgtgatggtgcacacctgtagttctagctactcaggagggtgaagcagaaggattgctttagcccaggaggtcaagtttgcagagagctgtgatcataccactgcactccagcctgggtaacagagacaccatctcaaaaaaaaaaaagaaaaaagaaatacaatgatatcttcctatttttccaaaaaggatattttactcttctggactaacaataccacaatctcataaaaggaaacaaattacccatgtctttattatctttctaaatggtgtcttgtcattttattaacaagaactccctaatatttgatgctaccatacttctgaattaaaattatttatgcttgtgttaatgatttgctactctaagatcctgacagcttttgaattaaaaagaatgactaaaaaagattcaatgttgccttagattcataactctgaaaatcagtagttcatccatataaagaaagccatctagtaaccagaatgtttccataacatcaacacgctacagctggcacatactgagtgttcaacaaatgtggggtaccattatcgttattcacaatcatgccagaaaataatgttgtaccaaattattggctagtactggcttttatagcaactaaaaggcactaagtatgaaagggcagcctatcacttaatagattgatattctgagttctttcacaaataaaccataaatcattatcttaaactgcctgaccatcattctaacatccatgtctttccatgtgttcagttaggttcaaattgcgtcaccctgcccaatactcttccatcgccagctcccctttaaacctttcgtttataactgtggatactgtcgcagctactaggaagtaacccaagctagctggtgtatacagctgtccaatccttgaggtgggctcaactagcatggtagtccagcaaactgatggtgcaagaagccaatgtggccctcctccgcagagacagccaagggaaggggtcccaccacatcacaggagtcattctctcccagtcttcattggaaagtgcactgggctaggaattaggactccgggattctaatcccaggttttttaaataacataatagatccaaggtaggacaacacctcctacccctgatcttctagaaaggtgaaatctgaggtactttctagatttaaaattctttgagcgtttccttaaaccagattttacaattaagtttatttaaaaaaaaaaaaagagcccttttgactgactgaagggaaatgaattgaatagcaactgtacaacaggaagaatttctcttatttttcagcagataccaaatagatgggaagtcaaggtcaattttatcttttgagaggtgggttacaggagatcacaaattgagtgaggcattacaaagtgcagtgccatactacagcttaagtctctaagtcagggctgccataccatacttaagtctcgaagtcagggctgtctaggttctgacatggctttcagaaataacattttcaaaacaaataattatgaagtgattaatgtggccaagatcgcttcaccaatacctttgtggatatctttgtttcctattgcctgaatcgtgaatcttgtttcctatggcctcaatcccccaccctcaatcctgaatcttgacaaattaggataaatatactgtatggcctcccaatcatttatgattgattggcttcaggactttaagtcatcttgctaatcctgagtgatttaatagccaacacctgaagaaatgaactcatgtactcaaattagcccatcacctacgtggctatctctaggacaaaaaataaaagcaaaagattagtccatttactgtgatgtctttacatatttgtaaagaaacagagccagaacacagggtgaaaaactcgcaaagaggaagaaagcacaagggggaaaatctacttatgcaaattctaaagagatctataaaattgcaatctgagaatgttattattaagctaagcctcttagtatagaaatacccaaaactctcaaactgggcagctaacggagagttagtaagtgccaaaaagacttccttctttcccttattcatcacaggcaatatagaatcacttgctcaatatgataatatgacttttgtcaatgcatgttcaaatcagatcaaggattggctgctgatgatgtcatatccaatggttaatccccagtgaatgcagttttaatatcacatgcatcaacatgccatttacatagcaaagtattatattaagtgtaacaataaatgagtggtgcagaaaaaaagcagctattaggaaaaggctaggtaccactgaaaaggaggtggtagcggggagcaaaggagtttcttctttttcttttttaattactaaatggaactaggtcatcaaacaatacacatgtctaaaaagatcagaaaatgaatattgaaattcaagtgacctaggatattctagtactagaaatataaaaatggttgccttcaatgaaaaatatccaataatcaagcagagatatttgtaggggtttttgtatgtgctaagggaacaagtaatacaattaaagtcattcaaagatagagaaattggcagccactgcttttctggacaggacaacttacttatctttagcagggaaaagtggccaagtcaaattgtgacttgaagccttataataaattttaaagtgtcaaagggcagttaagatggtactgagggatgaaagcaaagtcacgcaaagcagaacaatgagacagaagaacttaggaagggaaccttgaaatacggctttctgctatgagaatattgattaagaaatgtccgtgcatatgaagaaagcttcttccacaaatgagccatgccaactcactcggtcattttgggaggacacaagtcatcattcgtcataatgattctgaaaactgctctcacactaccttattaaggcctgtatttcccatctagaggaagtgttgggctttcacactgatatgactataaacttagcagaaattcttctcactataaaacccacgcgagctattgaagaattcttcaagtcatacatttgttctcagtgactgagtggtaacactaattatattgcaaaatggctgttcctaaattattttagcctttaaaaaaatccaaggccttcctgaactgggctctgacacaaactgcccccacctcttccctcctcagcgagtgttctagagggggccaaacgaagatgcgtgtgattaggaagctaggccatcagtgtgcacaagtttgggtgaccgagtctgcaggtggcagctacgagttatggtggacaagctttatgccaaggatattagagacagaaacagaccaaagcttcgaaggcgcccatccccacacacggggatcgcctgtcacatcacatcaaccttgcttgtctcagagggaagaccattgaaaagttaaaagggaaaagagttcagggataaagacgttaaaccaaaggggggtccctgaatctcggtgacgggggatgggcaccaggctaggtctcggcgagtccgtgaacccgtgcatgtacatactgcttaggagctgattcacagctttactaaggctccgtggagcccctaaacgttaaatgatgctgattcgagaagaaaacgcaccagcggcactgtgtctggcttgggcagcctcaccaggtgcaggagatcaagctttccagttccaatcctctcccgagctccttgcgtagggtcaaggatgccctctcttctaggagcggattaacagggcaaagtgggaaaaagagcgaaagaaatgtagagatgccaccttggtgggcaaatctgagatgcctcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtgggggcggggggacgctgaccggctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggctgcccacgagacagcacctaaatacagggtccaaatccacccccaccccatcctctcgcccctccttatcccttccaacccttcttactcgactagagccggcatccaagtcggaccggcgcgtccggaactaggtactgatcgccgcaccggagcccgaggacgctcaccgtgccgcctccccgcgggagccccgggagcggcccatcacctctgcagcctcgccaggagaagaaaagttcccacgtctctaccaggagaagcccgaagctcctgcgggagaagcctgaagctgctgctggagaagcggcagctgaggcaggactcccgatgtttgcccgcagccgcgcgcgcagtcggtgcgccccgtccagggcggcgcgcagctagcagtgcggagccgagcccagctagcgcgctgaccaggaggggccgggcccgccgcggaacgcgctgattggccgggccgcccggctgctcctgtccctgcctggccccgcggtccacgtgggccggccttctccccgccccgcacccctgctcaggcggcgcgcccccactgccggcctccaggcgcctctcccgagcgcctcgctgtggccaccactccgcaggtgctgagcaaaaggtattcttcctgaatacctgagagtcgcgttgagctccacataaggaagacggatttagggttcggctctcactcgaaaccattctccacgcaggacccaaagcggtttgcaagcaggatttcttagccaccccgtgcagtagcacattcatgaactaatctggcttcgcgtgtaatgtgcttgtatgagagaggagaaaactcggcccacgtatgaatacctaaatacttttcttttttaatgtataaaatacagctggggccgggctcggttgctcacgcctgtaatcccagcactttgggaggctgaggcgggtggatcatgaggtcgggagatcgagaccatcctgactaacacggtgaaaccccgtctctactaaaaatacaaaaattagccaggcgtggtggcgggtgcttgtagtcccagctactcgggaggctgaggcaggagaatggcgtgaaccggggaggcggagcttgcagtgagccgagatcgcaccactgcactccagcctggtcgacagagcgagacttcgtctcaaaaaaaaaaaaaaaaaaaaaaaaaattcagctaagacttctttgactccctcctcccaccccattcctagtcatgccctccactcttccgcaagtgaagtaactgataatcagtgtcacttaatggtattcattttactgggattagttcatctgatctctattttatagatgagataactgaagcacagagaagttaaatcgtttactgaagattacacaggtaactagtaaatccatgctctttagtatgcaaagcatggcgtcgtagagcggtcccttgagaacactttagaactgcagactttcaggccccaccccagaagtagaatcttcattttaacaagatgcccaagtggctggtgcatgcataaagttagaaaacgttgctctgtaccactatgctgctcactgtcattggcttggcttatcatcttctggtccttttactctgcattgacatacaattatgtgccatcctgcccctgctgcactccaaagtatgttcacccttctctgactctaccccttgaactaacgtatggcaggccttctgcttctgttccccgtaccacacataccatagcacattttacttgttaaacagtttcaatctcttactctcttattattaaaatgggggttctacattcaaaggcaatttgttatcaagatgtcaccagtttaagagagaattcaagctttggagataggcgcttgatctttgagatttcctttaaagactagcattgaagttctgtgacggccaaaggggagatccaagcaaaacctgaaatagcatgccaggagattccagagctctttctcaacagcattcattcattcattcactcactcagcaaaactgagggcctactctgtgtcaggcgctgtaacaagtgctggtacatagagaaggaaacacaacagtgaaaagttcctgagttcatggaacttatcttctagtagggagagatgggcaattaacatgacaaataagtgaattacagagtttgatagaaagtggtcagtgttatagagagaaagaaagtaacagaaaagaaggtgagtactggggagatggtggttttaagaacagtagttaggctagttcccactgagaaggtaatatctgaaccaagacttggaagaagtgagggagcaagtcatttagaagaacaagtccacattcatttgttcaccagatattcgttgcttccacactgtgtgacaaacatggttctggcaaagatctgcgtgtttacttaagccctgttttccatgtctccaattttcctgcactgggggtttcttgtcctggtgaggaaaaccaaaacgtaagcaactgtgtttggctcaacctaataccatgttcttccatcctggatgttcagtactgttagaggttcaaatttgtctccctaaaatttatatgtttaagtcataacccccagtaccacagaatgtgacattatttggagatagggtctttatggaattaaattaaatgaggtctttagaatgagcccgaatccagtatgactgtgtccttataaaatggggaaatttggagacagacatgcacacaggaagaacaccatgtagaaatcaggacagagatggagtgatacttccacaagctaaggaatgccaaagattgccagcaaaccacctagggagaagagaggcgtgtaacaaattctttgcagccctcagaaggaaccaaccctgctaacaccttaaccttggacttctagcctccagaactgtaagacaagaaatttctgttgtttaagccacctagtttgtggtatttgtatggcagccctagcaaattcatacaagcataaaagtgtgtttgtttctaaagtaagatagtacagttaagggactcatctgtaagtttccaatgacctgatgtctcttgtgcagtagcaagaagccagaatgatctgataaattgagatttactaaccaaatcaccacaaaaaaggcaagctatattaaaaaaaaaaaaaagaaatagccactaagccccaattatccaattgtttcctcattcagctatttatcaagcgcctgctgtgagccaggctctaggatatggtgacaaacaaggcacatgtgagttgcgtgtattcttgtggggaaggttggacagtaaataattcaacaaatatatgaataaggtcatttcagagcacaataagtgctaaaagaaaataaaagaaggctagagcattagaaggatatgaggatgggtttaatttagattggctgcctagagaaggtccctatgaggtagtgacgtttgagtcaagacctaactgacaaaaagccatccaagcgaatatctgggcaaaaattgttccaggcagagacagtagttcctcttacaagaaaacattcctgtcattcattcggtaacattctttctctctctctttgcgacccattttgcatcctttgaggttgtgtaaaatcaatcaacatctgtttcctaaaaatggggtcaaatgatttattttcttatgtaagaacctgtgaaggtcacgccaacggtattttgcacacaccacacattcacaaaacacccctggatgtgcctctgtatttgtaggtagtgacaccacgtgacttggacattgtgtttactttcctcatttgtataacatccagaacactactggcatgtcctggtgcttaatcaatacgtgctgatgactgactatgcctgaaaggaacgttctgactctcctgggcctgtttaaaaaatcctcttgtttctagcgaagcttcagttttaaaaatttgcaacacaattttgcacttagtaatttttctgaggagactaataagaatgatagctgacttaattggaggcttgtgtgtggctcactatactatgtacttcacacggattatcatctttataatccatgtaaatataagtaaaggtaaatacaaggtaaattctcttattataatctccatgttacagatgagaaaactgacactccaaaaaggctaatatgcccgtggttgaaaccacctttaaatggccgacttatgccttgaaacagtctcgcttactgtcagctctgtgttcgagtggttgaacagtgaaacaagtgaagaaagaacagagaaaaagcaaaaagcctctgtctgggtacacatggacatactatgtagaataataggcattgaagactacaaaatgtgggagggtgggagcggggtgagggctaaaaaattccccgttgggtacagtgttcactattcaagtgatgggtacacgataagcccagacttcaccaccatgcaacatgtccacgtaagaaacctgcccttgtgcctcctaaatatataaaaataaatttaaatgtttttaaagcatctgtctattcctttacatttgtctttgaaattttcaaagcactgttttctaacttttttttatttaccccagctttctagctttctagtacacttttctagcaggatatttgctttgttttcccttgcttcaaactaggaactgcagggactttataaatgaaataactgatacatataatttttgtttgtttgttttcagcctgtctgttgttcaacaccctctaaggaaatgtaagtccagcttcttagcgctcagcctactttgccagacatcctatctcatacattgacagtgtcccaacactaaggggtccctccccttattccaatagtaaagaacatcacgtcccttgccagaccaaatgctataaacaattttgcaataccagctccggcccgctttacacagatactaatagatcctcctgcctgagagtgaacatctaaaaatggcttcggccagtctttgtgaataactttctattctcgtggcttccccacagtcctgatcagggaaaaagcccagagaacttgcaacagtgaaatgatgtgaggcttctcttgttgcatcctggattccctcaccttgcccaggaagtgggtagccgttttagccgtaaaatgacttcctgccttggatggcttggtcagacttgttttagacttctggaactcagacaaggtgtctggatatttgctttggaaggctcgggtgggtttcactatcattccctttgctgaccacaactgcttcaataatttacaccctggaaaagatcagcacttcagggcaaattagcataagaaggatttatgaaaccacagtgggaggtcacttttagaaatcatacaagagctgttgcacagagcaatacaagctaggttccaagcagggacaaccacagatagaatcatcaaagaaataatgctccttttggtaccctctcttctgtccatcccttccactccagcatctcccaatatggtcgtatagcactcagctacacagaaggctggtgatgtcattcattactttattttcattgattcttttgctaatttgtttaaacattatgtttgttaaagagatatttgtacacccacattatagcaacattactttttggaaagaagcaacccaagtgtccatcaatagatgaacaaataaaatgtgatatatacatgaatgcaatggaatgtaattcaacctttaaaaggagggctattctgacacatgatgcaaaaatggatgaaccttggagacatcatgctaagtgagatatgccattcacaaaaagacaaatactgtatgatttcatttatgtgaggtactgagactagtcaaatgtataaagacagaaagtggaatcatgtgactcatgcctataatcccagcacttcaggaagccaatgcaggaggatcgcttgagccctggagttctaaactagcctgggtaacatagtgggaccccatctctacagaaaacaatttaaaaacttagccaggcatggcggtgctcatctatagttccagctacttgggaggctgaggtgggagtattgtttgagcccaggaggtcgaggctgcagtgagccatgatcatgctactgtactacagcctgggtgacagtgagaccttgtctcaaaaaagaaaaaagaaagtataatggtggttgccaggggctagagcaggggtgtccaatcttggcttccctgggccacattggaaaaagaagaattgtcttgggccacccataaaatacactaacactaatgatagctgatggacttttttaaaaaatcacagaaacatctcataatgttttaagaaagttaacaaatttgtgttgggccacattcaaagccatcctgcggcccacaggccatgggttggatgagtttggattagaggaagggaagaatggaaagttagtgtttaatgggtatagtttccattttgcaagatgaagagttcagggatggatgaagtgacggtaacccaatagtttgaatgtacttaatggcactgaactgtacacttaaaaatcattaagctggtacattttattacaaagtgcatttcaccacaatttaaaataacttttaaaaactaatggaagttcttgtaaatgtctaaaatatcaaatttttaaagctgaaaatggagatgtgattccatttgtatcataaattaccaaacttagactaaacatattttggtcaaaaaaattttttaattttatttgcatgtgctagatattgtatgaggtacttgagatgcagttgtaaaagaaaaatccataatcctagacctcaaagaacttacaaatatataccacaatgacctggatgagactctttattcagctcataccttcctcctccaacaaatatttaatgagtgccaactatgtgccagtctctctgctacctacgagcccacattagtgaacaaagtagatacagattgcactctcacaggactgccagtctagcaaggaaaaaagataataaacaaaaaattattgtttccctaagccagggtgtggtggcctacgcctgtaatcccagcaatatgggaggccgaggcgggcagatcacttgaggtcaggagtttgagactagcctggccaacatgatgaaaccccatctctattttaaaaatacaaaaattagccaggcatggtggtgcgtgcctgtagtcccagttactcagcaggctgaggcaggagaatcccttgaacccaggaagcagaggttgcagtgagtcaagattgagccactgcattccagcctgggcaacagagtgagactccatctcaagaaaaaaaaaaaaaaagaaagaaagaaattattttttctctaacccctatctgctccatcaaaatttactggttctctgtaccttcaccttatagactgtaacaggtgaccgtatcaaatctgctaatcatttccagatataaataaagtttctaactgttatccctcccacatttgtagcatgtctgtgtggtaacacaagaaacaatatattaacccattattctccaaaatatggtttttattccacagatgggttgcaaaatgactttacctgaaatgcaaaagaattttttaatagttttcattgttttaatgtacatcaggaaaaagttaagtgagaatatcaaacctgtggtttcatggatattgctatttggaatgaggctaaattcaaaggtgattccaattaaagaaaaatatatggataataatttaagtaaatggcaaaattggaaaggtggggcataacacaatcagaagggggctgagatttatgaaaataggagtgactccattggcagaaatggccaatgagaatgctattctaaagaaacacaggatttgcagtgccttcatattccaccatgggcctagcctgattccatccttaatgttctcttctctctctagctctgcaaccctaaggggcagccactctgcctcacactgaatgatgatgtatactgagaatttcttccttccccgttcaccaactcagcttcccctgaaacgactcaatctagtgaggatggtggcaaagatgggctgacagttaaatatctttggaacttgggttctgagcgtgctgagtttgtgtcttgcaagttgatattgtgacaaaataaaggtggaaagagaaaccatgctggtggtcattacctgtcctgtctaatctcctagaattctagtgcaaagttttggagaaaaccgaaaaataagagttgggttttattccagttttttttttctatctatcatattctaacacatgcaacaaaaaccacatgccatttgacttttatttttggacttgagttttttgcctctaccttggaacattattttgtaaaaggtcatgaatgttaaagtaggacttaagaggcttcacttggacaactgacatttgaaatactctcaatcagggactttctcatcagggaagctaaatctatccatagacctcaaatcccatggatttcaagctggatgcagtactagacatttgcctgcctgccaagcatctcccgagaaagcgtcctagccaaaacccttgattgcaggtgacagaaacccaacacaactggcataggcaaaaagggacagctatctgctcacataactgagaagttccagaagtgtggttggatattagtactcagggaaggaatgtatgtgtatgtataatttccccatctcttggcttttttttttctttttttattgttggcctcattctcttatcaagaagaggctacatccaaaaagcagaggaaatgttattcaataatcccaagctattcccttccagccacgtgaccctaaaggcaacaagaattctcctctgacttcagttttttaaaaatctagcccagcttgtttcacaagtctatgtccatgcccaggttgggcaagggggggcggtggtgaatggcagccccactatcattacatggttataaattcctagaaaagaaggaacgttggacaatgctcactagtgtccattgcggaaaactgccctacccactgccctgactgaacaactaaccatgttccgtattacccaacccacgtggcaacagctaaataaattatgtttgaggtcctaagccaggtacaattcatctatccagttcctctgatttgtgtgacctggctggaaaagtggcatgagccaaacagacttttcttcctggaatttgaaaatgggggccctagagactgagtcatttggttggggcagttgaactaaatgtcataataaagtagaagacatgacagacaattatggacgatgtgcaattgaagctatgaagaagccagtctacagagttggagatctgagaccacagcaactctaaaagagatattcaggaagtagctgactcggtttactgggagcttcagtgcttgaaaattttgtgtttgagtagaatatctaggtaagaaaaggctaacatatttagtgattttacccacattgtcttattttctctttgtagtaactccattagaagttatttattttctccatttttaccaatgaataaactgaggctcagagaacatatgtgatgtttcttagtgtgacttgtttcaagctagaaagtctctaagtcaagaatgcttttcccctactccaagttgcctcagaatcttgagtggtagagatctgggctggagacgtggatttggaaatcatctgcttagatgcttagaggtactcattgcagccacagaggggaatgaggctgtcaagtgaaagtacacagttagggaattactgtgatagcctcatctattgggcactcactctgtgcaaggctctacacattatatactagtaatgactaattgtatgtgttgaattaactgggccacagcatgcccagatatctggttaaacataatgtctgggtatgtctgtgaaggtatttctgaaagagattgatatctgaataggtaaactaagtaaaaaacagacggccctccccaacgagagagggcattacccaattcattgagtccctgaatagaacaaaaaggcagaaaaagtttgaattcactctctggctgactgtttgagctgggacatcgatattctcctgccttcagcactcctggttctcaggtttttagatttggattggaatctacaccatcagctatagagctctcagtgttttgagctacacccctggctttcctgagtctccagcttgcagatggcagatcatggagtctcagcttctgtaattgcatgagccaattaccttaaaaaaatctcaggtttgttatatatataaataatgtatatttatatataatatatatttataatgtatatataatatatatttataatgtatatttatataatatatatttataaataatgtatatttatatataatgtatatttatatttacttttatataatttgtatttaaatttatttttgtataatttatatttatttatacaagctatacttataatttatatatataatttatattcatatttatttctatatatatcctattggttctgtttctctgaagaacgctgactactatagtattctatcaacagaagcaagattgaggtagagtttacagaggttcacagtgaccatgcttctaggtgtcatgagatggaaggaacctcaagcagtttctgttctaggatttggtcattttcctgccatgctcatgttccattaccctcgtagtatgcctggtctgaaaaattcaatctgccttaaccatttgaatctctaaacaaaccttgcaaattaatacaagtctcaaggaccaggctgaagagaacgagacgggacctggagaatataaaaaagcgggtatcagctgggcgccatagctcatgcctgtattctcaacattttgggaggccaaggcaagaggatcgcttgaggccagtaattgggaagaccagcctgggaaaaataatgagaccctgtcttaacaagaaatttaaaaattagccgggcgtcatggcaggcacctgtagttccagctactcaggaggctaaagcaggagggtaagtttagcccaggagtttgaggctgccgtgagctatgattgggcaactgtagtctagcctggatgacagagtgagaccttatctctttaaaaaaaaaaaaaaagtgggtatcaggttgaatatggcgacaccccaaagtgacactcccacccagtcttgataaacaaggttccaaattgagttaattttgcccctagcaaattcaaaacattctaacattttcataagattcttaacaaaaacaaaaaagtaatgtgtgattcattatgtcagcattttattttttaaggttattagaacacactgacatacattttaaataataaataaatgcactgagatgattttttaaatactcccttgtacttccttttactccatgccccttctttccttcttgcactcaacaaattgcagcagctaaacagtatgcttacagccctagggaaaaaaataccaaagcaaaactctgagaacaaagagacaaagccatggcttatgagtttcaaaataggctgctgaaacccacaccagagataatagttttgaaagggtttctgagccccagaagccaggcttttgaatatcaaaaagccacagcctaccctgaacaatagattggggaaaatagcctcccctctagctttagactgggtacagactccatgggctgagtgcaagagaagacagtttgaagagaagaaagtcaggtaggggtgagcgttacctgggagaccactgtggacaaatctcccttagccttcagcccttgttcatgagaccagcaacagaggtctgacctaggaagaaatgctcagggttctcaacctcagcattattgacattttggccagataattctttactgtgggaggcttccctgtgcactgtagggtgtttagcagtatccctggtctcttcccactagacaccaatagcatttcacagttgggacaagcaaaaatagctccaaacattgccaaacattcactgggggtggggatggggctcaaaactagccccagttgggaatcaatgagacatagatacatattacacacatacatgtatatctttctaataaaaaagttatgtgctttatacagaaaacttcaaaaatacagaaaattcccctcaaaataaaaagtcaaccatgcttcatccactcagagctaatcattaatgttttatctatttccgttttttcctatatattgtatttcaacaaactaaaagttggggttatataataaaatactgtttcatattctgcaattttttgcagattacatgtcgtgaaacttcatagaggtatagttttccttactatagccataacataatctattttgccaatctgttattgttggatatttagattactcccaacattgcaccatcattggtaatgttttgatgaatatcttcatatatttctttgattgttttattacaaaaaatttctaatgttggggtttggatctgtaatatttactatctcagtggtgtaagtcatagttttctgacttaacacacacattttatttctccagtgcttttaactttccacagtactttccaccttaccaaacatgcagggcagctaccaattgttcccattttactgatgagaaaactgatgtcatagaagttagacgacttgcctatggcaacataattattttacaagaatgctaaaacccatcttgcttgagtcctgggctttttgctattagtgcttactttggcagcatgtataccaccaaaattgacataatccagagaaagaagattagtatagtatgccccctactcacaaatgacatgcaaatttgtgagcactgtggtgttaagaaaattttaaattatgagtcctatttctaagtacaattttctataaatttcagaggtcccaaaatgtaatcaaagctatggacctcagatgggtgaatctaccagttcccaggaaaaattccacaaccaatcttgtctccaaatgctgatttggagggttactatctaaagtgctaattccaacatctgcttctttcttatccctaaagccaaattaagttggcacagtctgtttttacttccagcttccctctaatacagatttattaccaattaatttcttatcgaggaaaaacaatcccatcataagtactttagataatgacacctaagtattttatattgctttaagtctgaacagttagaatagagtgcatccaatgttcattacctcttaatgcttgcattcttttttcatgttttgattcaccaaaaaaaaaaaaagaaagaaagaaaatgctacccactgcttcgactattttttaagtttaatgagattaaataaattctgcggagcggggagaagagtacagcttactaatgttttaagtggtttatggaaatattcctaccatgggcacaattttaaaccaaagccagcttctgcagtgctattgaaggctaatgaatgccttaataacacacagaggaaaatgtgatgagttgattagatacagacatattctagacctctgaaatatagttagaaaaacaactcaattgtactcagagacagaactcatgacaaagaattatcttaacttcctagtgatccatttcaccacccattaataataagtgatcttcttggcagtgtatgctgaggtaattgacactgatttgaggtttagactttaaagctccagataaaccttgaaccaattcctctcagttataataaaacttggaaaatttagaacatcatataacttttctatttcctagaacctagttgttgccaatccttctttcagttaattaaaattcttttgcagggatatactttttaaaaatgaattgttcgacatactcttctggaaattttatttttcttttcccagttgcctatgtagtctttggaatggttctgtatgtctgtgtgtgtctgtgtgtgtgtgtgtgtgtgtttgtgtgtgtgtgtaagattgttactttcaaatagacttgctttctagtcattagacatccaattatagaagtgtatattacataaagctgaaataaacagtgttttttagagtctggcaaattccaatagggttgttatttgatctttggagtcttgagcaatgggatacaggagatgtcacactgcttggacaaagaaggcaaatatcagataacagaggccatctgaacacataggcagttagggagctctcaaagaatgtgaaggacaagtagacagaaaaaaacatgcagagcaacagtaaaaagttgttttaaaaaaactcatagatggaacaggcatggcagctcatgcctataatcccagcactttgggaggctgaggtgggcagatcacttgaggtcaggagttctagactacgctggccaacaggaagaaacctcagctctactgaaaaaaagaaaaactacaaaaaattagctgggcttgggggtgggcacctgtggttccagctactcaggaggctgaggcaggagaatcgcttgaacctgggagacagaggctgcagtgagccaagaccacaccactgcactccagcctgggcgaaagagtgagactccgtctcaaaaaaaaagatacattctccaacatagatgagtcttgaaaacgttttgctcaatgaaataagccaatcacaaaggactacatattgtgtgatttcatttctatgaaatatccagaataagcaaatctacagacagaggaaagacactagcagccagcagatggggaaaggagactgaagagtgactgcttattacagtttcttaatatacatagggtttctttttggggtgaagacaattttctaaaattaagtagagatgatggctgcacaactctgtcaatatattgaagccaatgtactgtacactttaaagggggtgaattttatggtatgtgaattatatctcagtaaagttgttttttaaaaaaaggcagagacagaattaaaaagttagaataaaagaaccaagagcctgagacagacataggattccaacattagaagaagcttttttctcactggtttaagttggctaaagaggtttccagacaactttgatgtgactaattggaaattttttaaaaagcaagttaaaatcaacatttggcttgtgccagccagattcagcgaatattgtccaggcacctactatgcactagccacctaaaatatgaggagatcatggcccttttggagtgataagcttttaactaaaaagtaaaatattttcggctgggcacagtggctcatgcctgtaatcccagcacttcgggaggccaacgtgggaggatcagtcgaacccaggagtttgagaccagcctgggcaacataatgagatcctgcctctagaaaaaattttaaaattatgcatagagggagaatcactcgagtccaggaggtctaggctacagtgagctgtgatcatgccagtgagctccagcctgtgcaacagagtgagattctgtctcagaaaaaaaaaaaaaaacctagaatattttttgaaagaaaggaagtacacatactaagaatgagttttttaagtgatgaaattatgagtattttttccagtagtctagaatataatgacttttgtattataaagaagaggaaatacatttttaaaggaaaaagtattacagtgtgatataataaatgctctatgaaagcacacaggaaggagaaagaagttgggcctgaggaaggaaggtcagagaaagcctgacaggcaattatttgatattaaccccaagagatgggaatcataggcttgaaaaggactgaggatgttcctctatccttcaagccccaaccctgaccccagcccctctccagggaactgagaggctgcagctgcatgctcaggtccagggaaatgtcttcccttctctgtggcctccacccatgatcagggcctcccttttgcttcagtaagggcaggaagactggtaacaaataaaaagtcattaggaaggagttcacttctgggtttgggccagtgggtaccacttcagactcttattgttgccaaagcacataatatggcaagacaattgctctatcgctgcagaagttagtgtcaggggctttactattaatgcccacacagcatgtgaccaacaggtagagaaaagcctctgtcagttcaattactctgaaggagagagggtcacctttccaaagctgatgcagagttcatttttcacggtgagccgtgttcatcacggcagctctgatcccatcctcctttgcagttcttgtggttatcccagccttctctgatggaacaaaagaagatggcaaaaactacactggctcaaacccatgggccatcccctcatacattctgagtatgtcacagggaggaagtctactatgataacatagcacaggttttggagttaggcatcaggatttgaatcctggctcaattgactcagcagctaactggctttgggaaagttattccagctctctggtgcttcctgtcttcctctataaggtgggaatagtattaaaacttccctcatagggtggatgaaaaatatacatacaatcacctggcaccaaaggtactgaacaaatttaaagtcacttttatcagtttttgggggtttttttgtgtgtgtatgtgtgagatggagtctcagtctgtcatcaggctgaagtgtagtggcacgatcttggctcaccacaacctccacctcccgggctcaagcaattctcctgcctcagcctcctgagtagttgggactgcaggtgtgtgccaccacgcccagctaatttttgtatttttagtagagacagggtttcaccatgttggccaggatggtctcaatctcttgagctcatgatccacccacctcagcctcccaaagtgctgggattacagacgtgagccatcgcgcccggccttattagtttttctaatgagagacttcctatagcaatgtctatacaagtttaacaacattaccaatgaattctatcacttttcttccttatttagctaatgagtatatatttgtgtacatatatacaatatacataaatatatacatatatatgtgtgtgtatatatatattagtccattctcacactgctgtaaagaactacctgagactgggtaattcataaagaaaaagggtttaattaactcacagtcctgcaagctgtacaggaagcatggctggaaggcctcaggaaacttaaaatcatggtggaagatgaaggtgaagcaattacctcttaccatggcagaggaggaaagggagagtgtgtgaagggggaggtgttatacacttttaaaccagatctagtgagaactcactcactatcatgagaacagcaaggggtaaatctgccctcatgatttagacacctcccatcagatccctcccccaacactgagaagtacaacaggacatgagatttgggtgaggacatagagccaagccatatcaacatacataactatatatatatatgttatctcttttgttagaattatcttggttgcaaataacagaaattcaatgttaccggcttagagactctcccaaaaataagagaatatttattgattcacatatatgaaaacccagggcagtttagtttcaagcacagccatatcctgttacccaaataataccatcacaaactggtctctcttcaggttttaatctttgtttttctgtgtggttaaaatgagttaacatacataacatgcttagaatactgcttagctcataataagcactctataaatatttgctactattatttcatttaatcctccccaccatcctatgaagcatgtactgttattattctatttttacagatacagaaactgaggtgatacagctattcaataatggagctcggtcaggcagtctgattcagaaggcttttcttgaccaattctccaaccatctcctcactgggctagaaaggaaggttgagccttgactggaaagggctaggaaacacaacccctaaaggacagattctttaaaaagaaagcattcaagcaagaaagcctgggccctttgcaccctgaagggtaggtaccatcctctcaaatccattttttttttctttttgaaagtgaaaataagtttctacttttacaattcatgcatgaatcctattaatccttcacaaaggcagctttaccccctcaaaaattccagagacagggcccggcatggtggctcacacctgtaatccttcgggaggccgatgcgggtggatcacttgaggtcaagagttccagaccagcctggccaacatggtgaaacctcatctctactaaaaatacaaaaattagctgggtgtggtggcaggcacctgtaatcccagctactcaggaggctgaggcaggagaatcacttgaatccaggaggcggaggttgtagtgagctgagatcgtgccattacactccagcctgggtgacagagcaaaaactccgtctcaaggaaaaaacaaaagaaaaaaatatccagagacaggaagtaattggaatatgggtccttgaattggttattctttgctgacaactccatctcccaactctaatctattttctgctcttgcctgtgcttctgcttggctctctgtcctctggagctgatggactgaacctctagattccctcacccctggtttctaattgggtttggccaatgaagtgtcttcttttgtggcttcaggcccacaggtggtgatagcttcccatgatttctaacccctaagggcttcaccgccccttcctggttttcttcactcaagccatgcctttgcaaagagcccctttgcatcattctcttccactaaaatcttagagtttgccatcagtttccaggcctacatcatggctgttgtgggcccttggcactcctgcttacatgacttccttcctctataaaaaagctattgaaaataaaaaataaaaaaagaacattttaaagctattgaaaattatattttatgattctgttgatataaagacatgtcatccagactggattataatcttttttttccaatttcaaaagaaattaaaatattccatgggccctaggcactgcgcctactgtgcctaatggagaggttggctccagttattttctacaggaggccattctaatggatgcatcctcttcaacccacaggcctaactgacagaaaatgaacaggagctccctggaaggtgggctactatcaagttaaaatcatgatccttggatcaaatttcccaaacagcctgtttccattacagtgagctcagcatccttgtccctaagtagatcctatttccaagtcacagctatgatgacaagataatagaaaaaaatggtgtatctactgttgaattaatgcctaattcatttactactcaccacattccagtgatgggaggcacaacgatcacatagttcattaataattctccatttcctctatgtaaatatatcactctatacctgggaaggagaggacattttccatatgttctctgctcagaaagatcctttttttttttttttaagaaagatcacatttttgctcccagttgaaatttgttttgtttttaaaggagatctgagaagtttttgaatgacgaatactgcctttaattggcaatttgttaagtatcgataatactgaaggttatatttaagattctatttgttcacccggccctcagtctgtggccgtctcatagaccaggcagaaagtaatagaaaatgtgaaattacaccgggaagaagacaatgctagacagcagaagtacttttaaatctaaaatcagcagttattgattttctgttggaggtaaacatctcatactctacccaaatgtgggactgatgctacttcagattgtttctttgcctttttagaaacttcatttctaattgcaagttaatgccgaatttaaatctctaagcccctgaatttttctgcacttcttcccagttggttctctgattgactggaggaatgaggaggttctgcaaaggacaagggaagctgagagtttgcccctcagtaccctaaatatcaaccataaaactaatgaactgtggcaactgaattgtctaagttcattccaaattatgtcttggtaaagttcatctttgttttcaattatcatcctggaatcataaatgtcgaatccagggtgcagcttctcagctctttgagtcttgtttgcattcttcttaccgttaagcctatgtagtgggtatgttgtggcccactgcactggatacccaaggcaatgggtacaagtcctcttcttaaaaatatcaacttcgttttaaaggaacaaatctgaaacagtctctgaaaaaaattgccgtgattcaatgaatctgcatttttgacatgttgctaaggatcgtgtttttaagtatatcctctttaactcttcataacccagttataaatctttttttcttcattctcttatgactacataacatttaccctgacaagtttataaagaatattgaggttgatacttgctggtcttagtagaaattaatcaaaatccatctgttcccttctcagcctggacattttcattacaactaaaccagggattataggattcttacatcttctttttttccctacacagttcagttgatttagaaacaatgattaaagctgcttactttaaggaagattgtttccaatcttcccttcttgcaaggcagagaaagatgaaagcgtctcgatcctgaaatatttatatctaagactggaaatctgtatcagaggcatgacgaatgattacaaccaaagacttttttattttaaagtcatatttcttatctttacactttcactttccttacaagtttaaggaaataaatgccaaattcattcactgccccccacctcaagtagatagattttctatcttcatttaattctaagtccagtgtgacataataaagagacatgcagagaaagattacctttctgacactaactatttatagggataaatatcagttatccttatgtggccttagaatgactgctttcaaaggaatggagaacacaactagggggaatgaatgtaagcctcccacaaggggataccttgatctgggattgaagaaatcttaagaattagaagtgattactagagagtaattctaggtttacccagcctcagacaggtgctctaattaactattctcattcttcttctttttttctatctagttttcatgctttttcctcctctcatgcccttataattgaggtaaaatgctcagatgagcattgacaaatgtatacacccatgcaaccacaccccagtcaggatctagaacattccgtactcaattttgggggagctgtttttaaaaatgagtattattacagtcctctgctagtaggaatgaactcctctctaaataccaggaaaaaaataaaataaaactgaaggactgtgagttggtcccctacggagccaaatgctgtttgaaaccaatctgtgtcatgggccttttaacaacataacaaaaagaggaactgatcttgaccagcaggcaaagggttggcgtcatggcccaaacatcagattagaaacacaatgattccctgggactggacactaaatcctggcagacaacgcagcctttcatcttctaaaatggataaattgaatgaagcaaggccaattctgggccaagctgttggatgagattttttttttaagttcctaactgttctacatagacattaaaacatccattacagcagacctagaaaccgtccttctgtccttgacatttcctccttcctcacttgttcctttgcaacaggaagccagctatttgccttagttcctagctctctgttcactgcacctcaggggtgcttccttttacggcaggatccccctagataaaaggaaaattataaacactcatccttagaaatttggaagggaatatatatacagcctaaggagtgcaaaaggctctgcacttcattcagctatcgctgctcagggactctaagtacaaaaataaagatgaactggctggaaagtataataaagggagctgaattacagggagttgtttttgttttttagcaagagttctgtactggcaagttttatcgtcactgtattgtgataccacagtggactgaaggatctctgaagccaggctatttgggttcaagtcctgaccctgccacacctctgatacatgacttggaacaaactatttatttttctgtgattttcttttcacttctgtaatgtggacagtaataatacctagctcaagggtcaatgaacttattctgtaaaacgccagatacgaaataccttaggctttgcaggccatgggctcagcagcaactgctcagctccatcttgtagcatgaagcagccacaggcaatatgtaagccaatgggtgtggacatgtcccaatcaaacttgctgaatagactctgacatttgaatctcatatcatattcacttgtcaagaaatatccttgttttgacctttttttcaaccacttaaaaatgtaaacaatattcttagctcacaggctgtacaaaaacaagtagtagccacatttggccattgggccatatcaagctggtcaactcctgacgtagtccgcaaggttgagtataacacatgtaaggctcttagataagtgcctgacgcaacataaggactacttccatgttgttatttattattattatctagcggaccatgatgaatgctatactctccagagatctggtatcagtattatttcccagaaagtcaaccttatgggcttctagttttgagaaaaagagatggaggtcctaagagagaaaatgatcttagtgtcttcctccaatatctaagaaagatatagtgaacactctccccagatatggatccaacatacagagtgtgccattgtatagatcttatcatttggggaatgattttttaaagccattgctgtccatttttgcacattaaatcccacaaagagatttatttacaacattaaatcatttctttgtgctgcctggctacatttttaactattgaaatattcatcacacactctaagaacctaatgccaagtgttttatgaccttttaaaggatggcttctttaaaaaatcaccttcaaatgtggatgtcagtttccaagtggggctaaggaagagcagcctattgtcaaatatcaaggagataaacaagagatcattgcccacaaaaataccaccagagatgggctgatcaaacagaaatgtacgtaatgtgtaaagctgtggattagggaggtagggatgggaagtgagcaggagtttggggcaaaatttgtttgctctttagaatgagaaacacactcaactgtccacagcaatggttctcaatagagggcaatttggggccctaggagacatttggcaatgtctgtacatttttgattgtcaggggttactgctggcatctagtggttagaggtcagagatgctgctaaacaacttgcaaagcacagcacagcctccacaagagggaattatctggcccaaaatggtcaatagtgccaaagtagaaaaatcttatagactcaggaactaccacggctgacccccacctcacgcctgactttattttgctgttacttcgaatttgctattacaggcatgtgtcaaacaactaaagataaacactagaaagcatccctcactatgttcctctgaaggatcacaattcaatttgaactctccatccacccactttttcaaaggcatcatgatggaaaaattgcaagattggtgttcatttaaactacacaaattaattcaattactctgaagaaaactggtaccagatcaccagattgctgagcaactgatgctaattttataattcaatttactaatgaggtaatgtgacaaatgtttaaaagctagtcatctgtagctagaaccaagtcatccaaggaagttcgtacctgctgtgtatttggatacaaatctctttgttcttgaccaaaatgaatctgttcaatttccttaagtaaataaagctctttagaccaacacaaggtgaaagaagaggtgaaaatgaacttccattcttttgcaaagaatcaaaatactaaataagcagaaaaaactaatgaaaagcttctgaatcaacttatggagagttaaaataattctgattaatcttaacttaaaattataagtacgctaattaattttgtatatttaacactgttttaaaactttgtcagtttaaaactttcgttttataatgaaattctatttattctatttaaattaaacttaaatatttaaacttaaaatgtagagtgctttacaattctatttaaattcatctatatttgtagagtgctttataatttatgaagtgcattcacatatattatctcacttgagctctaaaataattctgagaagcagggatgacacgtattattatccttgatttacagatggaaacacgggtttgaatacatcatataggtctttctggcttaacagaggactctactgatgctataatgttttacaaaattggattacgagggaatatggtacaaacaactgtttctcttctctattgctgagtaaacaacccgacactcagtgatttaaaacaacaaacattttgttgtgtttcacaacttagtggggcatgaattcaggcagagctccgataagcaattcttgtgctccatatggcgactgttgactgggaccacaggaattgctctgtggtgttcagctggtagctggtttggagggtcaagacagctttactcacacatctggtgccctggtgagacagctggaaggctaggctcagttgggtctctctctctctctctacatgggtccaagggccacatagtctctccagcagggtagtcagatttctcaatggtggctcgggcaccaacagcaaatactccaaacaacaggaaagggaagctgccagtcttttgatgcctgagcctgggtactggcccagggtcacttctgccatattgaattggtgaaagcatccatggagccctccaagaattaagaggtgggagggcaagaaatacactccacctgtacatggaaagaatgtcaagaaatttatggctatctttaatctgccacttgaccttaagaatctcttccaactcaaatatcgaatgatagcccaatgacactgatttcttccctgaccttgggcatgattcttctcgaaaaaaaaaaaagcaaaaaaaaaaaaaaagcttataccaggggaaagtccaaaccagagagggctgatgtaagcagtgctcagcacctgtgtgttcacctgtattcttcgttgatttactgctgtctttgatcgtgtccattcctgtggcttcagctaccatttccatgcccatgacatccattctcctgagctccaagactgagttcaccacaaatattcatttggatacctcacaggcacctcaaattcagcacatcccaaatggaacttgccatctttccttccaaacctgcctgtcttttgcctttgctatctcagcaagctatgcaaccatccaccatgtttccgaaatctgtaccctgagtagcatccttatctcctacttctccctcaccctctgcagccaactgataacaaaggcctgtcaattctaactgctattatctaccacgttattctgtcctcgctgtcactcttctgcttcatggacttctacactcttctccttactatttcccctacagtccagagtgacctttctcaaatctaaatatgattatgttgcttcccattttagttggaaggcatactgttgaggataaaatctaaactccttaatgtgatttataagtgttgttcttgtgtgatttgatttaaagacatcaaatgccctcctgccccacacatttctctccctagcattgccaataaaatgtccatattatccattccttctagttaaggcacctgaagtccttgttagttgcaaatggtatctgagaggcatggccccagttaagccgttagcagccattaactcctttatgccattcatgaaagtatcctctgtggctattcagtccttttgaaactggtcataggatagataagttttcaaaaaaggcaagggttgtctaagttagtgtctggagccatttctgatacattcaaataaaagtaatttgctggtgaacataaaacatacaagcatctggaaagattctgtattgtgaaattattctgcatgtcatttttttgatgaagaattaaaaagttattgatatcagtaaaaaaagaaaaaagaagaagaaggaggtggccagtggccagtgtaaatagccatttaggatccaaaatttcaaaataatttagccagtttcatttgataagattagcataatagagcaccaattaaatccccccaaaactaaattccaagagatgacttaaatatatcggtcacatataaatttgtgatatcaatcatttctggaaataagggatccatcaggcaagacttaaaaattgtttccatatacagctcaacttctccattatagtagtatttgttactatgatagaatttgacctttaatagaatttaacatttgtgaaactcaagttctgtctcttcctcgtcaatcttctactgatgtttcacttccccaagttcttatcctattgcctagaagcagaacactgacaagtgaccaccaccatcagacactcacgtccttactctcccccatgcctgaacgttggctgtctgtgctgatgctccttcatcatgtatatcttacttcacccatctttttcaaatacatctgccacattttccatcttcatctctcccagcagcttcttaagcccccacatcttttttttttcaggcttgaaatttttgatattttgtttttttttttttaatttcaatagttcttgaagaacaagtgatgtttggttgcatggaaaagttctttagtggtgatttctgcgatgttggtgcatctgtcacccaagcagtgtacactgtacctaaagtgtagtcttttatccctcacccccctcctgcccttccccctgagtccccaaagtccactgtatcatccttatgcctttgcatcctcatagcttagctcctacttataagcaagaacatacgatgtttggttttccatttctgagttacttcacttagaataatggtctccaactccaaccaggtttctgtgaatgccattatattgttcatttttatggttaagtccctacatcttattactccacttttcaatgctcctgtgtcatttacctataaaatctgaattccaatgatgataatggcaatgatgattatttagattatttaaattttttcatcactttgatgttatgttatcttgaactatctcctataatccttgtatcaccactatgatgtctaagtatctcatttacagaagaggaaactgagacttagagaagtcaaatgatttttctgaggttctataattaatcatgttttccaaagatattctgataaggctggatcaaaaaactaaactgggatcaatctgtcaaaatcacctttccgtacactaaaatatttatgaataaaatgatatgtcattgagaatttccttcagaataatccagtgcaggagggagtggagtatagataaaataagagtgaccatatattgatgacttgtgagtgagtgatgggtatgtgggcgcccattgtactattcactctacttttgcgtatcttggaagctaaccatataaaaaggttttgggatttttttgttttgttttgttttgagacagaatctcattctatcacccaggctggagtgcagtggtgcaatcatggctcagtgcagccttgacttctcgggcccgtggatcctctctgctcagcctcctgagtagctgggactgtagtcatgccaacatgcccggctaattttttcatattttttgtagagatggggttttgccacgtttcccaggctggtctcgaactcccaggctcaagcaatctgctcactttggcctcccaaagtgttgggattacaagagcaatccactgtgcctggcccctaaaaaggttttttaatgtcatcttttttatgcaattacaaacaatccaagtccactgatcagtattgctattcaatgtttgtagataattttgaaaatgtttcattatgtgtctaggttataaatatctaacataagaagagcacttcagctttaaatacaaaggtcccatttttgtcacacaagttttttttttttgttctaaacctctatgatatgcattgcatacttaccttagtggaagaaacaattacccaagcactgtgtccaactgcatggtgttatcttttaattaacctgtgtagccctttttacttaacctagtttgagaagtgacagccactgagctgtctaaataatgtacgccactgctcttttatttgatctattcaatcaaaaacaatagttcctggtgtgtggtccagccctgtagagctagatatactttctattcagtcatgatccttgtcttgtacatcagcgttgaaacttgccttgctaaccagagtatttagaattgtttcaatataggaaaccagattgatcccatatgtgaaatcttttccatatttcacacaatattttgtgtaaaagctattctgctactctgcgtccatcaacttagaatatccagtgaataaggggggggtaattggatgctcacatttctgctgaggggttagattaaaagtgccacattggctgggtgtagtggctcacgcctgtaatcccaacactttgggaggccaaggcgggaggaacacctgacatcagaaggtcgagagcagtctgaccgacatggtgaaaccccatctctactaaaaatataaaaattagccaggcatggtggtgcatgcctgtagtctcagctactcaggaggctgaggcaggagaattacttggacccaggaagtagaggttgcagtaagctgagatcacaccactgcactccaacctaagtgacagagtgagactctatctctcaaaaaaaaaaaaaaaaaaaaaagtgccacatttctggatggaaatttaaatttatcaatatgtgatcaaatccctaagagtgtgcatgccctggaacccagtagtgccatatctaggaatttatcctaaggaagtaactggacagatgcacaaagatttttatgcaaggatattgagggcagttgtttttttaatagtaaatacaaagagtctaactgtccaacaatatgggattggcttaatgaaattatccacagaaatttaaaatgttgatgcaaataattgtatggtagtggagaggtattcattaaatcctgttagtaaacaggttatccacaatatgcatttaatgaatatattattatacatatacacaaacacacacccacatatatatagcctcacatgaaagaagttacctctacatacatatatgtgtgtaaaatttgtgtaaatgtatgtgtttaagggagtgttgtggaggggtgtgtgtgcacagcttaagtcaggatggagaaatatggtatcctttaggtgattttttttctagcagtatttttatatatttctataatggaatactactacaagtagtagctacatacgaaataaaaaggaacaaaaataacagataaaacctattctgtctaaatgtgtttcaagtgttcagataaaaggcaagtgaaacaacctagagaagatgtaaaaaaccttttgggagcattgtttcaataaagaaaagcctttccatattaattattgagtagaaatgatggaaaaggtaatggggaaagaagcagagaggagtgaagagccaccctacaattggtgataatttcccaagctgggcctgggagttataagtgagatgtgctcccctcaccaaccaaaccagtgaaatattatagcacatttttctctccctttttcggagtgccagagttttttggagttcctgtaacagaccaggttttacttgctgatccttaacagaaattattttaaggtaggtcttcctaaactatggcccagggagtggggggttcaatgtcttgcccaaggtcatatagcaggcaatctgtgagctgagatgcccttcaccaagggcatgccctgagatgccgttcggggctctccatttgcaaagagaagaacccaggaaagtgcaaagaaagtcattgtcactgttacagtgaccaagacaacaccttggtaatgtctggatagaattctctgaaaaatggggacaatctgagttgtacaggcagcaactgagggacatttttaggaaccagaagtaagcatttgtgattgtaaattattcaggctagatatttacaatgagcaatttagcttcaggccaatattaacttccattcctattactatcagattaattgcattttgttgctttttctaaatacatgtcaaatcaggaaacctataattcagcagttagtcattaaagtagcagtggatctgcaactgtgttatctgaagcccttctaaaaaataaaataaaaatccagggcttctttttttggtctaataaacagagcattaataaaaagcaactaggatattcttcctaggatgaaatatgtctaaattgaaaaaggcttcagataaaagaaatcaaggcaaataaacaaaagatgattgaaagaagttggataaatttgcatcttaaataatgcatctatagaatcatagaaaatacagttgcaaattgtcatttcaagattatacaaaccattttatacattttatatacatagtagttacaaaaataagttggacttaaagtggagttagtattatctgacacatttcaaatacttaagtactaaaacatcatatttcctatgcattacagaaattatatgaaaatgtgtatgtgtgtatctctcttcatttttcattgttcttcatgatctcatgcctttacatgcagctaatatcaagtacagtttcacagcaaatcaatgaaacacagtttacatcaaatgaccagagagttgccaatttctaaaaaatcccagcatctcttgtggattgctgacttcaaagacatgcattaagattattaagcaagtaatgattgatttattacataacattaagaaatgttttctttgaagcacaaattaaaaggtcatggatgcccagatttttcttcaggttgatagttaaaaatgcagaatagataatattgctggctatgaaggacacatgaaggggatttgaagtaactctcctttctgggcaatattttaatgaaacgcttaatattctgcagtggattaatgaggcagttctctattttcaaacaatggatgaacaattaggacccaatcctgaggacaaattggtgtcgctgttattttgtgatggtatttaaaatgaccattgctgtagcaacaaggtattatttaacaggaatgaaaataaccatttacatcaagcatttcagcagagatattctgggaaaaaaaaatgtggcagctgctgttcctagaaataaagctgacattttcggatgaaagcaaccagctgaaacctaaacatgctttgtgccgtgttcagaagtcacccgaaatgcatgccaacgtgctaaacactccccataaagccagcaagctgtggaatttctcactctggtctcaaaacactcaggggagaagagatgggtgcagatctttgaagaggtcagatttgagaatgaacagaattaattagccacatgagagtaaggaaaccatacatcaagtgtgggaaaagttatctacatatggagattaactgggaaaaattgatcttccaaccaaactcaaagtccaatccaagactactctaaacacctgcatgtcctaaataatcaggaactatattgctcagcaagcttgcataacaatgtaaacagaataataaattgtctctgatttttccagtgcattgttatggaaaatgaggatgaaaattctacgggtggtcaatgagaataaactatgttttacgcccaagagtcaaataaaaatcagggacttttcccatacttctgtgaattgtaatatatatttacctcaatgtcatccctgaggaatattctttctaattctacctctcacacctctagtcttttcttcccaggtgcaaagttattttgcttgctagttgagataagttctataatttagtttcccccctcttcctccccccaaaaaaagactataggactaaattgataggatgaaatgataggtttaaagaataattcattataccatcaagatcttggcatgctgatagctgaaaagactactttgagctgtcagttctaaagcacatactttttcattgtctgacatgccaagtgcttgatagaataatgaattgttcccattgacatcaccatcgcacgtaactcttgggctccatgcagcatttttcaggggtgatgaataacatcaatgttctttccatggtgtgtaaaactaggaggatgagggcaggctcagggactgctgaagaggaggatggtggtttagggatggagggaagaatggaggcaaggtcagaggtatcattaaggtcagacacaactgtggtgcatgtgataacacctcataattaaaaatgtatcattccaactgggcgctggtggctcatgcctataatcccaacgctttgggaggccaaagcaggtggatcacttgagctcaggagttcaagactggcctggactgtggtgaaatcccgtctctaccaaaaatacaaaaaattagctgcacatggtggcgtgtgcctgttgtattcccagctggtgaggtggaagaatggcttcagcccaggaggcagaggttgcagtgagccaagatcatgccactgcactccagcctgggcaacagaatgagaccccatcttaaaaaagaaaaacaagaaaacatacaattccacattcacatttcgacataattgcaacaaaacaccatccaagaattctgcctttttacttgggaaaggtttggggtttgatttttttctggcttggaagctatttgctgctactgcactcaactcagaggcccagctcccctggctcagagataagaaagacaaaaagaaggtactcatatcaaagccatggggccatttcccttagaatgggtcatatacacatacccaagttatactctgctcctaaagcatgatcatccttctctgcatctccagggtaggccaaatctgaaccactgtagccaagggaatgtctcctgaaggctgtaagacccactgagcaaacttgtccagagcccctagtaacattaagaactggagctacaaaatgcttaatactgacagaagtcacaatccacagagctaggcattaatgcattaggcacttaccatttgtgtaaataactttttttcctgcatttaaaaggcagtcttggactttcattaagactctggtttcctctaggcaataccattcaggacacaggcataggcaaggacttcataactaaaacaccaaaagcaatggcaacaaaagccaaaatagacaaatgggatctaattaaactaaaaagcttctgcacagcaaaagtaactaccatcagagtgaacacgcaacctacagaatgggagaaaatttttgcaatctacccatctgacaaagggctaatatccagaatctaaaaagaacttaaacaaatgtacaagaaaaaatcaaacaaccccatcaaaaagtgggcaaaggatgtgaacagacacttctcaaaaaaagacatttatgcagccaacagacacatgaaaaaatgctaatcatcactgatcatcagagaaatgcaaatcaaaaccacaatgagataccatctcacaccagttagaatggcgatcattaaaaagtcaggaaacaacagatgctggagaggatatggagaaatgggaatgcttttacactgttggtgggagtgtaaaccagtgcaaccattgtggaagtcagtgtggcgattcctcagggatctagaactagaaatcccatttgacccagccatcccattactgggtatatacccaaaggactataaatcatgctgctataaagacacatgcacacgtatgtttattgtggcactattcacaatagcaaagacttggaactaacccaaatgtccatcaatgatagactggattaagaaaatgtggcacatatacactatggaatactatgcagccataaaaaaggatgagttcatgtcctttgcagggacatggacacagctggaaaccatcattctgagcaaagtatcacaaggacagaaaaccaaacaccgcatgttctcacttatagatggaaattgaacaatgagaacactgggacccagggtggggaacatcacacactggggcctgtcatggggtggggggcagaggaagggatagcattaggagaaatacctaatgtaaatgacgagttaatgggtgcagcaaaccaacatggcacatgtatacctatgtaaaaaacccgcacgttgtccacatgtaccctagaacttaaaatataattacaaaaaaaaaaaaaaaagactctggtttccagatagggccttctctggtttccaggtaggggctttctctaccacattcacccaagtagtgagtattatagtaataacacctgcttcaggagttcccctccccctccactaaacagcaattaattttcttaattttgttatttcaaaaaaaaaaagggggcagttttcgtttcccctctcttggtagacattttcctactatcattgaaaacactggattatgtgagtatttctttctgtctcagcccatctctaaatacaagtagatgaataatccccccactaacatggggttaagaacacatgcattttatataaagactttaggataaggcacagaagaaccatttttccatcagagccacgaagtggctattttatataacatgagttcacatgtgtgcatatatttgtatatatccacatttaatttgtcatttcatcatagacttgatgagcagaagtctagacaagatagttagagctcagataacgtgtccaaactcctcactgaaaagctgagaatgctgaggcctggggaggaaggttggcagacagagcctttttagttagtgaagttctcagatgatgttgataaaactaccacaaggcaaaagttccagtcctgcagccctggagcatctgccagttttcccaggggggcatcatttgccatctgctctcacccttctcactgagggtctacctctcagactgtcaacccattacagggccaaacattctggggttgtagacctcagtggccattggcatcatggcatctcagattaaagtttggcacctacacaaaggtttctctggggtacatgggcacatggccttggcttcctatatgtctgcatcttcttcctgctcttcctcctctccctgctgccttactatttatcgaggccttgccagatgccaggcattaattgtgctttcttacatttccctgggaagaagctcccctgactacactacccctcagtctaaagcgtttctcctggtcaggaacattgttgagtttagcctagactgggcatgatgactcacacctgtaatcccagcactttgggaggtcgaggcaggcagatggcttgagtccagaagttcaagaccagcctgggcgacatggtgaaaccacatctccaccaataacagaaaataaattagccgggcttggtggcacatgcctgtagtaccagctacttgggagactgagatgggagatcacataagcccaggaggtagaggcttcagtgagcagtgattgtgccactgtactccagcctgggtgacacagggaaaccctgtctcaaaaaaaaagtttagtctaaagctgccttctcacatatttaaagttcagcctaaaggtttctacgtagatgggaaactgtatcctatgatggaggtgtaaacaaattgtagcctactcttgtgccaatcacaggggcaatcgaagggggccaactgttcaaaccatgttaaaacaagacaaacaccaggctgtaactaatctggctgtttctttacctcactttggctttctgtctatcactttcctttttctgtccataaatcttccaccatgtggctgcactggagtctctctgagcctactctggctccggagactgcctgattcccgaatgtcctttgctcaattaaactctgttaaatttaatgtggctaaggttttccttttagcaacatattctttcccttcagggtacttctctcccgttatccttacatactctcacttgtgtgattacctgactaatatcagtctcccctattccttaccattgtgttctcagcagagtgcctcatacctggaatgaacaaatagctcctcacaaccacctgatgaggttgggtcccttaataccctccatttacagatgagaaagctgaggctcagtgagcttaagtggtttgccttaggtgtacatgtaaaaagtagcagcacggggtgcatttgaggccagagcccatactttcacccgtctcccacactgccactcctcatgagtctgcaaaacccctctaatttctgtcaagatgtcatctgcatgcacttgccaaacatcactcactaccttatggaagactctcggtggatgtcaagatgtcttaatgggtgaagcgggtgttatcttcaggctaacttgggttctcttccaagggtcaggcacagatcccaacagagtaaatccaaattctgctacgatgtcttaccacaggggtcttcacttggacaagatgctgttacctaagaagcaactagtcaagtcatttctgcaggactcctggctgatgggtgctatcaagttccaacaggaaagcagacttttacaccacagacttttaagtgctattagaattaaacagaaggaggaggaagaaaggaacaagaaggagaagaaagacaaagagaaggagagcatatttcccagctatggcccttttcactactttaaaagcaaaaccatcaaagaatgggcacctttctatgggtatgacttttatccccttgtcctctagatttattgcttgcaccacgtagcttccaccataaaactcttctttccaatagactgctatctgaatatcaagagcaagactctccagtaacatataatctagtaaaaagtaaatatgatagaataacaaagcgatttctgaaggcaatttatttgcatagagatacctgagagggaaaaccaaaattccatctcagaatctggtaataatgtactatgagatgctccatcatcacatcttacttctaattttacagaaaagcagttgtagcaactggaagaaaacctctcagtctcatttctgcaaggtgaaccataaacacttctaaatgcctcatgggtaaactctctcccagcacattgctgaatatcacttgaatatttgaaaaacgatatgtagacaaagatatttttctagaggatttacattttcccatcaatgtagaattgcccttgctgtgaataagtacttgctttcttttctccccattttccacgtgccttaagggtttgaagggttgctatggatgatgtttacttgtttccttagtttttccattttcctcctcatcctgccttattttagctggctttcaaatgttaatcctggcctttccctgcctcaccttaggtctgttcaatgtgtccctagtactactctcatttcactagtcacctgcttcactagtcacatggctataccactttaacttcgggttttcttctgggacttgcaacagtcaccttaaacttcatcccctacctgctgattcctcatccaatggccttatatcaaactggcctgattttgctggcacctttacttaacactgtgcccgacttggatttccacccaagacaggagacacttccgctgaattgtgtccttgccatttactctccagatttctctggaaactacgattactttttgcctactcttgtcctgctgattgaatgacctcagcttgagaggcaacaacacagtgatgtaactggctggcattcaacttggagtaagacaacaaaggtccaaatccctcaaccttagtttgcttgcatctccatggtgtagtatggggagaataatacctgcagtgttggcattgctgtagcagtgaagttctttcagattgtaaggatgagctaatccaatccataacctaaatgtactagcagcttcatggataactggaaagtgactcataattgtaccccatagaggaggaaccccagtagctcagatctggtgtctttgtcccaggaactttggcattctctttgcacctcaccttcaaatgtccccagcagaatggctctggatgggtcatttatttaccgtttatctcgcagcctcttgattgaatagactttggctcagctgttgattcctggtccaattaacaagaaccaggtatcacagttgatttaactcaacaaataagatgcaactgaccagaacaactgcatggtgaaggcactgcctggtccccctttccccagaaggcggctttagccatggcaaatgcttagggtagcctgcctggagtgggattcttgcaacaccaatcctcatacctcttgaagaaaagattccatggtcaaataaacttgcatacagtgcatatgacatcttcctgtttagagattcacaatgcacatacatcaaaggtgctgagaagtcctgcaataaacttgctttaaattgacttaaggaagcatttatcaaataactatttatatatttagagaccgagtctcgctctgttgccaggctgcagtgcagtggcgggatctcagctcactgcaacctctgcctcccaagttcaagcgattttcctgcctcagcctcccaagtggttgggactacaggtgcatgccactatgcccagctaatttttgtacttttagtagagacggggtttcaccatgttggccaggatggtctcgatttcttgacctcgcgatcagcctgcctcagcctcctaaagtgctgggattacaggcatgagccaccacgcccagctgtaacccatttttttgtggaacatcttatggacactcagtggaagatactttggcaaattctggcttagacctcatgaactgtctattgccaccagcttcatcagtgtctccagaacagcagttcccaacccctgtacatcagaaccacctggggacatttaacaaaatataatcagccagactgtgccgctaggtattctgatttacttggtctgaggagaggtctggagatcagaatttaaatgctccccaggtattagacctttaaataataactctatatgttatagtacaataatagcatttactaaacatgttttgtgccaggcactaaataagtgtgacattattcttttattttatccttatatgaacgctgcctaatgtatattaccaccaatctacaagtaagaaaatataacctagaagaccaacataaagaaatttgctctgaagaagaactgaagagatcatgtgccatctatagatcctaaatagagctagagtcttcatcaaattctctaccaagtcaaaaagaatgcattcccctaagcagcttctgtcactagaaataatcttctggggaccaagtgctcttcccacaagatgatcaggagatactatacaggatccagctattggcggcagctaagcaattccacacttaaacctgaaaacggtccgttatcattttcccgccttccctcaaatcaggaataacaaaatccatcacactcagaagcaaggccttactcctaacactcgggtgcctggaatctacaatgagattcagacacaggcttcagaccacccaagaggccatttggaagggcttgactgccaccttgtggtcctgtgcactaccagccaaggcgagggcacacaaccagggagaaacaaaccgtgagcaaactgctctaacccacttcttctgttttgacaagaatggttataacatcgtttgacatgtcccagtaagccgaaagagaacaaggtattaaagtattctcgcaacagcccttgcttgggagtaggttattttaaacaattgctttctccagggcaatcatacctgagttgatttgtgtatatgctcctagtttagaaaaagcaagtattttccgtattttctctctactgactaggtttcaaaaaagaactattttgggccaagagtggtggctcacacctgtaatccaagcattttgggaggctgagaccagaggatctcttaagctcagagtttgagaccagcttgggcaacatagtgagactctatctcaacaaaatatgaaaaattatccgggcctgggggtgcatgcctgtagtcccagctagttaggaagctgaggcaggaagatcacttgagcccaagagtttgaggctacggtgacctgtgattgcgctgctgctctccaaactgggtgagagagagagacctgtcggaaaactaaaaaacaaaacaaaaaattcgttttttaacggcaagaaaaggcccaactccaggactgttttttccatgttctatatcccccaactaatttctcccttctctttccctcccttccttccttcctccctttcttcctccccgacctccttccttcctgcattacatgtaaacatccctacctaactcaaaattccttcaccaagaaagccctatatccaatccttctgctactggctgtgtgactttgggcaagttccttaacctctatttaaacatcttagaacggtttttacatttttaaaagattgcaggaggagggcaacaaataataatacgcagcagagaccatatgtggcccacaaagcctaaaatattcagtcagcagtacacggtatcaactataagtattctttaaaaacagacattcaatctgaatcttaaggagactttagatccaactttcagttgacaggaagcaggagggagagtaagacaagctaaacggcacctcggcaccacctcacccgctagtgaatgtgccgctgagatccccttcagactgaagcactcagtccccagattgcttgacatttggctgctgatgggtcacagctgagctcctcaccaggccttgccctcagctgaaggaagtggccttgctaaggccccacccctctctgggatggcccctgtttgaacttacgtgcatttcttgcctcgtgcatttcttgcctcatttggggacctcactgaaaggccactccagccctacagcaccccgctgaggcctcacctggcattgcccctcaatttctccctctgcccaagcctggaccccttacaccctcacaggtgttgatcgtgagaaccttccccccaaaaactatctgcattcaaatctccatcccagaatctgttttcctaagacatccctccacaccctattctcagcgtaacagctagagttagtgtgttagagataaggcaggtctttactactttactcagatcccttcaatggcttccatctcatcagaaccttgccatctacacccttgttgcattatctcttgactttgcctcctactcctctgcccttgatcacaccagccacactggcttccttgctcttcctcaaacataccaggcatgcttctgccttggggtctttgcacatcttcttctagcttcttggaatgctccttgtccagttatctgcataactccatccctcacctccttctagtcttgagtcaatgaaggcttccctgaccccctacttaagtgtgcaggactccaccccaccccagactccacatccctttctttggttttctccatagcacgtatcaggatctggcacacggtacatcttattgatgttatttaacgtctgtctccaccagaatgtaagctccattatgttgtttaatgtctgtctccatcagaacgtaagctccatgagggcaataacttttatctattctttgctgtattcccagaacttagaatagtaactgatacaaagttgcagcccaatcaatatttactaaatgaacaagtaaataaacgaatggaagactgtgaacatggaatcagaagaaggcttgtgatcttcagggaagtcccataacttccctaaagtggaatggaagacttccctaaacgaatggaagactgtgaacgtggaatcagaaggcttgtgatcttcagggaagtcccataacttccctagagtggaatggaagacttccctaaacgaatggaagactgtgaacgtggaatcagaaggcttgtgatctttagggaagcattcttcacatgaaaaacaggaaccataattcttatgtcattttggtaatgattatacaatataacatttatagaagcatcatgtaataaactgctaaataaaaggcatttttgatcaaactgaattcttcatcagagaggtacttaatttttataatctaagagctaccagattgccaaaaaggaagcacagaaacattcagacacagaaaaccttaaaaatggttctgatattcaaataaaatataaaatgatttattccaaagccatacccaaaacatacaatgaaatacatccctgttaaagacttaataaaaagagcaatctttacattttacaatttgaagaccttctgttcccacaaaaagtctcataaaattccataaagtgtcaaatgtattttcctgtttatataaaatgtattctctcttcaaatatagccgttttattatgaaattgttctcaatttctgaaattctcagtagtctatagtatcccattttcacatgcttcttaaaatgaggtaagaagacaaacggtgaaacttttttcagatcattttttcagaagtcaatgccttgctgatgcaaagcgcaacatgcttttgtcatccctttcatctgaaatattttcccagtggttactcagtattttgcacacaaaaaacagttacaatacctgccacttaaaaatccataacatgttgtaattcttcttatgtgattttaaggtctgaatcaaagccattgctacagtgattcactattttctttacaggtattttaataaatattcctcaattctagaagactgttccaatcctttaaagtgggggtcagcaaacgtcttctgtaaaggtccagatattttgttttgtgtgtcatttttctgatggatattttttacaactgtaaaatatttttaaaaaattatttagctattctgtaatttgttactccattattttaaaaaatagaagtaactagtctctaaatcagactactcaagtgttaataaaatgtaaacttcacattgtgcagtaaaataaatccatggtttctgactactaaattgaaagttcataagcagtaagaaatgaatcccactcaaagagtggggctacattccagatattctttttaatcaatgacactgttttagagcttctttttcactttcattgaataagtcacatgtctttagtttgttttttcttggtcttacttttcacagggaaaaattctcttcatgaggctaatttgaagtttttgaaattaaagactggaatactttcatgctgacagaggtagacgcacacgcactggtatatgcagttacaaatactcgcataaaatggaaaccattatttcatatataaattaattaatcacaaatgctctccatggctaagaaggaatcagtggaaaccagacagaaggtatgcaagacagtcctacagaatgttctaatttgcttttatcacatgtagttgctacattttaggaaaacatgatttaaatatgaaacatgtaatataaattaatatagtggcatgatttattcaggttctcgatgcatataacctggaggtgactaaacgctgatctataacatggtcctatagcttggtactgagaatcacaactctgcgtgtgtgtgtgtgtgtgtgtgtgtgtgtgtatgttttgcatgttttcctttcctaccacaaacagtgttataaccagattatggcaaataaaagaacagttgtaaatttacccaaatatatcataaacaagttggaacactctggaattacagtcatatgatattctacaaaaatatttacaaattctaaagctgaaaaagttgaaaactttggtattcctaaaaagagaaagttcagggccatgcgtggtggctcacacctgtaatcccagcactttgggaggcaaggtgggaggatttcttgaacccagagttcgagaccagcctggccaacatggtgaaactccgtctctatcaaaaatacaaaaatcaactgggcgtggtggtgcacgcctgtaatcccagctacttgggaggctaaggcacaagaatcacttgaatccagaaggcagaggttgcagtgagctgagatcatgccactgcactccagcctgggtgacagagtgaaactgtatctcaacgacaacaacaaaaatttagccaggtgtggtggtgcaggctgcaatcccagctagtcaggtggctgaggcaaaagaatcgcttgaacctggggaggcagaagttgcataaactgagatcatgccactgcactccagcctgggtgacagtgagactctgtctccaaaaaaaaaaaaagaaagaaagaaagttaaagtatactggggagtccatgcttaatttttgaactataaaaagttttcagtgcaaaattattgctattgataaatagcaatgacacaaaaaccacatgaaacacttaacatctatacaacacataacaatatcctgaaggtatgttttggcatagaaaaggtaattcggggataggaaataacagattgctttactgatttaattctaagtctgggtgttggagtgtttaaacactctctttttgcaaacagactcagcatatttatagctcatcatgtttcttcttaaatggccactttgggtgttgcaatacgtggtctgcagcctgaaggacaagatacataaattcttctacatcgaaagagtagttggtgaacttcgggtgctcccccagggttggatggtggccctgtgaaaataaaccaaaacacgaatccataactcaatgagggcatggttttctctacagcaggaaaattatgttactttggttaaggcaactaatttatgttctacatcagagaccagcaaacttttcctgataagggccagatgataaatattttcagctctgctgactctaaggtctcagtcacagttactccactgtcgttgaagtgcacaaacaactagagacagtgcataaacagacaggcatgactgtgctttctttacaaaaacatgtcatgggctggatttgcccacagggctgttgcttgttgatcccgtctctatatataatctaatagatctttctaagcccaaatttcacgaagctgcctttgtaacattaaagatataggttgcttaattcccctttttctcctatttgcaaatataaaataaaacaattcagtattccagagaacagtttatctttgcagcactgaagttcaataaccatttttcatatcaataattggatactttaaaccaattaaaaatgaagcaaggtaagttttgtgattgaactttaccttatcctgaggaaagactttgttctgccgtcgccaagtgatgtagtgaacgcctctcagcctggccaagtctaagtaacagcgttcatcttcacagttgtacctaaggacacaagggtgtcacaacatgaggcttttgtccaaggttttttccaaatcaacaactctgcgaaaataaaatgcagctcccaaatatgtccttgcaaaaggttgtaaacaagactgaggaagacagtaaacaagactgaggaagagaatgtaaaaatattctctgaactaaatgaacttaacttttaaaaaacaaaatagggtcatggaatggagagaattgaccttattcaatagggcctgctgcctatggacttggcatgaccttataatacctctgtctttaaatgtatgaaagaggcaagggggataggtaacacttccaaggtcatataactaaatagtgaaggatgcaaaagtagaacccaggtccattagactataaggcttgagttttctcagttacatttctctcccttctctctcctttcttccatccttccttctctctctataagagaaatgacagagatagaatccattatctggctatttctctacatatatcatatatatttttgaaatgttttgcagggcattggaagttcatgacaacttttttcctaaatagcctcctatttaaatacagagtcaaatcacttttaaaatgaaaccatagaacccagatatttagacataatggggggaaacaggtaacagtaactgctattagtgtctcaagacctaaaatggagcacagtgccaacagcagaattattatgagagggaaggtcatgtctccataaaccaaccactgagttaaaagtatgccctgggcaaatcatgaacacccaagggcctcagtttccctgtgtatgggatcagcaagcactaagttaagtggttggcttgtgttttgaagctatgtcgtgcatgagacataaatgctttcttttaacacaataactacactgtttgcaagaagacgctcagagtttgggaggtatgcaggaacaaactcagaataaggaaaccacagattcacatcttccatatcatgctcgggatgggaagatgaaggggtagttggcttactaagtgcaatggcaggctgcagactttgtatttttagcttcaggcctcttttctttccagattgtctatatgatgtgacttctctttttgaatgattaaatattaagccttttgatgctcagaatgaaagctttagcatgcataaaaagcattatcagttgcttcagtgtaaaactgcctcccaacacttacagttcaaatacagcagcccagtctggaaggaaaagtaaatgggtcagaccagctccatgcattccaataaatatgtccgtgttgtgtgtgatccttagttgatctaaaaacccaagttctctgtgaacatacagaataacatgagagagatggggagaagagagaagtattaggttgagttagttcatgattcacagtaaggatatttataaaagtgtattgcccattttaaaccacattccatttttaagaagcatttttgccaatttcaagtgcgctctagtaattaataagtttcttaataatttaacatattttctaagtaagctcacctatccttttaggtttaagtactttttttaaaggaaactttaatatctgtcttaaatggaaaagcagtgacatatgacatcaacaaaactgtaaaaattgatataatcaaactaagtagtgttcaaatcgaggtagatactattgcaagacaaagctcagagcctgaggcctgctctttcttcatgaaaaagagaaattggcaagtgttaaagagatgttgtgacacactagcactaaattaaaaactatttccttaggacaatagaagcactttttaaaaagaaacatttctccttgtgtgatttaagtttttataatgccctctgggtacctccaaaatgatctcagataccaccagggcattatcctgcctttggaacagacaaatccacaattttatgcatgttaggactgtacaagtgttctctaaatccaagacactaaccagtgtgtaaactttgaaccaaaaatcagtccccaaacaattcactgaggtgaggctagggagaaatgctggaataagggtgacactctgaataaacagaaagaaatgagatctcccagccccaacttacccaaagtaaagaaaaataaatgatcaagattattttggatctacgaagggaagctgaattcccttttacaccagctaacaacaaaaactccgcataggaaaaagatgacagctccatgtgtatgtgtatcacaacgagaacatgtgcctcagtttctccaggaatgtgaactgatgccaagggaaggacggccattcacccaggtgaacatacccctgcactgccagttgtggaaacgcctgtggtcagcactcaccaatccccatgccaacatgttactagtatttcccgcagactggcaaggtacgaattcattatcattcttgcttatctgagaaactacaacatatccttaaaagccagtcaatgatacagcctcagaggtgccctgcccagttctttccatttcttcccagcctcatctaggtgaatggttttgggactgatgtgggggccccatattggctcactcatttcttcaagcaacactgacacaacatttcttcagcgcagcagattttacataatctgtaaaatgggactagctgggccaactcagaagactgttgaaagcgtgagatgagataaagcaagtaagcataaaagtacatttcgataaatagtagctgtttttacaattgctatttacctctattcagtgtctgagatcctcaagaccagggctatgccatccgccataatgggattcctactgctgagactggtgaccagctcatgggtccccaatagagatttattgcacaaatgaactaatgtatgatgaatgaagtgcaaagctcccatgccaacattctctgaaattaagtgtatctatattagatacccacatgctgggatatgtatacttcttttaactggaaagtgttcacagtgttagatttgggaaacacagctgtgactgtaggtggacatggagacagaagttttcacttttccttttgatcttttctatactgcttgacttttcaaccagaaacatgtactacttttaccaggaagatgtaattctagcaacaggaattacccaaactgtgaataataggcatattctgtctttctaagccttttagttgtgttaagagttttaaaagaaatgtaaatatttggtaagtttttttaaaatttcatgttattctgaccctcaaattatccccatataaataattttcagtcagatgttgaaatctggcaggaggcagggcaaattaggtttataacatctaaattttgataacttttttgttatcaaacatttgataatgttatcaaatatttgataaattttataacacctaaattttgaactagttgccaatttttttttttttgagacagagcctcgtactgtcacacaggccggagtgcaatggtgcaatgtcagctcccttcaacttctacctcctgggttcaagccattctcctgcctcagcatcctgaacagctaggactacaggcacacgctgccacactcggctaattttttttattttttagtagagatggggttgcaccatgttgtccaggttggtcttgaactcctgagcccaggcaatccacccatctcagtctcccaaagtgctaggattacaggcgtgagccatcgtggccagtctgccaattttttaaaattatgaaattttaggccgggtgtggtggctcatgcctttaattgcagcactttgggaggcagaggcgggcagatcacttgaggtcacgacttcaagaccagcctgaccaatatggtgaaacctcgtctctacaaaaaatacaaaaattagccggatatggtggcacacgcctgtagtcccagctactcgggaggcagaggcaggagaattacttgaacccaggaggtggaggttgcagtgagctgagatggcaccactgcactccagcctgggtgacagagcaagattctgtctcaaaaacaaacaaacaaacaaacaaaaaattctgaaattttaaatgaaaatctgaattcatcacttcttttgaataaggagatggagtgacaacatcaggccccagaaagccaaagagtaactgcccttgttaccagggacttcacctgcccatttcattcatctgtagtgtctacttgtcccttctgggcctacaaatgccaatggctcccactggaaaaatgctttctagcccccttgacctcatccaagcaaaagttgacagtgtctgctgagattggctattacttacctatacttgtaatcaacaatctggacttcaaatgtagatactgttttcagtgcatttacaagctgggaaaaaaagagaaacatttagcatttcttttccttctttcacttctgtttttcccttatgagtcctaaaatttctttttttgcatatactatttcagatattaaatatcatttggtaacaacaacaacaaataaaaagaaaataaataaatatcattcaggtcaatagttctgaactgtcattaagttcaaatccaggccccacctgtgaacacacgactctacctccctcagataccaatgcactgtgttgctgtgaggctgaaaggagaagacaattcagggaagtaaagtgctaggcacagaaatagctaaccattaactgttgttattaccatttgcttattattccctcaactttcaacacacatttttgggcatcagaatgcccaaaatgttctagactttaccttaagagtttttgccccatccattatctcatttcagacaacactagcgctttgaacctcatcctctgaaaatactaaggtcttggcagaaaaacattttcagtacttctacatagaaaaacaattattcttctagcaaacagaaagtaacaaagcattgttaatctattatcaaaaatatagtcatggttctctgtccctcacaattaggccacgggggatcaccaccattcagaaatttctgcaactgtgtcatgttgccttgtggcatgcactgcactgcaacagcaacatcaacagttgcaagtatcattgatggggcatgtaaatggtgctggcatttctaagagtgtcgttaggtttacttcacttaatcctcgtaagaatcacaccagtggctgggcgcagtggctcacacctgcaatcccagcactttgggaggccgaggcgggcagatcacctgaggtcaggagttcgagaccaacctgaccaacatggtgaaaccccgtctctactaaaaatacaaaattagctgggtgtggtggcacatgcctgtaatcccagctactcgggaggctaagagaagagaatcacttgaacccgagagatggaggctgcagtgagccgagatcgtgccactgcactccagcctgggcaacaagagcaaaactctgtctaaaaaaagaaaaaaacataccaaatatcataccaagtaagtattagtactatgcccactttacaaattagacaagataggctcagagaagtgaaataactttcccaggatctcacagctcccaaatgcacagccaaaaataaatctaggtcttctgaccccagaacctgcgttcttaaccagtgcactctattgtcctgcttacagaaagcaacaagcagtgaccaacatttaatcccctcccctctctctctctctctcacactcacacacacacacacgcacacagtcataacatggaaatttccctctccagacagccactgaaatcttataaagagttgaaggggtaagaagattagaattctgttttacaggagagatggcagatggcataagccttggtcttttaacaagattgcccacataaaaggaatcatgtgtgctgacggtctcagggcaagcatgccctttttcatgacttctagttgcacgaaaaaggtggccctatcccttccgatggctattcaaaccctaaagttgggcagaattccacaagccatgatttaatgaggccatttgggttgattaatacatacctgtttattaatcaaagtatagccaaaggtgctttcttcccttcccaggagctgcctttctagtaacatccaatcctcaagaaagaagcagccagttgggtgctctttggcttggagttgggggctgaatgatcaaatttcgcctttgggtgccatcatctgggcaatgcgcatgactggatctgaaaacctcacacatgcactaaagcatctaccagcactatacctttctactggacttctctgcagtggcctgatgttgttcctcagcctgccccttcctgatggactggggccagaggtagcttctgcctcctctgaaatctatttgctgttttagtagtagcacactctggctaagaaagcagtttcagtccctgactaccttgactcacgcccccgttactctaatcaccagccgggtgaccttaggcatgttttttaaccactgagcctcagtgtccttgtctagaatagaggataataatacaatacctacctcatgggtttgctgggagggttggggggcacaatgtacaaaaggagcacacaataatatgcttgacccccaactgcactcaatatgtatggtctataccaatatatactgttgatctgttggctagtgaggcttctcatttgtattcccaacattgcactatttgatacgttcgtatttctaggtctttaaacacacacatacaaacacacacactgctcatttcttccatccacagagcttacaattaacacctcattatgccatatgttcatgtcctctgtaatccatatgggtctcaggaagagatgttaattacataattcggatcagcctgttaggcagccaaattagtctgtgtaaaatattttacccatcaaaacatgacacacaccacctcccccctcaactttcctcttactgaatattttccagtttgtttccacttatctgctcaagttaaaagcctcaagtcacacttgatccttgatacctttcctggccttctctaatgtgaatgtacttttacattccaaaagtaagtatcataggtcctatctccaaaatatgtcttgaatgcatctaccatgtcatctctactgtcatcactttggctaaacactctcccctgggccacaataacaacttctgatcaatctccttgcagaatgacttaaaaataaatgtcaattcatgtctctccctctgtatttgttttctatctgctgctgtaacaaactgccacaaatttagcagcttaacacaacacaatttatccccttacagttctgcaggatgggagcctgacgtgggtctcactggactaacaccagggtgtcagcagggctgtgttcctcctgcaggctccaggaaagaacccactgcctcaccttttccagcttctagaagccctccacactccatgactcataggcctgccccctccatcttcgaagccagcaacatggcatctctctggccccacttcccttatatctccctctcccacttttaaggaaattatgaactctgatttgatcagtgagaagaatccagtgaagaaaagagctgtccaggccgaggcaaaagttctctagcagatggagtttaaggcccatttgtgattatactgggctcacgtggatgatccaagataatcttcttactttaaggccagttggttggggaccttaattccatctgcaaccttactttccctatgccatgtaacctaacctgttcacagattccagggatttggatgtggacatcctttgggaggagcaggaagagacattattctaccaacaacgccctgctttaaaacttcacaatggctttcccctacactggaataaaatccctctcccaccaaggtctaggaggctgatacgatctgtggccccctgcaccatgcctgacctcttggatatcgccccacctctctcaagatgctacagtcatattggtattctgtttctagaatactgaaagctcagtccactagaatacatttgactctgcccgagaggctctctcccttgctagattcttctctgattaggtctttgaatgccctcatgtgagtacaaacccccatccatccacatccccagtctctatgacatcaccctggttcatccttcaaagcacttatcactgcctgacatcaccgtacttattgacgttttcacttacttcttatctgtctctcacctctacggtgtaagctccatgaggtcaggcaccttccccgtctttgctctactctatctccagggcctagaacatggcctgacacatagcaggtgctcaattaactattgtagaataaattcttactactgagaggctatcttcaggccatgatgttgtaggtagtggccttgcatggtgatctcattgaggttaaatgtaatttatgagttggtgctactgaaatgagtaaggatgctgaaaatgcagtttctaagacatggtcatgtaagaggacagagattcttccaactaaatctgctgctgataccacaggattaatggcctcaaccatctgttgcatcaactatgcaaaagaaagtcttacatttttgctacttgtctgtccggatgccctctactgcagtcaaggcaagattctgacagctttttccatgctgagttgatgcagatgaaatttactataaggcaaagctagtttgtctatgggtggtttggtgaatctcactagaaattcaaatctaataaataaaccgggcataggccatcaaacttttctcaaaactaagttttaaaccaaagcttttaacgtaatgtgaaaaaaaaaaaaacacaatttgctctatgaattgaatatgaaggcattaaaaatgcataccaaaaactaacctcattttggttaaggattttccggtattctgtgctccgtgcaagaatggtgactcgaatttttccatcctgtaatcaaaatgaaacggtaaaataacactgcatatgcctgggtagatgaatgaacatctgaacccaaaatgtgattttcacaaagagatgaaactcaaccaggatacattaatagaactcttcttttttagcttgattccttcaccactctcagggaataaaaatgtatccacttcaaccaccgaaggcaaaaaccagctcattacattgtctgtttggttgggtgggtgaattttttggcaggggttgtgtatgttacatgaacatttggggaggtgagggagatataaccaatgaagggggaaaggaggacaggaggaagcacattcttgtaatatcccttagcttctcttttataggtttttgacacctggtttcagatgactccaggtcagaaaatgtttttgggttttgttttggggcagtcttgctctgtcgcccaggcgggagtgcagtgacatgatcttggctcactgcagcctctgcctcctgggttcaagcgattctcatgccccagcctcctgagtagctgggactacaggcacatgccacctcgtccagctaatttttgtattttttgcagagatggggttttgccatgttggccaggctggtcttgaaatcctggactcaagtgatccacctgccttggcctccccagaaaatgttaacacaaaaacatggtctcctgattatttctgtttctgaaaaggtggtatcgatttttattagggaagaaaactcaagcccacctcagaatccgcagtgtatccattaccttaggtccttcttgtgtgatgtttagtctgtgtagtacatgctgggcaaatgccctgaatagtccagtattttgacagccagatatctaaaataaaaacactggttcatattacaatgaatacttctgtattataatttaagatactgtcaacttatgtataaatgttatgtctgtaaatatgaatgctaatggtagacaatgtgcttaccagaggagtattatagaacagcccatacctcatgcgggggagtaatgaaaaaacagcttctttaaaacatacctaagaacaaagatacattaaaagaagatgtaatttgcacccttcacaccaaaaatagcacgtataattttgagaaatagattttaattaatctccattttgcattgcttgaatagcacactatttcattcaaagagaacagaattcatatttttggaaagattatagaaaaaacttttcaaaggctgcatgattaacaacactgaggattctaattataaaagaaattcagaaattcagaaatcagtggtaatggctaataggaactcataataaatgtttattttatgagtgagtcatctgcactcaagaaatattcacagacatttcaggaaaatttccagtacccttttggaatcataagttttcaaatgtataacgtcataatcagtaaatgcattccatgtgtcggagaataggtcaccatatccgtaagaactctgaaagtagaaacaaaacaaggttttagggcaataaaaggatataacatgacttttcaaagatgcaacaaaatacctgaatttgcctgtgttaaaaactaacaatcctacgcaagttcataaaatccatacaagcaaaatggatcttcatcttgggccagagcaaatgcctaatttgatgaaatatcatcagaaataattatcacaattatactcttagccattaatagtgtttcatttttctaccttaacttcttttattctcacatctttgtagttcagggctttttcctgtgaacatcttatccaaattatagatacacacaacacacactatgccaccgtttacacacactcttatgctcagtgtgcaaaaaccatcagggtgaatgaaaaatctttggaaaaaaatttcagagcaagaaaatgggttcaaagttttaacactggctgggtgcggtggctcacagctgtaatcccagcactttgggaggccgaggcgggcagatcacctgaggtcaggagtttgagaccagcctgaccaatatgatgaaaccccatctctactaaaaatacaaaaattagccaggcatggtggcatgtgcttataatcccagctactcgggaggctgagacaggagaatcacttgaacctgggaggcgggggttgcagtgagccgagatcatgccattgcactccagcctgggcaacaagagcgaaactccatctcaaaaaaaaaaaaaaaaaaaaaagaaaggtttaacattaaaaatataggctggtcacagtggctcatgcttgtaattccagcgctttgggaggcaaagtgggaggatcacttgagccttgaagtttaaggctgcagtgagctatgatcatgccatatactccagcctgggcaacagagcaagaccttgtctctaataaaataaaataaaataaaaatatataacatatgtaattctatgaaatatccccccacccattgactagtgaataaaaagtggtaatttcccattaatattaatggtgtcaataacaactttatataataataatagcatcttacatacttcctatgttccaggcagtttttttgggcacttgatattattaatgtacattaagccacccacaagcctaatgagttgataatatcattttctctattttgcagatgaggaaactgagacacaattttaagtcatttgcctacattgcgaagcagctgagttatagagctggtattcaacccagcctgtgctgccacttccatctgacagctgcctttcagcaggaattagttctttccagtataattaccacatgcttttttttttttttttttttttgagactgagtctcaccctgttgcccaggctagagtgccatgtcgtgatctgggctcactgcaacctccacctcccaagttcaagcaattctcctgccccagcctcccgagtagctgggattacaggcgcacgccaccacacccggctaatttttgtatcttttgatagagacagggtttcaccatattggccaggctggtctcaaactcctgagctcaagtgctccgcctaccacggcctcctaaagtgctgagattacagaaaccacacccagcctgatttattttttgaaaagtagttgattatgagctccattagctaagaagatcaattaatttttaaatggtttcacttagattgaaaaattcagccaatagaaatcagaaatatgcattgtagcactacattcaagctctacagttatacattatgttcatgtctcttttttatagcattcttttctcagattttgaaaattttatgttgcacatattacagttatttcaaagttattgagatctgttagatgtgaaaaaaaaaaaaaaaagccttctttccatgttcctccaatgccattctaataaaggcccttctcaacaccatctaaaatgaaatgtccctgttctggctcaataataaataaagggcaattaaaagaagtgattctagatggtttcctgagataaaatacttcagataaaataaaatatgtttgaaaggaaattttaataataaaatacagtaatcctgactgatccttcctcagggaagtcatacattattgaataagaaccacctccaaaagcttcttttccatgtttcccaagtccaaattatccaccatttgggaaggaggcacttcttcctatactcatgttgaagaatatttggatagtcttcaagatgacataaaatttcctttagtgtgtctcaaatttaaacatgcacataatctatgacttagaaattccaattataggaatctgtcctacagaaatgctaggatgagcatgtgaagatataggtatattgaaaggacatatgtgtttatggtcacatttcagtaaatagcacagaactggaaacaaaactaaatgtgatggggggtggagtgggaaatgaatacatgcactgatgcatgcatccaacttccaaaacatccattaaacagaataccacataacatctaaagcaaggatagccctaaaggtactgacttaaaaagacattccacagataatactaaggtggcaatatgagacagagaatgtattttccataagaatataaacatattggccaggctcatggctgtaatcccagtgctttgggaggctgaggtgggaggatcacttgaggccaggagttcaagactgtattagccagttttcacactgctgataaagacataccctgagactgggaagaaaaagaagtttaactggacttacagttccacatggctggggaggcctcagaaccatggcgggaggtgaaagacacttcttacatggcagcggcaagagaaaatgaggaagaagcaaaagtggaaaaccctgataaacccatcagatctcatgagacttattcactatcacgagaatagcataggaaagactggccctcatgattcaattacctccccttgggtccctcccataagatgtgggaattctgggagatgcaattcaagttgaaatttggtggggacacagccaaaccatatcattctgcccagggctctctaaatctcgtgtccccacatttcaaaacaaaccatgccttcccaacagtcccccaaaagtcttaactcatttcagcactaacccaaaagtccacagtccaaagtctcatctgagacaaggcaagtcccttccacctatgagtctgtaaaaacaaaagcaagctagttccttcctagatacgatggggatacacgtattgggtaattacagccgttccaaatgggagaaattggccaaaacaaaggggttacagggcccatgcaagtccgaaatcctgcatggcagtcaaactttaaagctccagaatgatctcctttgactccaggtctcacatccaggttacactgaagcatgaagtgggttcccacagtcttgggcagctctgcccctgtggttttgcagggtacagcctcccttctggctgctttcacgggctggcattgagtgtctgcggctcttccaggtgcacagttcaagctgtcagtggatctaccattctggggtctggaggatgatggccctcttctcacagctccactaggcagcaccccactaaggactctgtttgggggctccaaccccacatttcccttccacactgccttagcagaggttcttcatgagagccccgcccctgcagcaaacttctgccagggcatctaggcatttccatacatcttctgaaatctaggtggaggttcccaaacctcaattcttgacttctgtgcaccgcaggctcaacaccacatagaagctgccaaggcttggggcttccaccctctgaagccacagcctgagctgtacattggctcctttcagccatggctggagcggctaggacacaaggcaccaagtccctaggctgcatacagcatggggaccctgggctcagcccacaaaaccacttcttcctcctgggtctccaggcctgtgatgggaagcggccgccatgaaggtttctgacatgccttgaagacattttcctcatggtcttgggaagtaacattaggctccttgctatttatgcaaagttctgcagctgacttgaaattctccccagaaagttggtttttattttctattgcacaatcaggctgcaaattttctgaactttgatgctctgtttcccttttaaaactgagtgtctttcacagcacccaaatcaccttttgaatactttcctgcttagaaatttcttctgccaaataccctaaatcatctctctcaagttcaaagttccacaaatctctagggcacggcaaaatgctgccactctctttgctaaaacataacaagagtcacctttgctccagttcccaacaggttcctcatctccatctgagaccacctcagcctgaattttattgtccatatcactatcagcattttgggcaaagctattcaacaagtctctaggaagttgcaaactttcccacattttcctgtcgtcttctgagcccttcaaactgttccaatcgctgcttgctacccagttccaaagtcacctccacactttcaggtatcttttcagcaacaccccactctactggtaccaatttactgtatgagtccgttttcagtctgctgataaagatacacccgagactgggaagaaaaagaggtttaactggacttacagttccacatggctggggaggcctcagaatcatagtgggaggtaaaggcacttcttacatggtggcagcaagggaaaatgaggaagaagcaaaagtggaaaccctagataaacccatcagatctcatgagacttactcactatcacaagaataacacaggaaagactggcccccaggattcaattacctccccctgggtccctcccacaacatgtgggaattctgggagatacaattcaagctgaaatttggtggggacacagccaaaccatatcaaggaccaatctgggtaccataacgagatcttgtctctacagaaaataaatttaaaaattagccagatgtcaaatcagaagacagtaatatatattatatatacgcacacacacatatgttatgactatattgtcataacacatatataacacatatatggaaaagaatagccaggtatggtggcatgcacatgtagtcctagctacttgggaggctgaggcaggaagatcacctgagcccaggagagcaaggctgcagtgagctaggatcatattcctggactttagcctgggtgacatatttgcacttattaaaataaagagagtcctgcaagggactcacacacgttaaatgcagttacccttgggggaacagggaattggagaggaagaaggagacttttttaaaaacttcacatacttctgtgttgtttgaactcattataatcaggtattactttcataattaaaaaagtaatcatggctggacacggtggctcacatctgtaatcccagcactttgggaggccaaggcaggcggatcacctatggtcaggagttcgaaaccagcctggtcaacatggtgaaaccctgtctctactaaaaatataaaaattagccaggtgtgatagcacacactgtcatcccagatactggggaggccgaggcaggagaatcgcttgaacctgggaagcggaagttgcagtgaggcaagatcgcgacactgcacttgagcctgggtgacaagcaagactctgtctcaaaaacaaacagaaaaaaagtaatcataaagctatactacttctcagcacaagcaaatgtggaaagcctgccgtaatttctccttttattcattctgtttgataagagcaaccctgctgtgcccagagaggcatctgaagatgggtccctctatgcatgtttgcaggttggtggccttgcccatcccactgaagatgccacatgctgaagggagtaaactgcagagcttttcaaggaggagagggaaaggccccataggcttccttgtgatgacaggttggaaaatatcaccaagatgtgaactgcagtcacagttacctccctgctcttccctgggcaaactgctcatccaagaccatcaggactctggcaacaccatccaccgggagggattcatgtcatagtcagcctgcaggtcacagtgatgcttaatttaagtccttaccaacaaaagggaaacagcagccacacaaacccttacttagcgccatccccatccaacctaccctgtggacctgaattctggagcaatctggcagaattgcctgtcctgagaacctggcttagtaaatggcttctttgaccaagcgtccgggtttaaaatggatgcacatggagtggcaaaggaaggaggtaacaccaggcggccaccctgctgggctacacccatcctgcttaactgtgccagagctgaggtcagactgccctcatgtctcatgctcagctgactgagtaacctggggtcttcatggtggccgtgcatcctactccagcagccacagagaaggggagggttgtaggagctggctcacttacagtgagctaatgtgactaagttatactaagcccatttgaggaagatgtagaaaagcatgcaacaggtacaaggaagcttctggaagccatctgataaatttctgtcatctgataaaattctgtttggcaacttaggtagagtcctcttcagaggactttaagaagacgacagagcactgtggtgtctgagcacaggtctggggtcaggctgcctggatggaaactttggttctgccctcgctgacagcattatcttagaacactcacctgctgctcaggcctcggcctcttgtctgtaagataagctaatgaaaactcaagtccacgggggtcataagcatgaaatgaagtaacataatttatgttaattacaaaatttaaaaatagttttgtttaaaaacggcaaaacaaccctgagttaataatttagggcttgtaatggctggtgagtgtggcctgacttcactgatacaaaaagaagaaaagaaagggattgttgttccctttgctcacaaaacatttcgaagaaatgaaactgtggtggcagcaaaactgaaatacaagaggaaaatgtaaatgcatatagacggaaaataaagcattaacacgccaagaattatagtctcatcagacttcaaatctaactcaaagtctagggagcagtgatcctgaaaacctttttacacagctctactacaagcctcttatcagtgaaattaagggtcggcaaaactgtctctccttctgcatgagaatttgacctcctgttaactagctaagtcggctctctgcaaatgaggacagcttgtgtcaacaagcctaggcaacaatgcttctgatctaaaaagatgcttgatgggtaaactgcatctggactgggaaagccatgtttcggattccctgagtacgctgactcctggaaccaggcatgtctctttcagggatcctggggactttgccaacacagctgtgtcaggagatgttggcccctacaggatatgaggctcctaagccaaggcatcgcctgtacctgccccaggcgaatcttgtctccttgcacctgagctgtgctgtgtgaactgctagcactccctctggaagaaacacctgaggctgccctgccagcaagctgtggttcccctgcaatgtcatcctgaatagactcacaccaagagccgagcatatgagtgtcgtgagtcagaatgttgagtggaaccttatatgaccccttggtgggtgttccaacttcccagtttagacagcctctctcatgtacactacaaaccatttattctccttattgtaattgtcacagttaacattcagagcacaagtactgtgtaccaggcatggtgactgttcacacactacacggttcattctcaaaatgacacctaggtaaatgtcattatctcactatctcatttcagagctgaagattctggggcacatcttggggtttcctcagcaagtggaggggccagatatgggaagaagcagggaaaaggcaggcaaagagagagaaggaaaaaaagattgcactaaaaacaaataaatagcaggtgtcactcaacacatgcatttatgtgcatgcctaagacctgccctttacagtgagctgaaacacacagcataattcagcacaaaggacacagtaacaaggaagctgctattaagcaaaggcagacagtaaatgcaaaaggccaaacagtaaacagaggcaagcacttccaacataggttacagaggttgagtgaatgacagcctttttttttttttttgagacagagtcttgctctgtcacccaggttgcagtgcagtggcacgatctcggctcaatgcaacctccacctcccaggttcaagtgattctccgaccacagcctcctgagtagctgggacaacatgtgtctgccaccgtatctggctaatttttgtatttttagtagaaacaagatttcaccatgttggccaggctagtctcgaactcctggcctcaaatgatccacctgcctcggcctcccaaagtgctgtgattataggcgtgagccaccacgccctgctgaatggcagtctttcatatgtgtgtcccagaggaacactaagccaaagtcactgaatctctggcctttggagctccacccacccagaaagagaaagaaaccttccccactgcctcattctaaaattcaaagaatgaaggtacacacatacatacctatctgcctatacgtatatgcacatgtcaacacatatatgtacagatacattcgcacccatccgcattatgtgcggctgtacatgttgaaatatatgtgtctttgaaaattctgtttcacaacatcagagtcacacactgatacaagggaaagacagtactgaagcggagagcacattcttacttacggtgtcccacatcacgatgtacacgtcagtactgaatgagttattaacgtgctgagtaatataaagattgatgaaatcacagaagtggtgatacatgttaacacctagtgttggaaaatgaaactacattaattaacaccaaagagcacatgatcaagcaagttttattctatcccatctatttacagtttaagagaattttagtttaaataaatggggaaaaaaataactgttttgtttttccaaacatgaaatgatctagatacataggtagtcctcaatttatggactgcctgggtttcaaaagtcactctaaaattggttatttaaaatcaggaatgcattttcccatatatcccaagtaacaagtgatcattaagttcccagaaaaaaacaaggtaggtctatttaactcaaaactgagtagaactacagggccatgaagacaaaccattatttcttctgactttatttatttttttaatcaggggtggggtcttgctatggtggcatgtgccaccatgcctagcttgatcagttgttttttaaagtcaattaaggggccaggcacagtggctcacacctgtaatcacagcactttgggaggctgaggcaggccaatcacttgagaccaggagtttgagaacagcctggccaacatagtgaaatcccatctctactaaaaatacaaaaattaggcaggcgtggttagccactcaggaggctgaggcaggagaatttgcttgaacctgggaggtggaggctgcagtgaaccaagatcacaccactgcactccagtctgagcaacagagtgagactctgtctaaaaaaaaaaaaaaaaccagaaaaaaaaaaatcaattaagaaacatctgttcatcagggaagtactggcaatgatggcaactaacattttggtaattttcattcctgtctcttttttccctatttaatcattacatgtatcattcctggaaaaacattaaccaactatcatataaaagaagtgaatgtcttgtgttctgattgaaagagaagcaattctggagaaagaagaagttgaattccagcacagccaagcatgcgcaacattcttagatgagtttataaagtccctaagctttagcttctctatagaaatgggaaatagttacctaagtgccagctttattatgagaaacccaaagataatacatcttaaagtacccatcccagtgccaggcacataggaagacctgaatgaagactagctggatcccactaggtcagatagagtggagagggttgtgggaactactatttgtaagttcacatgccattcattaaaaagaaacagaatgtgcaccctctccacttaggtatgcaggacccaatattcatcctggaaatatacaaatctaaatgggatgaaattccaagaactgacacttagagcatgcattttaaaggtaggaaaatgctgagtaaaagaaaaacagggactctcaaatgcagaaatcataaaatattctgacttcattcccacagtgaataataacattgtgtgccagaaataacagtataaaaatactctgtttttttcagcctcgtatcttagctgattgtttggaagggctaattttttcacccagaaaaatcttggcaaagaatatattttcaaattaacaagaaaaataaagttctatcagaatctatcctcttttcccaggttagccatagagcacacatgagctctttcacgtaacatttagtgagttcctaacagttactgaggaatgcagcaagcacaaatcagtgcttggggttgcaagaatttataaacagagaagaaaacataagctccatccttgagaaatgtgccccctaatgagtcctgatctgtagaatgttcatttccctaaggtacaagttaacatgaaaaggaaaactgaaccaggcacagttactcacacctgtaatcccagaacttttggaggccaaggcagggggatcacttgagcccaggagttcaagaccagtctgagcaatccatgagaccccatctctacaaaacatatgttaaaaattagccaggcatggtggtgcatatgcctgtagtcccagctacttggcaggccaaggtgggagaatcacttgagcccaggaagttgaggctgcaatgagctgtgatcatgccactgtactccagcctgggcaacagagcaagacctgtctctaaagaaagaaaagtaaaattggaagacagcataaattagaagaaaaaagtagagttatgaatataggaaagaaatgagacatgtctactctagcctattattctcactttatatactttattgtataagtatctgcataaatttaatagctcacacatatttgccacttttacagacggatcagtgttttctttgcccctttttaatttgcatgttttaaaaacgagtcaaaacctggaacatagcatttttactcgcttttatttcaaaaacctaaacttgtctgatttctgaatttaatactttgtaatataagaactatgacttcagaaggcagagcacattaaaactatgatcaataaattatactaattctgaaatatttgtgacagaggctctctatatttcactgtaaacccaacctctcatgaattttgatatgatctagcacagtaatccctgtctctcataatgaaagagataatatagtacaatctgtgtttctcctccccagtgtaactagttcgcaaagttaaagctctgcttgcaagctgagaaagaggctataagtataaatgataaaataattttaattttatgtcaagaataaattacactggtaacttccagaagaattttaagttcactttagtcatggaaatgatacagaaagtttgtcagcgcaggtcatggacacttctttcccacccatactatacacatggcttttgattttttttttttttttttaagacggagtcttgctctgtcaccaggctggagtgcagcggcacgatcttggctcactgcaacctctgcctcctgggttcaagcgattcccccgcttcaacctcccgagtagctgggactataggtgcctgccaccacgcccagctaattttttgtgtttttttagtagagacgaggtttcaccatgttggccaggatggtctcgatctcctgacctcgtgatctgcctgcctcggcctcccacagtgctgggattacaggtgtgagccaccgcgcccggcttagcttttgattttaaacatcttaatgaaagacaatctaaaccaagtgattagagaaaccagatgaggtaaatttagttacaaaaggcataaatatgccttcacctctcgtcctttgattttggttaagtcctttgatataaatgtgaaagtttcttctaaaatgcccaagttataaaataatgggaagttcaaattagttcaactacttcttcagagaagaaagcaaaaaaaacaaatctactgtttgtcatactgcttccaaaaaattcagagagaattactacatccaaaaaaaggaataatatctcattaacaaatacacaaataacagaaaaagttatttctcacctgcatctaatttcatgaaatatgttggtttttcaatgacaatgtcacatttagcatcttctataggtctgaagttgagctgagtatagctttgtagctcagcaaacctgaaattatgaattgggacatgacttcaaactgattctcccaaacttcctattagaacactgtaacttaggatctgttcattaggcagattttacctctaaatggtacagacactcctatggacacctgtaacttctaaaacttactgacttttatataggttgatatcaattttaatgttaagacaaggaacagaccgggtgcagtggctcaaacctgtaatcccagcactttgggaggcagaggcagtcagatcacgaggtcaggagatcaagaccatcctggtcaacacggtgaaaccccatctctactaaaaatacaaaaattagctgggcgtagtggcgagcgcctttagtcccagccattttcaggagcccgaagcaggagaatcgcttgaacctgggaggcagaggttgcagtgagccgagatggtgccaaaaggagccgaggcttacaacaacctgagtgagtttagcagcagattctccaggcccaggttgagtctagagatggctacagccctggccaactcagccaagctgctcccaaaccctgaccctcagaagtactgtgagataataaatgtttgtattttaagctgctaaattttagagtcatttgttatacaacaataggtaataaatataaatataccctagggtacactttggaatagcctgtcacacagcaataagcaactaatacaattatgccctgagcaactaccatgtggaatcaaatatcagaaagtaccaggaatcaaaaagcccacttgaatatagaaactacctcttgtaaaagtctgctaagtgacttgagacattgcattgcagactgcaaaatcccagataaatgtgtggtagatcattattctgaatgatctgcagccaggcagtgaggcctctttaaggacaaaaaaaaaaaaggtttgctcagcatgaatttctttttttttttgagacagggtcttgatccatcgcccaggctggagtgcagtggtgcaatcatagctcactgcagcctcgacctcctgagctcaagcagtcctcccgcctcagcctcccaagtagctaggattacaggggcatgccatctcgcccagctaatttatttttattttttatttttcttttttagagatgaggtctcatcatgttgctcaggctggtcttgaactcctggcttcaagtaatacttctgccttggcctcccaaagtgctgtgattataggcatgagccgccattcctggccttggtatggacatttgaccttacaaattaacattatgtaagtaacctatgtgactatacaggagtagcaggagagtttctttgggatgatggaacaattctgcatcctgattgtggtggtcgccctccccgtcctcctccccctctctctccctacctacatacccgcacctacacaagtgataaaattttaatgagtacaggtaattgctggtaaaacctgcacaagttaatactactgtaccaatgtcaatttcatggttgtgatcattgtgccatggttatatgagatattatcattagaggaagctcagggaattagacaacgtacaagttctccttgtagtatgatatggtttggctgtgtctccacccagatctcatcttgaattgtagctcccatcatgggaggcacccggtgggaggtaactgaatcatgggggtgggtttttcctgcgctgttctcaagatctgatagttttataaagggcagttccctctgcacacgctctcttgtctgctgtcatgtaagacgtgcctttgttcctcctttgccttctaccatgattgtgaggcctccccagccatgaggaaccatgagtccattaaacctctttcctttgtaagttagtcagtcttgggtataatacatactatttttaaacttctatgagtctaaaattattttaaaatacaaactttttaaattcaaaaagctggccaatgatgttaacagtcagagtagcatctacctttggagagggggatgggggtagagcctgggagggagactgaggtgctgacaatgttctatttttggacctgggtaaaagttacatgggtgggttcactttttcacaatccaaactgtacctttttctgtatgcttttacatactttaatatatgtgtattgttttttaaatgggttccccaaaacacatttttattttttagatttgaggtctcatcatattgcccaggctggccttgaactcctgggctcaagtaatacttctaccttggccttccaaagtgctgagattataggcatgagccaccattcctggccttggcatggacgtttgacctcaaaaattaacattatgtaagtaacctatgtgactttgtaagtgaataaaacttggcaattgtgagttaataaaaatggatttttaagctgatttttttctttcattagcaaacagtaagtactgtatctactattataaacacatacttaattcagatgcaactgagggattcactcggtttccgtcacttcccagaagctcatgccaaattatgtacaaatgaagtaacattttccatttgagagtctccattaatatctgcaagtgccgtaaataaaggcaaatatttccgaaacagatacgttaaaaatatcttaccatgactgcagagggcttttgcgctgaccttcagacgtcaatgtacggatgtcaagtttacagtgccctccaatttcaccactctggaaaaagtcctccttaaatctggtatataacaaaacattaagttaagttcagaaaacgtcttcatgacccaagcacgtgggttgtaactaaagtggattaccaatttccaaactgaattttttaaaagaatttaactatttacaatagaaaatttcaagtgtatatgaaagtaacagaatcctatcaggaccctaatgtatccacaacccaactttgcaatgcgattaactcatggcctgtctgagtcatccatccccccacccattccccaacccctctgccatatcatcaaaaacaaattcaagatataccccttcagcaaggcttggtggctcacacctataatcccagcactttgggaggctgaggtgagaggatcacctgaactcaggagtttgagacccgcctgggcaacgttagaagaccccatctcttcaaaaattaaaaaattagccaagcctggcggtgcgcttctgtatcccagctacttgagaggctcaagtgggaggatcacttgggtttgggaggtcacagctgcactgagccatgattacaccgctgcactccagcctgggcaacagagcaagaccctgtctcaaaaaaaaaaaaaaaaatccctggatctgaaaatatttcagaatttatactagatgttaacattaaccactaaagtacctgtcatgatttctcttgatgtttcttaaatcaagatagagattggttgctctgcagtactgaagataacgggaacacaccagacttgagtcactctgaaggttgagcaaaagaaaagaatgactctgagtattaacacagcaaagactcatccggacttgctagacacactgacagcacggataccctcacattcaaaccacacaacatgacaaggaaagctctccaaagactgcatctgctgaaggatattttctccttcccagcagaccctggccaagcatacttttgccagtttcccacttttaagttaccatggaaaactccccaacgatctgtcacctcaaattttaaagccaagagctgtatatgtggctcagttcagtcccctttaaaagaaaaaaaaagtacccagatccagtactactacccccacagctatatgaaaaagcagcttccaaaagccaaaagaaacaaggaaaaatgcacatgtaagagacattaaaagcagggagggaagtttgccagttttaataagaggtgctttctgcaaaccgtaaagcttgtgggagcctctgtctcaacagcaacatgagggcaatattttctaaataattgaagaaaggagtcgaagagtcagctaccagagcctgattctatttcaaccaatctgggttatgctcagaacttcaaaaacttttatctgctctgggttttatttatagatttaaatgccattttaattgtttttcccaaaactcccaatgaacacaaagtctcaatcttgacctgcatggtgttttggagtctgtagttggtaaaatattgcaatggactgaatgtccgtgtctctgccaaattcatatgttgaaattctaacccccaatgtgatgatattgtttagaagctacccagtctatggtattttgttataacagcccaaacaactaagacaaggatcatactctgctagcacaaagcaaatcaaggtaaatcttaatcaaaagaacattctacaagccaccttgaaagaggagtgcaagataggggttgtcattattatcttgccctttccatgtgaacagctagacttgagccaaatgtgcaagacagaacagaactctgttaaagacaccctgcggccgtgcagtttaatggcatgcctcacatcctgaggcctcattcaccttgctagaatgctcaaagctctattacgtgacaccctccaatagctctataaagtatatactcagtttttgaatgtgagtaaattaaaaaatttttttagttctccagtgtggttggagatcggagacccctgagatgtcagagactcagggttcaggatcattgaacagtgtaccttaatcgtaagtgcttacaacttcatcaacctttaaaaaataatgctgagcccttggccgggaaccaggccctgctgcactgagcatttttatctgcagaacctcatttcttccttaccatatgctacataatgggcatggctttaaggcagaggaaattgaaacaaggaaagcctaagtaccttgtctaagactcaggatctgaattgtagttgagagcctgctcttgtatttactaccccaaaccacctcttgacaacgtgtttatctgatccactgaggtacgatatggtatggttgaaagtaaactggaaaaaaacctgcattttaatcctagatgtgtaattaattttaaaaggtagctgtgcagtcttggagaagttgcttaactcctctgaggaccctgttttccatactgataaagtggcatcagtagtatctgctataacgcttataagcatcaaacgagataacacacagaaaagctttctgcaaactgtaaagctctgggcaaatatagagcagtatggtggtgttatatcatctgtcccaaactatctgagaatgaatttgtaaagacgcagtttatcaatttctcttcattagcacatgtttgggggaatgattctaaacctaaaaatatttcgactgtcttaaaatatgactatctgataaatgtgggataaggaggacagggtttccaaaggaaagaaaacaacctatttggggaagttacataaaattctatgccaataactaagtgagagtgaggaattcctttcatagtgccgtctatcttgtttttacattacaagctaaatgataaatattaaaaatcaataataagtaataaaaataaaatagcttagttgggcacagtggctcacgcctgtaatcccagcactttgggaggctgaggtgggtggatcccttgaggtcaggagttcgcgatcagcctggcaacatggcgaaaccccacctttactaaaaatataaaaattagcgggggggggtggcacgcgcctgtaatccaagctactcaggaggctgaagcaggagaattccttgaacctgggaggcagaggttgcagtgagctgggatcgcgccactgcactccagccagggcaatagacagaaactccgtctcaaaaataaataaaattaaaattaaataaacaagtttatttagtaaggagcaaaatacccaccgtttccttaggctgacagagcacatgcatctcctccagcctctctctggcatatccaaagtcagcttgtttccaaaatatgtcctcagctgactcaagagtgtccgtcctatttgcaaataaaaatattctgtgtttttttctttttacttttttggaccttgaattttcattctaaaggttaaaatgctagaggttccttattactttaattttgttacagtatattatcatagtttttccaaaactacgcctcactacatgaagttacgaaactaagttattcacagaattattcctttatcataaaatacataacagacatgtatgaagttatcacctgaaactgaagccaatgatgcattcttaattactatattttctttacctcattaacattgcatgtattggaagtactaattatacttaattctcccaggaagaatcaagaagaaaccatccatttatcttcttactatacactgggggaaaaaattatctatggtcctggctgtttctccctctggcagaggaaatgacagatattcctatcccagtatgaaatagtcaagttgaattcatgactgtgcaagcaaattaatatctaaatgaattactatctaaaaccaaaagaatctagctggaaattagggcatcaacatacactgtatagaaagaggaagacttgaagagggtattccatatggaaacttaccatcccatgtcgacatagctgcaaactgggtaaccaaacctgaactctggtttgcaggatttctcataaccccagcagtactttagcttctctaggtgtttctagaacataaaacttacattgatttcccttcttctgacatttagagaagactcttagatttttccattaagaaaacaaatcattatagagcattcacatttacatttataatacgtattcttataacaataaatttaaaacttacagttaattctaaaaagagcagtctcaaggttcttaacaatcctccttactcatcacccccaccatatcggtcccctaaccgaaagtctgggctttacctagacgctcaaagaccacttgaatttgaatttcttgaagtagcttaagaaaccacctttctcagtgagcaagcggattctaaaatcagtccctaaaagacatataaactggaatttgtgctaccaaaggaatcacagctaaactgaatcaatcagcaacttcacttagcaatcaagatcagcagagaccccacaacacatggacaactctgccacccttgggaaccacccagctgctgctggccaaggagttgagaatgctcttctgcaaggccccaggagcaatgctggtctgattcccaagtctgcttttccatatgcttcctgtgccagcaccatgggaaaggaagtgtctcacaatgcccagctttgatctctggggccctgtgagatgtcttaatgggctcctatttgaggcctttccaactcctctaaaacagaaagaaagccacagtaacaggcttaattatgtggagacagaggctgaggtgttattactgaaattaagtgctaaccgatcctctcatgtgccgtttaagaaagaagaggtgtgaaattctttagttacttttaacaagatgttctttcctgcataaaatctaattgcttctttacagagtttacaaatagtattggctacttatttgttttagaagtgatttagattttaaatttctctcttatgaatgggacataattttaagcagtttagtcacttagaagtattatatgaaacaatgattaacttatacagtgacaaccgaaaattagaattctgccttcagtttcaggttataaagcagaacctgtaagccagctgaaattgcatcctcataaaaataaggagaaaagaaataatacctaccttatatggacaaagagagtctttcctacagacagtggcaatatgcctattgttgtgcaaaaagaagggaatgtgctcctctggcaagcggatgctggcatagttatacagaggttcgcctggaatgctgtgagtattaggaggagcttcattctgaccactcagtgagacttcatgaagtaagactccaaagacaaacaacattaacatagcaacctgcaaacctagagatcaaaatgaagacaactttgttaacaaatttcctttaaaagccaaaacaacaacaacaacaacaacaaaaaaaaaaaaaaaacaaagggtcaagggctaagtataattacaaagcactttgctatcccactgaataatgatcctttattcaattttttttgagcacttgcttggtgccaggcaccacgttagcaaatgggtatacagaggtgaacaaaacaagaaagagccttgctctcatggtgcctttaaacctactacaactgtcataaacaagcaatcaaataaacaacttcagctgatgactgggcctgtgaatcaaaccaactaggggccagcaaacttttcctgtaaaggagaagcagtaaatatttttggctttgccagacataagatctctgtggcaactacacaacaatgcctctgtccaaaaaagtagccatggtctattataaaagaatggatgaggctgtgttccaataaaactttttaacttacaaaaattatggaagggcttgataggatccagtttagtgatacctgaaactaaataaagtaatatgatagacaacatagcatggtgaacatttaaagcttaaccacctggatttgaatcgcaaatctgcagcttcccagctgtaagacctggaacaagttacttaacctttctgcacctaagctttcccatctgtaaaatggaaataataataaaccttcatcatagagctgtcatgagttaaatgagttagttattggtaaagtgtttcgaaaactatctggcacatgctaaatgctatggaaatgtttattaaataaaagtttaaagccatgtggggcagagaaggggcctaaataacattaaagctgagatctgaatgatgaggaggggaaaagtatctgtgagagagcaaagggagtgggatggctctgagcaagtgtgtgtctgctgaataaaaaattataatcataatcaaggtatgagcacagacaatgttccaggagcgcttctgtactcaggatacagcaatgaaggtgcagtcacgaactaaactcattgcccttgtgaagcttacatgctagtaggtataataatcagctataatagctaagacttagaaactccaggacactaagcagtctgcctcaaagactgtgcccttaagctctcccatcatgcctttacattgtgaacagtgataatggtcagaaacctcactgcatttctaattcacccagtaagtgttaaatctcttggaccagatttctcctatatatcccagacaatgatcctgccattctcaggtcactttagtgggatctttgttctttttttttttttaagtgctctttccactggatgacagagtcttaatacacactggatgttcatcagctaggactgctgtttcctgggtcataccggaaaacccaactttcgaaatcagtcttcattgattatgggctgtgaagatggaacctttagaaacagactgcaggcctgtaatagtagcactttgggaggccaagactggcagattgcttgagtccctgagttcgagaccagcttgggcaacgtgatgaaacccggtctctgctaagaatacaaaaaatcagctgtagtcccagctgaagtgggaggatcactttagcctgggaagtcaaggatgcagtgagtcgtgatctcgccactgcactccagcctgggtaatgcgagggagactctgtctcaaaaaaaaaaaaaaacaaagaaagaaagaagaaaaggaaattgactgctatgttccatcaaacctcaagttccaaggccatggaattctaagtgaacagtggggacaccaaaaaggaatcctttttcccccattttccccccttggagtagttaagtattgtggtttttcactttggcggccctcaagagtatggtgttatctgctgtaaatctgatctgaattacaataacattttcacttggagcttttatccaagaatgagttgacagcagttttataaaaatttaaaaacacatattaatagtaacaatgactctacttgtaataaaaatatatacctcttgaatcttcagaaccactcagaagcttctgtgatgtttcaggtctctaaaacctgtcagaaatgaaacatattaccttaaaaggatgctaaagtaaacctgatcattcagatgatgttgtgaattaaaggaaatattaagaaagaaaataatgtaacgtgataactctcagccagaaggcctggccggtggtgcgctttcttttccttaatgaataccacactgctatactcgagttcacaggcaccacccccaacacagcaactcggaccagattccaatggggaacgggaggaggtggcccactttctacaggcatccactggaactggccaacaggatacttagtggatcaaacattcccagaagcaaacaactttcccattctcacagcagtaatcccactggctgaatcacagggctacccacctagagtggcgagcctgagggttcccaggccttcctattttttgactcgtccttcccggtaataaagtcattgttatgaccaagccctgacctttggttatccaagtccattgtcctccagtgagctctggccatcactaaactcaccgatcagtggagaagtaacgcttaggcgatggaaaaaatctaaagacgcagatcagaaagctggcgtctggcgagggcatgtacccacttgcataaggcggctgggggtggctgctgggcctggcacaaagccttcctggtgtcggtcgtcctgcaaggcccgccgggatgggtggctgcactcctccagcacacggacgctttactggccaggctacttttccttcagctcaaagcagctggaatcactccactccagaaacccttgattcgatttccacaggcctaatgaggaaggaaaaaagggaaacatctgaaagatgatggataggaggcaaaacctggggttgacacagcgggcgaaatggggcaatgtcgcagagagagagagcttggaaaagtttaaagacggcagtgggcaaatggaaagttcaacacgtgagaccccgaatgacacctcaacggctggcccctacttgtgccaaaaagtctctcggcgggtgccaggcagggctcaggaagtgctcggctgccccttgaacgtcagtcccggcagagcccagctgtccgcttgaacgtcagtcccggccaagggctgaggggtcagtggcgagcaccccgccgcggctgagacgccgcgctggggttccggaccccgggcgccgccagggattgcttcggggtcggtgatctcccggggccgcccgccaccgtgcaccgcggcgccccgggtccccagcgcgcctgggaggggccccggggagcggctccgccccggctggaaacctggtcaacgcggctagggcccggggcccgcctgcgctccgggcgctgggaaggggccgggcgcccggggccggggagggccaggatcggcttccgacgcccgcctcccggcccgcagggaatgggaaggcgcgggcggagtgcgtgcgtaggctatagccctccgggaagccgcgccgggagcggctaccacccgggcaagaacagcgcagagcgctgcggcggcgggaaggagagcgggggaaggctccgcagattgcgggggagtcccacctggagccggggcagccgtgaactaccgaggaggaggcggaggagacggcggctgttccagaggagggagtcgtcataaccggctactgccgctcaccggaaacctcgggcgcgggagctgggccagggggcgccaaggagcagctgggacaccttggccagccggcgccgtgggcgggctcgggccccgcagaggcaggaccgggactacacccaggagggccagggcgcggggcccgacgctcggagcggcttcagcccggcgagcggcctcgacccggcgagcgcagcagggaggggctcagagtcgaggaaccatctgcccttcctggcgttctcccgcgaacgttcgcgcgagtccgccagctccctcaccagggccggaaagaccgacggcacgtgccggcgccggacgcccatctccatcgcagcagcccgcgcctccttgagcgagagcgttaaagcgctcagaggatgttaggacggggtgggtagaaaacctgactcttcgtgtcttctgcgttgcactgaggtggatttttacttttgtcttatttcaagcagaagttgccgccctaacttccaaatttggggactgaacatcgttcaccgaatacactttgtgatggtgaggatactttggagtccacacacattttaaaagcagtatagttttacctatccgtaaactcatcaagttcaaatgctactctgtggagtttaatttttatggttttgttaatttactttattactgcttataattatttgaactcccatcccccactgtcttttcctctaagctcccccaggcctagtattccatctacagcacagtagagttgatcattaaatagtgactaaagttgaactgattatatgaaggtgatgacttcaaaataaacatgctcaaatgaatatagtcaccagaagttaaataatatgatcataaggaaacaagtttgtttccaaaggcttacatgctttttacgtaatttttaaaagtaatgttgtttaagaattgttacaagttccattagtgacctgctaaattaggaatcttacctggaatttttttcaaataataacagcaagaacatgtggtgtttaacatgtgccaaacattgttttaaagcactttacagtattaatttattctttttattgaaaagattttgcctctaagggaactgtcaagaggcatgtgaaccggagcaactccatcttaaataggagctgagtaaaatgaggctgaaacctactgggctgcattcccaggccgttaaagcattctaagtcgcagaatgagataggaagtcggcacaagatacaggtcataaagaccttgttgataaaacaggttgcagtaaataagccggctaaatcccaccaaaaccaagatggccatgaaagagacctctggtagtccttactactatactcctatcagcgccatgacagtttacgaatgccatggcaatgtcaggaagttaccctatatggtcttaaaaggggaggcatgaataatccacctgtttagcatatcatcaagaaataaccataaaaatgggcaaccagcagcactcagggctgctttgtctatggagtagccattcttttcttcctttactttctttttttttttcctttactttcttaacaaacttgcttacactttgccctgaattctttcttgctcgagatccaagaaccctctcttggggtctggattgggacccctttcctataacagaattactgctctattattttatactttgcatacttcaccatcccacactaatgacagtaattttttaaaatgcttcctcaagccaggcactgtggctcatgccagtagtcccagctactcaggatgatcgcttgagcccagtgaggttgaggctgcagtgagccatgattgagacactgcactctagcctgggccacagtgagaccctgtctcataaaaaaaaaaaaaaaaagcttcctcagcctacttgctaccatcctatttttgtcacatacaaaaaggttaaaatcagtatgacatgtgcatggtactattttattttattttttttgtagaaacaggttcttgctatgttcccagcacttgtttccaactccgggcctcaagtgatcttccagcctcggcctcctaaagtgctgggtttacagttgtgagccaccacgcctggctatgtggtgctattttaaacacctacatattgaatggtcattcagacttacaggaaaccagatatgataaacctgaacatgagattgagtctctcttactgtaacagccattctcaaatagaatttctctccaaaataccaatgttagaatttaaattttctttgagctgacataaaactcaagtgtctaccaatagaaggctggttgaataaactatggtttatccatacaatgtaaaactatgcatgcataaaaaggaattgagaaatatctctgtacactacagaatattgagtgggaaaaggatatgtaatatgtaaatatcatttttctaagaggaatatgtgtgtatacatgtgtatacacatatatatttactaattattattttacaagtagattaacatttaaaatgactatatgggcaaggagggaagaggaggggtataaggaacaaagaagacatgactttgttttttggtgtgtgtgtgtgtgtgtgtgtgtatgtgtgtgtgtgtgtgtgtgacagagtcttactcttttgcccaggctggagtacaatggtgcaatcttggctcactgcaacctccatctcctgggttcaagcaattcttctccctcagactcctgagtaactgcgattacaggcatgcgccaccatgcctgacaaatatttatatttttagtagagacggggtttcactgtattggccaggctggtctcgaactcctgacctcaagtgatccgcccacctcagcctcccaaactgcttggattacaggcgtgagccaccacgcctggcgtgaagacatgactttgaagtcatgtaaatatgttacattataaagcaaaattctgtttttaaaaagcaatccttgaaagtaaaatgaaactaaatgaacctaaatgttttccaattgtggcatatcacccagaggagctatcccaagtgactttaaaacttaatttgtatatacttagtgggatgtattctcaggactaaagtacaaaaaaactcttttgtagactgcattccgtaaccaaattgttggtggcaatattggtattatgggatacaccaagttgaagtaattatgatggtacctttgaagctgaaatttttgacatgagatagaaatatgaaagcttaatcaggctatataaacatcctgtagttctgaatttcagttggaggcctcagtatgattaacagtatggttaatctttaaaaacacatctctcctacgtgctccattgaaaaggcctagagacaagctacccaggaggaagaagcacccccttgcgctcacactgtgatctctaccaaccatttcccattaaaagaaacactgactccatagaacaatggatgatcttgggtctggagcaggaaatgtacaagataagcctgcaacatcttacatcaggaagcagcaaagcaatcaaaaggctattagggtcatatcaaaaggactcaggatccaccttgaaaaccttcctactggccaaagataggatgatttaaaacataaataaaggtaactgtaattggatgaaggacagatacatttaagtaatcatatcagacacgaccaatcaaccaaacatgcaagccaaaaaggtatcgctgttcatttttaatgacagaaggaaaccaactcttattctgaaaactggtaaacaaagggaaagaatcaggaatatttatactgtctttcctgtatgaattatgatgcaaataacaaaataactgaagtaaattttttatggaaacattccaactactaaatgaaaaagaaatgacaatatcactccacaagctctgtgaactaatagatttaagaagtgatcatcaattatttctttatcacaactgagaaaccatcaggaattatctgtctcctgctggaagaatacacttccacctaatgaagtatttttgttgaaaaataattgcctttagatttaaacacaggaggcggaacacactaacaaaaggtaagaaatcaacatccagatggagggaaactataggacaaatgacctagttttttctacaaataagaaacttcatcgaaattgcaagaattaagaaaaagagagacagagatggaagaatgcatggcttaaaaaatttgagacaaatccaacaaattacaatgagtaaattgctaacaatatcagcagaatgtagtatactggttctctcatccaactgttagaccataattaaaaggtgttgacatttttaatgaataaattttggctgtaactgatctatatgcttatgattttacagaaaagcagtaggaaaagtagcaccatataattaattattgaaatcatagactctggagccaaactgcacaaattagaatcccagctttgccacttacttgccatatgaccttgagcaatttacttaatctttatttttaaaaatgggggtgataatggcatccattttaaaaggttgacttgatgataaagtgtgggtacacacttccttttccaaaatccttgggtccctgtgtgtgtctgaactttaaaaaatagaatagatatgcccatcgtttaacttaatacccccccccccccactgagtcctgggtgagtaccccataatctcacacagtatttctgcagcaaaatgtatgagtattcacaccaaatgagttaaagactatacatagccctatgtcagtgcagtgcaggctttaccaccgaagtagatttaacagcaaatgtattaaaatatgtatggtttttagagctttgtggatttcagaacaatgattatgggattataatcctacataagtgaattccttacacagtgtttggaacaaaataagactatgtttcccaaaaaaagaaaaaagaagaaaagactatatttcctattaccaacctgaccacagatttttgaacaacgtatatttttaaaaattaagattgtaattttaaaacagacaaatcagcatggcattttataaaaatggaaggaatacctctatctaccatgctgtgcctatacctgtaaaagcaagaagaatgtttaatattaaacaaacagaaaaacctgccattacgttcttgtttaatgttatttgcgattctaaatattaaatttaggctacttgggagtagggcagtgtggggaattccagacagttctaagagtaaattctctttaccgtatttgtgaattattgaagcattttgagtttttttgttttgttttgagaaaaggtatttaagtactaaggagaaatacatttcatttccagtctgtcttacaaaaagatcttaatttgctaaaaggtaaaatgcgtatgtataaaggcaacagattaaaagtactttaaaggttacagagcttaatccaagcaatatgaactcagaaatagaggataacttattttaactgttgttattacttgaatacagaaacataagacttttagaagaatgtcttgatattgcttaagattaaaaactgacacaaactatccttacagtagttaccagctagttataagtaaattcttagcactgtgttttccgaaaacatatcttcattagaagataatgaacttagggccgggcgcagtggcttatgcctataatcccagcactttgggaggccaaggtgggcaggtcacttgagttcgaaaccagcctggccaacatggtgaaacccatctctactaaaaatacaaaaattagccggatgtgctggtgcgcacctgtaatcccagctacttgggaggctaaggcaggaggatcacttgaacctgggaggcagaggctgcagtaagctgagatcacaccactgcactccagcccaggcaacagagtgagactctgtcaaaaaaaaaaaaaaaaactacacttaatactaataatgtaacttatagaaaattagggcttcattttcttaaaatattaatctcaaatgtaaacaagttatattttcataaaacaatattcattcttcactcattactattgaccactataaattttgttaaaaatgaaatacactattactattttaaaatctttattcaatcagatccatgcttatttacattacctttcatttagaattaaaatatatcaatctgtagtttaaatcatactttcagccctttacaaaatatgtgattaaagttttcatggtttaaaatggacctagaatatggaaaattggattcactttaatgaaaatgaaaaattttgatacactagaacataaatgtatacgtactaaacatacagtattaaaacaagataaaacatctacagttttcttttttcttctattttctaaatattataaatcatatacttttaataagcattcaaataaaactctcaataaatgccaactgaagagatggagaaaaaaaatttcctgaacattcttttcacttacttcactacaaacttcatgtttcctaggtcagaagttatccacatttagaatatcttaagtcacaacatagatatatttggtacattccacatgctaaacactgtacaactggcaattctcaaaaaataggtaaaagaaatgtaagaaatggtagactcagtttagcctcccaagaattggaaggacatctacagtctgtgcttaattgtctataaatgaccaaacaaccttccctttgtttactcatttttttatattcttgaaaatgttatttgcagcttttttctttcaagaatggaaacatctaattgcaaatcattttcctatccattaaaatataaatattattttgcaagaatatgggtagagatgttttaatgacaaacagcaaagtatagcaacgaatattcaataggtattctgccacctactggagtttttcaagaaactgtttaagttcactttaacttacagaagtattgagagatccaagtgtttaacaatcaaaatatgatcagtttgagtatcagctatttatttgtagataaagagtaatatatggtaatatgtaactagaaactatgtaactagaaattgttaatacggataaaaaaagaatgtttaattttataaaattgaaaagtttaggaatgagttttattgcaatcttttctctgcaaatgaagtttttttctactagtggatattttaaagggactattttataattccaaaacgtctagtttcaaatgcttcagagaattttgtaacttaagtttcatatagagtagtctccccttatccacgattttgctttctgtggtttcggttactcacggtcaaccacagtctgattacaggtgagtacagtacaataagatattttgagagaaagagacagacatatcacatttacatcacttttattacagtgcactgttataattgttctatttgcagttattgtttatctcttgctgtccctgatttataaatagaactttatcataggtatatatgtataggaaaaaacagtgtatagaggtgtctatactatccatggtttcagacgttcactgggggtcttggaacgtatgtcccatgggtaagagggaactactatattttctaattctatacatttcttattgcttatctgtcctgtcattctgcccttgaatattacacacacaaaaaaatcaagctgacaaaaagctattagactactttttactactaaaatgaagaaaattaattttatgaatctggctcacactgaaagaatatttattaacactaccaatcagagatccaatgacagaaacactgtctggaatacaaaaagaacaaaaaatgaggtcatttgaattgccctgaaaaactccaaattcttcaagatggtgtacttgtatctatattctgaagtactagtgttttaattttaactaaaaattaaataagagtttgtttttttttttttgagacggagtctttctctgtcacccatgctggagtgcagtggcacaatcttggctcattgtaacctccacctcccaggttcaagcaatgctcctgcctcagcctcccgagtagctaggattacaggcgcacaccaccacgccaggctaatttttgtatttttagtagagatggggtttcaccaaactgctggccatgctggtcttgaactcctgacatcaggtgatatgcccgccttggcctcccaaagtgctgggattacaggcatgagccacagcacctggccgtaaatgagagtttttatgtgcaagtaaaggcagttaaataactttcagtaataaaatgcatcacaatatttcacaggtttaaaacacaacctggttacctttttgaataaaataacatttggaagaaggcatagctacttttaaaagctattctatgctttccttgtgtttgaaatttcaagaaaaaataaaatgataaatcacaaaattaaaaatgccaaattcaagttaattcctataattcttccattttgttatgaatattctgtaatatcaaacattcatttttaatgtgctaaaaatatgggtttacaaaatatgaacaggtaatttttaaagagtaaattatgttaagaactttattattttcgattcattttatagggtagtaaaataatacttcttcaaaatcatttaaatgttattgatgccattgcaaaatcattataaataaattttctccattatccaatcacatctagataacattgaatatgtacaggtttctctggataggtaccaaaaggtaccacattttatacagacttaattgtgaaagctgggtgaaataaattttcagatcaaaattttttttaagtttaaatcattcactctttaaatttcagacagtgtcagtgtgactcttacttttaaaggaaaaaaattagtttaaaatttaatagccacagatttaataattttttactttaacacttaatgtacattttcatgagcagtaattaagatatgttgaaattttaaatgtgaaagatttcaaagtttcagtatgttaacattactcttcaaatgttcttaatatatatataaacacttacaaattatagatacaactagttgtatatctacaatacatatatgaacaccattcttcttctctagccatatttatatgaggataaagtaataaatctctgtgctattcaaggaaaaaaaatgaatgctttaaaaaataaatctttaaagaatagtttcaaaaataaagttcaaatattgcacaaaataatttaactgtaaatattactacatagtgtaaaacaattttaaaaaaatttttacactctacagtaaatcccactttctaattctataaaagaatttattggaagtccacattaaatgtttagatattaaatgcttacattcagtttgatgggaattcaattttcacaagttaactgagactttgtcttaaaagttcatctatttgagttttgtacatattttttacatcttcgagatctaatcgaagttcttctgcctcttctgctttttctccatacatctgcagaatagtgttgtacctttgatccaaatcctgaaaaatgtatttgtttacaatttttaaaataactacacagaacatctttaatatttatattgccataggagtcaacaatgaaaacactacaatttaaataaaagtatatactcatctcttttaaaaattaaactcacacttcagtctatgttgaactaaatagcaaaaaaaggaattaaagaaaaaaaccaagctagatggctatcaattttaccctatctctccactaaatctacaattctccccatatatgacttctctcccattaatgtaagcacacttgatataaaatttagtctctttgttccatggtggtataagtattacccggcatttagcccacaccacaggaaagatcaaaagaaaacatattctcacttatggcttaacagtgtcttctaacatccagatgagacaattgtgatgatacatataacaacaatcaacaaaatattactaagatcatacaaagttcaatgttataaatgaagtgtagccaaatgaaatctagttcttttcctatactgggactaaacatgattgtgaaaattactttgaatatgtaaagatacaagcaagataaaagattcatttttaaacttctttgctcaaatattagtactctttaattttcaaataaatcactaacacatactataaattaaaaacatgagatttaaagtaaatgaactaaaatatcttagactcatccttaggtgaagaatacttactcttagctgagttctaagtttgggtatctccttcaccttctcttcaagttcatcattttgatttgttaatttaactagttcttcagccattattgatcgagttttttctagattgccaatttctagctgagaagcattaccacaaaatagtttaaatcaaaacatatcttttttaatactcccagtaatataaaaatatttaatgtgtgtgtggttttttttttttttttgaaatagacatgtcaacatataaccttgagctagctctttcttaagtaaaggaaacagtggcagaaaaacggtcccaactttcctgagaggtataccgtttataaggtttactgtgcaacagagataaatccaattatttgtttgaaaacattcaaccatatatttttctaatctaaggaaatgacatatatttcagttattctaaattactacaagaacccagagaaataaaaatatactttaacgtagccccacctgtgtaggttgtatcgacagaggctttcatcactaccaaagaaattaattaggtccctgtatagcataccagctatacaaacatctgggattcagattagtctgatctactttttgccaattcaagttctttaatattttcatataactaaaagtatataatgggagttgaatttttacctacttctgagtgtattgtgtttaacactgaaaagaggtatcctgattcaaaatgcttgagaccaggaatgtttcaaatttctttttttttttttttttttttcagattatggaataattgcattatgtacttactggttgagcatcccaaatctggaaatccaaaatgctcaattgagcttttcctttgagcagcatgtcagcactcaaagttttggatttgggggcatttcagatttcagagctgggatgctcaaacctgtaaaacatttcaatatttctgactgcataaagttttttaaaagccaaaaaggtaagatggaaggatgctccatcaacaactcatgttgtttcctcccatgtacagggtgttacagttcaaacatctcatcccctttacccctccttcccggggtagctggaacaacttatctaagaggtaaatctgaatagaacaggcattcacagctcagtgacttccctttattctgttgggaaagagctgcttgaaaggaggagggattctctgctcctagatgcttatgtcttatgtaggcaggttgtaaaacatgggaggcctgctccagcccagcatttcctgtgacagatcagccgaatatgcctaattctggcaattagcaggttcagttggctgttatccttagctaatttctctttttagcctttatcattgatatatgtgatacattttgggcttcacatgccactatgtcatcttgtttctcaatttgctcagaattcagatggaaatgaagggtgctatttattaggcctcaaaacttcatttacttctatagcaaatttaatttttccaatacctgtaaatgagtgatttccccttcccttagctttagctgagactgtaggttttcaattatgcttgatcctgctcccatccttacagcatcataaagattgcttccatttgctgatataggcattggtccaaatgagtgatcatgagactcatcctatgttaattaagaaagttcacacagttactcagttatcatagcttgtcttccattaccaggttcgaacaaaaatggttctgtcaatttttgctttaaatgtcttctcaaaggcagaaaatcattcacgtgtttcctctcactaaaattagcactcctccacaagtattcagatgaattacccatagaatggcaaggtcatgatgacagacaatattgccatttgcatatttcctttattattattctaagaactaagcacatataaaaaataaaacatcacctgagacagaaaagatgtctgtagtcctgccatatcaacaccacttattgaacttgagcgtgacatggtgggagtgctagaaacagaaaatggcttgcgttccttagggagtaaaaaaaattctgttcatattaaagagcaaagagataagcagagaaagcaagaacatttcctagggttaatgagaacaaagattcagtcttttaaaaaagccacactacaaaggaattcaatacaatcaaaagaagaaaaaaaacttttttaagattcattctaatttccccataaaatggcttcttaagtcaaaaatacaatatttggccaggcatggtggcttatgcctgtaatcccagcactttgggaggccaaggagggtggatcacctgaggttgggagatcaagaccaacttgactaacatggaaaaacctcgtctctactaaaaatacaaaattagctgggcgtggtggcgcatgcctgtaatcccagctactcgggaggctgaggcagaatcgcttgaacctgggaggtgaggttgcggtgagccgagatagcggtggaggtggcggtgagctgagatagcaccactacactccagcctgggcaataagagtaaaactcagtctccaaaacaaacaaacaaaaaaaaagtacaatatttactaattaaaactgtagctagacttggttagatcatcacagaacccatttattacaacaatgtaatttgttgggtttttataatagaataagaatgtttctgttaagcttcatattatacaatatactatcaattaaacctatttctgtaacataaaattactaatgagtgttacaaatcataaaatttctggcttatccattttatttttaatgtattcttaaaattccaaataaattcaataggtaatttaaatttacctatcggtagtttaaatatattatgctaactccaagtacacggtaattctttcaatacagaaaactcatttttatttatttatttatttttatttttttgagaaagagtctcgatctgttgcccaggctggaatgcagtgatgcgatctcggctcactgcagcctccgcctcccgggttcaagcaattctcccacctctgcctcccgagtagctgggattacaggcacatgccaccatgcccggctaatttttgtatttttagtagagatggggttttgccatgttggccaggctggtcttgaactcttagcctcaagtgatccacctacctcagcctctcaaagtgctgggattacagatgtgagtccccatgctcagcctcagaaaactcatttcagaaaaattaccctcattaaccagaaagaaaacaagccagacttactccttaagtgcctatagaccaaatgatgtgcactggtttcagtgacagacaattaaattcatttttaaaaagggcaagaggttttatatttcaagtcctagaaatcatagatctctttggataaactcaaaattactttgggtccactctgagcaggacactgattataatactagaattcatcactatgttgattttagacattaaaaaaatgatacttataaagcagggatgtccaatcttttggttccctgggcctcatttgaagaacaagaattgtcttgggccacacataaaatatactaacaatagctgatgaactaaaaaaaaaaaaaaaaatcatgaaaaaaatctcatgatgatttaagaaagtttgcaaatttgtgttgggcttcattcaaaatcatcctgggccacatgccaaccagggccacaggttggacaagcttgttataaagcatagctaaaattaaaaagcaatgattaatcacagcatctactaaatggttacaccacaaacaaacaaaaacaaaattcaataccttttcttttattgtttcttgagtaaaaatggctttcttcctttcttgttcaactttcattctttccatttctaactgactattcaacaatgtctaatagagagaaataaagttagacaatttctgtgatagtaattcatgccatgataagtcaatctcaaagttagaagcataaagtataaactcatatttgttttcctactaaagaccaagttccaaaagcagtggcatcacccatttcatcttgttatctcattaatttgctgccatccccaaccattctctaatgtatgccctaagagctgagtggtcacgaagagaaataccttttctttcctcgtctcttcaagtgttcttacatattcatcttttaggttttccaattcaacctggtacctattaaacaaggcagaatttaaaaaaacagaaaatgaaaaagatgctagtatagactattaaaaactcagtactttattaactccagctacatattgagaaatcatttttattaccagcttgacatcagtgattttccaacagtgtgttccagatcccatctgagtttcactcagaaaccaaaccaaaagtgaaaaagctccacttctgtgcattttatttattggtgctctgggttaagatttcatttaaaaagagactttataaaaataattttgagtaccatcatcctataatatgctcagattccacaaagcttattagggagttctatgaaaatgtttctaaaagttcagatattttactttagaaatcatttttacttgacatttttttaaaaagtaaaatttccaaggaagaacagagggttaaaaaatactaaccattgccttaatataatctcagatagatggattttacaccccatggtttccaagaacccagaaatttatttagaaaagacttaaattatactactaaaatccttgtaatataaaagtaactccaaagagtagtctcaaaactattttgtggtgttataggcccctttaaaaaatctgattaaaggtacaaatcctttccctggaaaaaaaaataaatacaaaacatgccacacaatctcaacaatctacatgacaatgaatcccagtactatcttcttgttataatatcctattactttatttatttttttttttttggagacggagtctcgctctgctgcccgggctggggtgcaatggtgcaatctcactgcaacctctgcctcccaggttcaagcaattctcctgcctcagcctcccgagtagctggaattacaggcgtctgccaccatgcctggctaatttttgtatttttagtagacacagggtttcaccatgttggccaggctggtcttgaactcctaacctcaggtgatccacctgcctcagcctcccaaagtgctggataacaggcatgagccacagcacccggccataatatcctattactaataaccctaactttaaatgctaaaagtgattacatttagttcttggtaccctgaagctaaaagccaacgacatactttgtttatttacttatttaatttatttttttttttttgagaccgagtctcactctgtcacccaggctggagtgcagtggtgggatcttggctcactgcaacttccgcctcccgggtgtaagcgattctcatgcctcagcctccgagctgctgggattacaggcgcacaccatcacacctggctaattttatttttaggagagagtaggtttcgccatgttggccaggctggtctccacctcctgacctcaagtgatccgcccgccttggcctcccaatgtgctgggattacaggcgtgagccacggcgcccggcccaacaacatacttttaaaaagtgctttaggatgtcacggaactaccaaaaatatcactcagaaaccatgctcacctattgttctcatcctccagtttacacagcctatttttctctgattctagctgggcttgaaatctactgttttcctgtcttaaaagagaattctgtgactccatggaagacatctgaattttgttagcaaggagttcttctgtagctgcacgttctctctcaactgctgctgccagcaaggtctgggattcacctgattacaggacagaaaaaaaaatcacatacacatacagcccagagaccaaaataccaagtcaattctgatttcaaacatttaatgatgcaagtagccacacttaaaactgataactatttattgcctaaggcaggactgtctactgagacaaatgaaccaatcttaacttatacctgctttatcactcttttccaaaagtattttaatttcaaaatggagtcatgcattaaaagagtagtggatcaccaacaccaaatggtcctggagcaactggacagctatatgcaaaaaaaccaaaaagcctacacatcacatcattcacgaaaattaactcaaaatggatcatagacttatatgtaaaacatgaaactataaaacttttaggaaaaaacagaggagaaagtcttcaggatctagaacaaggcagatttgacacaaaaagcaagagccatagaaagaaaaactgacaaactgcttcaaaattttcaacttttaaatctatgtgaagaggatgaaaaggcaaactacagagtgagagcaaataaatgcaaaccatatatctaggattagtatcaggaatatataacaatctagttagaaaatgggtaaacgacatagacagaaatttcaccatagagaatgtacaaatggaaaataaggacataaaatgatgttcaataacattagccattagggaaaaaatacaaattaaaatcataatgagatatcactacatgctgtctgagtaactaaaagaaaaaacagggacgacataaaatgttggcaagggtgtgaagaaaccacattactcttacacagccactttgtaaacagtttggcattttcttaaaaacactaaacatgacctggcaattgcacacttgggcatttatctagagaaatgaaaacttaggttcacactaaaacctgtacatgaatattcacagtagctttatctgtaatagccagagcttggaatcagcctggacgtcccttgtgcagtgaatggttaaatatacgtggtacatactatggaataacactcagcaataaaaagactaaactaccgatacaaaaacaactgtgtgaacctcttcctgggaattacactgagtgaaaaaagccaaacccaaaatgtcatacactgtataattttatttatgtaacatttttgaaatgacagaattttagaaacagaggacagattagtgattgccagagatttgggacaagggaggaagggttgagagagtggtaggtgtgtttccaaaagggtaacattaagagtgattattttcagctaagaaaaaaagaaaaaaagctaacaggaaggactcaatagtgttggaactgttcaatatcttgactatggtaatggatatgtggtatagttgtttagaacttaatacacacacacacacacacatacacaaatgagtaccaataaaactttggaaatctgaataaaatcagtagattgtatcaatgtcaataccatggttgtgatattatacattaattttgtaagattttaatacttggagatattaggcaatgtgtacaaaggacctttctatattatttcttataactgcacatgaatctacattatatcaacaaaaattttcaattgaaaaaaagagcaatgggtaagattctgagatttaacctaggtaagaattcttgtattttttctccaccaaagtagagctagtaatacctctatttcacattttacactctgctccacagcatagctatggtctttttaatagcattccttggtatgtttgtcctgtggctttgcctatatgctagcacaataccacatattgctgagggtatgtagacttcagtctaaaaaccacaaaagtaccagtttctagcattcatttattgctaaatatttatttcaaaagatatcattttcagatgtctcatatttcacagcacattgctctcaaaagctgtcagagataaacgacagacctaacatttatacctataaatttaaatatatatgaaggtttatctaattcagttcatttttttaagtaaatgaatctttttctagaccaaatctttcatggaactccaattaaaaaaagatagacaaaggaggccctattttcattaaagcagctagagaagcccagcctcttatttatcaagcttccctctcaccatgacagcagccccaaaggtatctaagagtccactgaatactatttgaaagtcactaatctagttcacccccccgattcacaaggaatagcacagagatagttggaacaatataagtgacttgttccacactgttttgctggatgattcaaaacagaataccctgagtccatgtctcctgactcatatttaggtctgattttatcactacactgtgatttctcaaattacatttagtgtcaggcgtagaaggcatacatgaatttttcatgaatttgctagcttctgggatacctataatatacatacactagctgtctgtgcttgaagggaaacattttagaataatacttttctttttattaacatcacagaagggcaacctggggcatgactgtaaagaagcagaatatggaatctttttttttttttttgagatgcagtctcgctctgtcacccaggctggagtgctgtagcgcaatctcagctcactgcagcctctgcttcccaggttcaagggattctttgcctcagcctcccaaatagctgggattacaggcatgcgccatgacacccagctgatttttgtatttttggtagagacgggggtctcatcatgttggccaggctggtcttgaactcctggcgtcaagtgatccacccgcctaggcctcccaaagtgctaggattacaggtgtgagccaccgcgccctgccagaatatggaatcttaagactccctagtatgtctcttctaaggtcgatcttgactctccttagacctattttcgctcttggaattctaccagtgatgagaatcatatatgatctctacctcctacactactgcagacaagctacaaaggggtcagatttagcaatggacaagaaaaaaaaatcgagtgcagcagtctactaaaaatacaaaaaattagccaggcatggtggcagacgcctgtaatcccagctactcaggaggctgaggcaggagaattgtgtgaacctgggaggcggagcttgcagtgagccgagatcgcgccactgcactccagcctcagtgaaagagtgagactccatctcaaaaaaaaaaaaaaaaaaagaactgaatgaaagaatgacatggaagtactttagccagtatctgataccattgtgtaatgggaaaaaatggtttgaaagagacataataaaggtattaaaaatacatgtagaaaaagagaaaatgtaaaaatctacatattagacacaaaatgtaactatcagatcaaatgaatttcaatttcataccattattctaattctataaacaagatggaagagcttctgcatcgagcataaaaactaaagcagttaccaagcctatcagaaagattcttctctaatttctcccacgacgatgtctgggatcccagggttgcttgcaaattttctatttgtcgaagcaatggtcttgttgttgatgaaacactttgactcagttcctggtttcgattctctgcttcctggagtctctgaatcatgaaattctgaagtcattaccaatgacagcaataaaaacattaaaaacactagcaaacctgaactttgagaggttcctggaaaattatttttccaagagaaaataatttgctttttaattattattattaattttagaaacggggtcccgctctgtcacccaggctggagtgcagtggcacaatcgtggctcactgtagcctcaacctcctaggctcaagcgatcctcccagctgggactacaggtacacgccaccacacctggctaatttttgtatttttttgtagagacgaggtttcatcatgttgctcaggctggcctcgaactcctgagcaggcaatctgactgcctcagcctcccaaagcattgggattataggcatgaaccaccatgcccagcccttaattatttttctaactgttcaatccttccaagagagttagattgtgtaatacagtatctaaataagtacttctttggccaggcacggtggctcatgtgtgtaatcccagcactttgggaggctgaggtgggtggatcacctgaagtcaggagttcaagaccagcctggccaacatggtgaaacctcatctctactaaaaatacaaaaattagctgggcatggtggtgcacgcctgtaatcccagctacttgggaggctgaggcaggagaatcgcttgaacccaggaggcagagggtgcagtgagccaagattgtgccactgcactcctgcctgggcaacagagcaagactctgtctcaaaataaagaaattaaataaataaataaataagtgcttctttaaaaagcgtttctaagatagtcttcaattacctgaaggttaaaaaagagttcatccaaacctcttagtagttacctcctcatccaaatatttctaagtatttataaaaactgaaaaatcaacctaaattgtattttctctcccttttcctctgcatgttataaatgactgaaaattaacagaggcatagaaaccgggaactattacctgtcccacagtaatcaaagactgacaatcattaataagcgattacaaatggaaaagcaatactgaatacatataacaaatctatcataacattattttctataaaacaaaataaggaatttccttgtataatttttaaggtgcccactctgatttattcacacaagccacaaaaattcagcaaatgctaggtgtgacagtaatcctctcaattccatgaacactatcccactgaggaattcttttatttctagaaaaacacatacttcttggatttgtgttttggaaacctgtgacagtacctgctgaagttcaccgatctcatggcgtaaataatcctcctttctggcagccgcttgttctgtacgctgcaatgcaagcctaaggtcccccacctgtaggaggagaaacaatacattcacaaacaatggtacagtattatctataacttcccactaactacatattttgtgttgtgtcaacattgttcatgtatactatttcatactctccaatgaacttttacatatgattatcacatctctcattcatcaagcaattctaaaactgtatgtatattcaatgtttacttagaaaagcattctgttaaggcaaagaaacgcaaacaaatatgtataaggcatagccattaccatacaatattggagaaaagacagtgcgtctataaatatttgccacatcacacagaaagtgataggtgctatacggattataaaagctgggggctccactcatatgcaggagcatacattataaactaccatagcctttttggaaaacgttataatatgtttaaagaatcatcaaacttctcacatcctttcaccgggccatcctagtcttgggaattcactctaagaaagcagatacgtaaatacacagggatattccctacagtattaaataggctagcaaaaacaaaactggaaatattctaaatctccatcactagtaatctatagttgcaaatgtcgatacaacatgaatataaccattaaaaattacaataaatgtataaaacatgtaaaaaaaatttctaatatactattaaatggaaaaactataaaataacacgtaagacatcaattatgaaaaacacatatatgggaatagaatgaaacactaacacacaaaactgacagtacttggaaaaagtgatggatttatgcatggtaactcatatatgctctatctcccattcccccaatttttctgtattattattattctaacgtattttaaatttaaattactgatattttatctatcccagcagaaacacaaaggatatatggaccatggcatgacttataatagcaaaatactgaaaataacccaaatatccatcaataagaaatagctgaaaatacttcacctaataaagtattataaaactgtaaagagatattttttaaaaacctctatgttttactagagtgatcatcaggatattttactaagtaaataaaacaagttataaaacagtataaacaataaactatcatttacgtaaaaaggatgtaggagatagaaataggtgtataatctatcaataagaaagagctgaaaatccttcacctaatgaagtattataaaactgtaaaaagatattttttaaaaacctctatgttttactagagtgatcatcaggatattttactaagaaaataaaacaagttataaaacagtgtgaataataaactgtcatttatgtaaaaaggatgtaggagacagaaataggtgtataagcgaatgtgtatgtacgcagaacatgtaagtatatagatacatatattttcttgcattttgccaatagaaacactgaaaagataagccaaactctaataaaatggttacctacaggcaaagagaggaaatggggagcagctaaattggaagtaaatgtctgaatagattttgctctcactttggaatcatgtaaatgttttacacatacaaaacttaaaattaaatcaaaagggcataggagtcaataaaaatagttttctcaacaactggtcctgcaacaactggatatccacatgcaaaagacctaaatgtgagagctaagactacaaaactcttagaagaaaactgatgaagatctgcataaacttggattaagcaatggtttcttaaatatgatgccaaaagcacaaataacaaaagaaaacatagataagctagactttgttaaaattaaaaccttttggcatcaaaggacactatcaagaaaaagaaagacaacccacagagaggcacaaaatattgacaaatcctatatctgataaaggtctagtatgcagattatacaaagaactcataataacaataaaaagacaaaccgcccaatttaaaaatgtgcaaaggatttgaatattttaattaatttctcccaagaagatacataaatggccaataagcaaatgaaaagacatccaacatcattagtcattaagagaatgcaaatcagccgggcgtagtggctcacgcctgtaatccccgcactttgggaggccaaggcaggcggatcacgaggtcaggagattgagaccatcctggctaacacgctgaaaccccatgtctactaaaaatacaaaaaaaaattagcagggtggccgggcatggtggctcatgcctgtaatccaagcactttgggaggcggaggcgggtggatcaccagaggtcaggagttcaacaccagcctggccaacatggtgaagcctcgtctctactaaaaaaaaacaaaaattagccgggcatggtggtgggcacctgtaatcccagctactcgggaggctgaagcaggagaatcacttgcacctgggaggtggaggttgcaatgagccgagattgcgctattgcactccagcctgggcaacaagagcgaaactctgtctcacaaaaaaagaaaattagccaggcatggtagcacctgcctgtagtcccagctactcaggaggctgaggcagaagaattgcttgaatccgggaggcagaggttgcagtgagctgagatcgtgccactgtgctccagtctggcaagagtgagactctgtctcaaaaaatatatataaattgaaaaaaaaaaatgcaaatcaacaccatactcagttaccacttcacacacactaaaaaggctatacttttaaaaacagacaataataaatcttggcaaggatgtggagaaactgaaaccctcacctattgctggtgggaatgtaaagtaatgcagccactgtggaaaagtttgccagttcctcaaaaagttaaatatatagagttaccatatgacctaaggatatatatctaggagaatttaaaatatatgttcacacaaaaatttgtgcatggatatttaaagcagcattattgataataaccacaaagtataaataacccatatgcccatcaactgatgatttgataagacaaagcctcacaaattttgtttttcctacttcatctgaggtccttggactcccacagatgttatgaatgagctcaggagttaaatggattctctcaaaattatatgcaatatgtatgtgcatttttgctcttctcttctaagagggttcctagcttttataatactctcaaatgggtctaaaactcaaaaaaattaaacaatactggtatcacgtaagcattactttaacagttttaaaaaacacaactggttaaatttagcagaatccagtactctgaaatctaacacatgtatcactacattgtttgattcaaaccagctaattgtttaatttgtagaagcataaacaaatatttttaaaactactctaattcatcatccattgcttacttgaatggctaatgtttcttgctgctgacgggcttcttcttgggccttctctaatgctgcagaaagttcttctttagctttcatttcacggctcagagcagcttcctgtgcctcactatcctttgcagcattggctttgtgaagatcagtaagttctcttaaaaaattagattgagtttataaatgttgccagtgatcagataatagaaaaagtatttcttcaacatcctactctgataattcattctaaatgggttgcatatttgttcattttcttacttgtatgcactatccagggcagcctgaatacttcggttcttttcttcaagttcatccatgtctacctgaagacggccaagatctttctcttggcgttctaccatggaatttagttttttaatattttctctatgttgtttctcaacctcttctttgccatcaaggacctatatgttataaaaacagacaaaagtatttttcaagaaataataccatggtaaataactgtattccaggaatctataataatggagaaaaatatatatttttttgagacaaagtctcgctctattgcccagggtggaatgttctggctcactgcaacctctgcctcccagcttcaggcaattttcgtgccttagcctcccaagtagctgggactacagatgtgcaccaccacgcccggctaatttttgtattaggttggtgcagtatttttagcagagacagggtttcgccttgttgaccgggctgatctcaaactcctggcctcaagtgatctgcctgtcgcagcctccgaaagtgttgggattacaggcgtgagccaccccactcggctaaaaaatcttatcatttatctattgtttgaaaaatccttcttacatgatataccccattaaatcttttcaaatgctccataaccatggccaactgttcatacaggaagtaataacaatatatatgtagagaattatgattgctattcacctgtttcaaatgctgcaactcctcttctagctctttaacttttttgttcagctttgcaaccatattttcattctccttgtctttagctcttaatttcttgatgatgttagaattgtgcagctgctgttttgaaagtttttctcctggtgatggtaaagaagtataaactcaaatgataactattccctaaaaatctcaatagaatgttttatctaatagtaacataaaagaacagaatttttttaaattacaattttgtaacccacaatgttacaactaatttggacagcaatcatcaatgaatgttaaaattattgggtaaaaggttgttgggaactggatattgacacggtcttaaagaatcactctcatatatcacctactaattttaaagagaaaaatctggcagtcaactccttaactaagcattcagttttggcatcaccaattgtagtacagcctgacaatatgtgtctgctgatgtgatatagttgttcaatatcacccagatatttcctactagaaatatgaactaaatctaatttaaatctcatcatgaagaaagtaacaaattcccgaacatgggtgggacatcctgtgggacaactgccctagactctacagagtcctcaaagacataaagaagagagaactgtcctagactgatggaagactaaaaggacataacaatcaaatgcaatgggcaaactttggatcctggggcagaacaaatgatcaattataacagacacttttagagacaactaggattaatattaaaatatatgctggattacacttctgaattaatgctgatttcttaggtttgactatgatgtacctgtcaaggaaaacgtacttgcccttgggagatgtagactgaagaatttaggagcagaatgttacggtatttgtaacctcctttcaaatgagttgacaaaagggtagtgtatgtatgtgcagaaagatatggaagagttgtggcaagatgttaacacctgatgaatctaggtgatgaagtaatcaggtattcattgtagtgtgctttcagctttgagttttacagctctttagctttaagttttaaaaatactggccgggtgcagtggctcacgcctgtaatcccagcacttttgggaagcaggcggatcaccagaggtcaggagttcaagaccagcctggccaacatggtgaaaccccatctctactaaaaatacaaaaactagctaggcgtggtggcaggtagctatagtctcagctattcgggaggctgaggcaggagaattgcttgaacctgggaggcggaggttgcagtgagccgggatcatgccactgtactccagcctggacaacacagtgagactctgtttcaaaaaaaaaaaaaaaatttttctggggcacgcggaaacaatatataatacccttttgtgaaatgtaaatactctgtgaatataaaatactcccatgtgaaattgctctattttctctgtaaaaaggttcattaagcaaaagaagacatcagttcattctctgacaaaattattaaattacaaaataataacattcgatattaatatttcaaataactcttttaaaataagaaaaccatgcagttagccttcccctcagtctctgatattgtaaggcaaggcagttaatgacttcaagacatcttgagaaaataattataacaacagttccttcatttttctattttagtgcttagaattgtgttttatcattatctgtgttcctatatttccctctcactgaactaagcccctaaaggacagagtgtcatacttattattgtatcaaacatagtatctgacatactaaccgttcaataaatattagttgaataaatgaaaaagttggataaagctaactttcaaatgaaatgactgcttccaactgttctcaaacgctaccctttctctggaaatttacttaagttcagtgatttaagcacaaaaacattcatcctaccactaactatattattaacattataaaaataaatgtacaacactagaaatagtaaaacatattatggtatacccatataatggactttaatacagccactaataatgataaaaagcatttaatggcatagagagatgtaagagaaggaagattggaaattaaatatatgatcttaaatatgtttaaaaatgcattaaaaaatacattaaaactagaaaaaattaatagttccttataatattggattataatctacttttcctctttattcatatactttcctataacttcaaaactttctacaagtagcaagtattactcttataactacaaaaactttaattaacaagagaaataaaaagagagattcacttgaccacgttttccaaaggctcctctctcccaggatattacatgaagaaattaattcagtatccatttgtaatgatttatttcatgaatagatctttaatttctgtaatgctattaattttattttatttatttatttttttgagacaaagtctcactctgtcgcccaggctgcagtacagtggcgtgatcttggctcactgcaacctccacctcccaggctcaagcaatcctcctgcctcagcctcctgagtagctgggattagaggcacgcaccaccaccacccggctaatttttgtatttttagtagagacggggtttcaccatgttggccaggcttgtctcgaactcctgaccttaaatgatccacccacctctgcctccccaagtgctgagattacagtcataagccaccacactcagccaaccctgtttattttaaatcttttcagagacaaaagtgcttaataatttaaaaattaatacaatgaaaaattcactatcaaatgtcagaaaaagacaatatcatacagtacttaagctaggtattcagatattacataaatcccagagttacacactttgaatgtcttggtttaaatgacaggctcttaagacctgtttaaagttttcttagggcagcacaaatttctgtctattttacagggacttacttttctttttacttccaaaaaacaaaagctagaaacacgtatctctgtctcaatatatcttattcctcattcttccataaactgtcacctatttctatggtttacgtccaaaccctccttgctttcagtatttttaattaggaagcatcagctagttatgtggcaagtacttttcctgttcttacagtatttttcatagtcaaccaaatactatacgcaccttcttccattaaccctcggatctgctcatctttctctttcaaaaggtctgcagtttcactactatttaatctagtggcaagttcttcttttatgtttttgatttcctaataaaaaagaaatctgtgaataccgtaaagaatgactttcactctaagtacagttctcatttctcccccatccaaagaagctgtccataatcacatttgcaataagaatctgtaagttttgttcagttaatctactaccttggttaactaagactaagaaaacaactttgaaaatgatattcaaaacctaaattcagatatacaagcaagtgttaatatgaaaatataaatgagaataaattaactttccttttcatttttatttttattttttgagacagggtcttactctgtcacccaggctggagtagtggtacaatgacgactcaccacagcctcaacctcccaggctcaggtgatcctcccacctcagcttcccgagtagttgggaccacacgcatgtaccaccatggccagctaatctttgtattttttgtagagatgaggtctcgccatgttgcccaggctggtcttgaactcctgggctcaagcgatccaccctcttcggcctcctgagtagctgtgaccacaggcgcacaccagcatgaccagctaactttatgtattttttagtagaggcagggtctcaccatgttacccaggctgctctctaactcctgggctcaagtgatccgcccacttcagcctcccagtgtgctgggattatagacatgagccaccacacgtggccaaaaatctacaatttaaatgttaatagatgatatccttttcaccttacttctcttttttccaatatcaaaatacgatgaatgcactcctcaaaaatctatatctctatagagtttaattaatattactttaaatttcaattacctttttagcagcatctctctctttgcaggctagttgaactttcttttctgcttctgcaattctttgagtaaactcatctttcaaggaagaaatgctactgctttcttctttcactctgaacatttcactaaatttaaaataatatttgagaatgaggatggtgtctatatatcccaaaggtatacatgagttcaattctcaaaaggaagataacttttctctgacatataccttattaaaatagaacagttttaggcctattaacttttaagaaaaaaaaaggaaatttcccttgttaaatttattttaaaacacctcaaagaaaatctgttagaaagagaaaatgtcaccaatatctgacatgtaaaaataagagaagagtaaatacaatgtttcaattctgaatcttcttgtatcacattttcccaatcagctccttatagcacaactgtgttattgattaacacagttttcttcaaatacgttttaaatctctaatactaaaagactaaaaacgaaaggaaagagttttccagttttgcaaaatgactctcttcaatggcaaagggtaaagacaatcaaaagagaaaagtaatctttagggttataattgaaagctatacaactttcaataatgataaaattacaaaacattttaatttcaaaaacattcttaaatatgtacaaagtatacaggtttccagaaaatgtgtaacattattcacatttgcagaatacttactctttcaggttatcaaaagcttcttctagaagtgctttttccttactaagagataataactgagcctcccttttttccagcttttcattcagaaattcaactgtctggataaggcgaatacataaaagtcagaacgcttagctttaaaaaagaccatttttacatgcaggtgtatcactgtaacaaagaaaacagctttatctcataaaaacaatcaagaacagtattaggaacacagaagatccagaacaagaagaactcttaggcagctgagaggagagtaaaagtaaatacaaccaaatagctagtgggagtgtaagttgagaaaccccttgagaaaacaattaggcaatatctagttggggatctacatactctttgatatagaaaatttcacttttaggtataccttagaggagaaaattcttgcataaatgcactaggcgacatgtataagaatactttatgtagcttcctggtaatagcaaaaatctggaataatctgcatacacaccaaaagaagaagggagatggatgcaatcaaaagaggtcaaagaggaaatttaaagcctctatattttagctaggtggtggatacacaagtgtctattttctgtattattctttacccgaaacacataccctttttaaaatatgacatattgcatttaaaaaataaaagtaggccaggcgcagtggctcatgcctgtaatcccagcactttgggaggctgaggtggggggatcacctgaggtcaggaatttgagagcagcctggccaacacggtgaaaaccagtctctactgaaaatacaaaaattagctgggcatggtggcaggcacctgtaatcccagctactcaggaggctgaggctggagaatcgcttgaacccaggaggtggaggttgcagtgagccaagattctgcaatgatcttgcactccagcctgggtgacaagagtgaaactccatctcaaaaagtaaaaataaataaataaataaaagtagaggccgggcatggtggctcatgcctgtaatcccagcactttggtaggctgaggagggcagatcacttgaggtcaggagttcaagaccagcctgaccaacacggtgaaaccccatctctacaaaaaatacaaaaattagccaggcatggtagcatacgtctgtagtcccagctacttgggaggctgaggcagaagaatcacttgaacctgggaggcagactagcctgggcaacagggcaagactccgcctcaaaaaataaataaataaaataaaataaaagtagggctggacacgggttcatgcttataatcccagcactgtgggaggccaagatgggaagaccgcttgagcccaggagttcaagaccagcctggcagcatagtgagacctcatctctactaaaaatcaaaaaaatagccaggcgtggtgcgagcctatggtcccagctactagagcggattaggtgggaggactgcttgagcccaggaggtcaaggctgccgtgagccatgatcgcaccactgcacaccagcctgagcaacaaagagagaccctgtgagccgcgatcgcaccactgcacgctagcctggacaatagagagagaccctgtctcattcatacatacatccatccacactaaaagtaattttagaaaacccataagaatttttaaatctccataatgtatcagtataaagctaaacaaaaagtaatgcttggaatgtctaattccttaggtcctactcaaatggtgataaacttgagtataaaaggagtaggaagggttcctttttggactcaaaaaaatagtcttacctgagtttggtttagatgaacttagaaatcacttaccttcttaaatacactgaaattcaaaaatatctgatagtaattagtgctggtttctaagaattcaaactcctattatatatcttacagtatatagctattactaattgaaatattattgcacagcattttgtttgtgaatatttaacctgattaacagaatctggcacttttttaaaaaattaagtaattcaatacatggcacttacaggacatttcttcaagacatcctacatctcagaagtctattaaagataccagatccaactaaatttgtatatctaaaagtcacagtaaaaaccaaaactaggacttaatgtcaaagaatttatatcactttcctttcacatgtattaggtagaagcaatctgtccctcctaagcaatgcttttgttccttagacatttctctttctcgttcatgtgaaatatagctatcaataggagatctcaaaaataacataagcagaaaacaaactgaagcaatataaggatatatactccttatatatgaatgaaaatactaataacagaaaagcaccaataattaaaatcttaaattatcatttaatatttgctacaaataatgtaaacatgtaaaaacaaattctgatacaagaaaaaccataacatttagtttttttggcacatctatctgcaaaggaggtgaagatacatgttaatgtaagaaaatattcctttcaaattgacatactaataagcataacagaattttgaagtgataaggactcaaaaataaagatgtaagatgaaaactttcatgcttaactgtattgaagtatcaacttattctaccataattgccttggagaaattccaaattatattaataattgttcaacttcaaggtacttaatgctacacagaaatggcaaaatgcgtatgtttttaaatctgtataaattattatgcatcaatgaaagtattttttaaaacaaatgatttaatctccaaaaagcacatctaaaaatcccttccacttactagagttaccttgcaaacatcttccttctcagaaagtgcttctggctgactttcagcaggttcacactgctcagccaccttgtctaacacagtctgtccttcatttattggtgtggaagaaaccaagatatcaggctgttcacagttaacaggagttgcacttcgtccactttcttccatttctgcttcctcagtgggtataactaatgtttcatttacttcttcagattttccttcagcagattcaactgttttagactttggagttgaagaattaactataataggcactaaagcatatcccttgcctgacaattcatcatctgaattgatttcacttacactccggctatctaatgactgtacactaaatgagtctattctttcaaaagcatcagatgaacagcaactctcagtgagtttttggaaatcatctaaacgattatattcaggacaagcagatgcagagagaagctgaaaagatgtctgcatcaagtgaagacttgattttgaatctgtagtctcttgtctcgagctcgctgagctctcacttattacactttcatgatctaaaacttcaatatcactggtggtagaagtacctgatgaaaaggtactaacaggaggagaaggtgtattgctctgcctgtcttcatgtttttgttccttaggttccaaagctatgtcctttgtttctgctgtgagagactgcgtagacgtattagatatactttccatagttgttttcacatcaattacactttcagatactttcaaacttacagttggcaccttcatatccgattctttattaacagtttcttcgtgcttgccttcagttttaggtgatgaagtacctgctgccagagtttcccctgaaacacacaaagaagagtcttttacttgtgattcagttgtttcaggagttcttgactggccaatgtgcaaggattcatgtaagctgcttttcacttcttcttctggtcgttgtgattttgctggaggttttgataccactggactcttctgaatggtctggacatcagttggcgagagaaaggcactgaagaaattttcagattcatcgaccacagtcctccgaactggctttgtgattgctttaggagaggctattggtggactctgaggttcagtgtttgatttcaacccccaggttgaagtatcccatcctccactgacaggggaacttattcctttaacaaaaaagtaaatattaaaaaagaacacatatatgttacattaatatttcaatcatcattataaatcagtataaatataaatttagaaaaaataccctatgaaatacctgtaatttgcacctgctaaactccttgcttactacatcattaagtagtttccaagttaatacagggacttacggaagaaaactggtgtgggtccacctgagaggaaggaggagcacagacaaaagactgggcctggcctggactaccagatgcgagtatgttattcctccccacaacaaattaaggaagtaacagtatatgttttataacccacagtaagtccaagatacctatgattcatctcataataacacgctttacttatcaatatgaaataaactaatatggaactaactgaataggttgggccatgtgcagtcacagaaaaatgaccctacctattcagtcagtttcatattaatttttacttgtaatatcagtaatatagttatgagctagacaaagggcaacactcaaaaactgaactcagtgggtatggaggttcacacctataatcccaacactagaagagtcatttgagtccaggagttcaagacaagcctgggcaacatagtgagacccctgtccctacaaaaaaatttttttaattagctgggcctggtggcccacatatgtggtcccagctactcaggaggctgaggtgggaagatcatctgagcccaggaggtggaagctgcagtgagccatgatcaaaccactgcacttcagcctgggtgacagatcgagaacctgtctcgaaaacaaacaaaacaacaaaagcctcaaaccaagataatggtgacaaatgttctttcccgaagatcatattaaactgatgggaatggtaagttctagagaacaaattcattttcatccacttaatcacaggctgattctctaaatcccactctccaagcccactctaagaggaagttttgttctcaaattctaaattatgtcagaaattacaaggtcattataaatttcagaaatgtgtgtttttttaagaactattgctctttgacatagaggtggttgacactagggtttttaaaaaagcgctacaaagaaaatgactgttttcttggggaaaaagttaattatcatatcagtcatacaaatagctactactaaaatcctgatttttaaaaatggcataatcaggatcttaaaaatggtatattcgttaaagtatttaaagcatttctttaaaaatgttttctttttcaaattaaaatgtggctgaacaaaatattcacaaaatattcacaattagaagttggtggagagagcacaagtaactaaaagcttctaaaaactatcaagccttatagtagaatctatcctttaatatgacttcaggccaggcgcagtggctcacgcttgtaatctcagcactttgggaggccgaggcgggcggaccacctgaggtcaggagttcaagaccagcctggccaacatggtaaaaccctgtctctactaaaattacaaaaattaggcaggtgtggtgacgcaaacctgcaatcccagctactcgggaggttgaggcacgagaatcacttgagctcaggagacagaatctgcagtgaacagagatggcaccactgcactccagcctggatgacagagtgagactgtgtctcaaaaaaaaaaaaaacaaaaaaacaaatatatatatatgtaaatatatgtatgacttcaaaggcagttaggatgaaaagtatgtagaaaacttcagtttggaggcatagttctacacattcatttgcacaatatccaaaccagagaaaatcaaaattaaatatgcaaatgaacaaccaagattatgtctgattaatttaaatacattcaaaagatgacaggaattaattttgcctcttggagaatactttatataatcccagggttatttggtatccatctaaattataccattctgaagactatgggcattttccgaaaacaaatatccttatatgtaaaacctatattctatcttatctaaagtttagtaattctaattaactggggcacatatgaaaaaacagagttactccagcaaggttatatgacatcttgtaaaaagtaaagaggatcatcacatacacacatggaccaaaatatcttaaactgaggtacctcaaatttaggtcctgacttttcaatgatgtaaaattaagaacagaaaccagaaaggagtagtcaagtacatctcttatcctttttcacacaaaggttcacatcccccaacaccagcaaatctttaccccacacatcaaatgctgaactgttccttagacttaagagtcaaaagcaactgaatgaagatccctgaaagattaagctcaatgaaactgcaaagagagacttggctattcagaaataaaatgtgataccatccagaaatcttgggtcacacattttccggctaatacctccggcacattctaatcctcctccgccgtgtgacctagagcaagttacttggccattctgggcctcattttcctcttatgtaaaacacggatataaaccaagctctctctgggagttgttctgaagatgagaaggccataaaaaagcacattacaggctcgtgcctgtaatcccagcactttaggaggccgaggtgggtggatcgccttaagtcaggagttccaccagcctggccaacatagtgaaaccccgtccctactaaaaatacaaaaagttgccgggcgtggtggtgggcgcctgtaatcccagctactagggaggctggggaaggagaatcgctagaacctgggaggcggaggttgcagtgagccgagatcgcgccactgcactccagcctgggcgacggagtgagactccgtctcaacaacaacataaaaccacattacgcgctaccaagcgcgaaatgttcactgactgttagcgattgttcttcccttccctgatgatttacgtacttcagaccttggatcccaacagtgcccgagacgcgaagcaattcgaggttcaggttcgggaaggttgtgcttggaagctgcgtcgagggagagcttgagggcaagaccaaccaaccaagtcccctgtcatccaagtccacaagcctcgcacccaggaccaaagaaagacaagggggaacctggatctgggttttccctcaggaaaacagcaaagaccgacttggaggctgaagcagcattagggaacgggccggggagaaattacttcctgaaaactctctcagcaaggaaggacccctctctacaccacttaacctgcctgcatcaagagaacagcagcctccgggagccaggaaccccgctcctctctctcttacccggctctccatacggaatggtctcggcccagatgctcggctcctcttcctggatgtccagaaccctgtcaatagacttctgggcctgggacagggcctgcttagcgaagctggagagctgggaggcgttgaaccaactcatcgcccctcctcagccggcagtggcggcggcagcaccaagcgggaaggcctcaggcctggggaagggtgcagaggaacggcttcgctccccttttccactcggctggttctgtcagcgtgtggccattaccccgacagcctcccgcgagcccgggatgttaccctcggccgttcccgcacagctgagacgaagggggcccatgtgcgcatgcgcttgcttcttccacgtacacagcaaccaaatctacgagcccagagttcggtcgacagacggaagaacagaagaacgttgacgtcacatccgggagcgcagggttgccgttagttaccgaggaacgcggaagggtttctattgatgtcgatttcgtgcttacagcagttcttagcgaaggggaagctatggctaccgatagaggtcgatttccccggaaggaatattcaagttttcgtgtgtgtgctttccaggaaaatagttcacgtgctaaaagcttgcaccttgccagcaataattgcaaagggaaattgggcctcacacttctcttagccctttgtctcaaatatttaataagctctgtattaacttggtattgtaaggagaaacacttgtttgggcttgcctaaaagacaggatcacgtatgaacactgtgtccaactcgtggaacacatggtgcataaagcacaacctctctctcaaaatagtagtaaactcattgctgcagtcaaaatacccctaatactgtggtctgtcggtgtcccctgcacaaattcctatgttgaaacctaatctccaatgggacagtattaaggggagcctttaggagatgattagatgatgatggagccctcataaatggggttagtgcccttataagagaggcccaagggagctcacggcaagaaggcaccaactctaagccagaatagcagccctcaccagacaccaaatctgccggctccttatcttggacttctcagcctctagaactgttaagaaacaaattgctactgcttataagccacccagtttatggcaatttgttacagcagtccaaatggactaagacacctaggaagcactaaagctgttatcctaacaatgtgcactgtgcatattacttaaaacataaccttttctgtgtgcattctcttcgaacatttggacatgggaaaataccttaaattggtggccttcctaatccagtctgcagctatatttggtttgggcccaagttaaagacaaaatcctaactaaaagccagatttcattcaaaaatctagatttccagctgcttttgaaaaatatgaataccaagcatgggaatagtcagccagagtggtcaccaaataattttcactcactccagtttgccacagacccctatcactcatcctattacaccctccctgctgtgattatttaccttatatgcctgcctcccatatttgaatattttaccccactgcaaggaactctgcaaaaaagaattatttttcttttaaaaaatcagattgaaccccttaagaagttataatcatcttccaataattttatctaactacagtaaaaacttgcatgttaaaactaacaatttagtcatgtacacaagtagtaccaagtaactcaagtactttcaaacagctaagtagtctgcagaggagatttggggcagattcgggttgaaattagctgtacagttacagttccaagacttctaattgtacagctttggtgaaatgacctacctaaaccatctaaaactatttattcagctctcagatagagtcaccttcttacaatgctactttgagaattattatagcacctatatggtgctaaattttagttccttcactttcaaaattgtaagctacacctgtaacttttcaggtagagcttataaatttattccgtatggttttataataaaacttatttgtcaatatgtagctagaaagattactgaaaacttaactcagtgacacataagtaaccaaaaaacatttgaacagaaaactgccatatctaagtcaaaaacaaagaatgagaacacatacatgttctcatattaaaatactagcacctacttttttagtatttgtacttaattttgtttgaagttttattcacttaaaagaaacaaaaacatggtcaggcatggtggctcatgcctgtaatcccagcactttgggaagccgaggggggcgggggggggtggatcacctgaggtcaggagtttgagaccagcctggccaacgtggtgaaaccccgtccctactaaaaatacaaaaaattagccgtgcatggtggcaggcgcctgtaatcccagttactccggaggctgaggcaggagaattgcctgaaccggggaggcagaggttgcagtgagctgaggttgcatcatcgcactccagcctgggcaacaagagcgaaactctgtcgcaaaaaaaaaaaaaaaaaaaattatattgatacagaaagttaaattaaaccagtaaatttttactatagaaattgctgtagcaaaagtattaagtgcaataaaaatttgatataactctgctacacatttaaaaattattcctatattaccatggaactactgattacccttaatgtacttttaaaaacttcagtgaaagaagtacacaatatatgattttattaataaatagtgcaaaagcatcagtgataactgtttgaacattaaattttttaaacagccatgtcttggcattagttaatattgtgcatattggcctctatggcactacaagtaaacagatgaaaatattgcccattttcatgcacaggtattcagctataacaccatttacaaatcattatgaacaagataaattctgcaataatattcatttggatggccacaattaaatgagtgttatatcaagaaatagcctatgttcaatatactccagatgtcagattgtaaaatgtaatgttatttaaaacttaattctttattttccttaaagggacaccttttgtgtatttgggtactcaaatgaaaacttaggaatgcattctttgaccataataacaaaattcacacaaaagaggttgtatgcttcctcctctaaaagaagcaatacatttgctcataatctctctctccaggtatcatttctcatattattaatgaaaatgcttacaagcaccaacaccaaaattctgtcttcaagggaaggttacaaagttaaaaaagagtggttcattatataaaaaaagacaaatcgtggcaacactattgctaaaaatgacatcgattcaacttcttagcatccacaaagtatattatttccatgagttttctattatgtggagattttccttaagaagtaaaatgaagtttgaatagtacagtctgtggggtggtgacatcagcaaccgccagttcttgtccatcaacaagccccaattctaaaacagaaaaaatattattaatacaagcaaaaaaaactcaacagaaaggataatacacatgtaaacaaactacagagtattacggtctagaaaaacatcaaaatccaatcctctttaatcaaagtaatatttgatttcttagagattttaaaatattctactaaaagagcaattaattctattaatatgtctaaagttgtaagtaattattacctgaccatatacaaggcattaagaggaaatctagaacaagcactgattactttcaccaaaaagagagaaaagaaagaaaatgattagtaaatacccttatgtaaaatacctttcaatgttttggagagatttggccttgttcgttcttcaatagaggttaccgactagaaaacaaaattactttaatgtaagacacattaaagtaaaataaaacttgatataattttctgaaaaaaatttaaaatacacattgataacctgtaagtaaagtgttctattttttccctctagggtggctgtgatggctggagatttcatttgcctaaagattatgatgagagagaagtatcaaacataatttttatcaaaagataatttttttaaggtttcaaaaatcacaaaaatgatttttacaacataacaaaaatctacaatacttacagagaagcactattggttagataatccaaaacctcctgtagtttagctgatggagaaaactgaatattttgaggaagctggctacaagctgggcagttttcctacacacataatacacaacaaattacagcagcacatgcaccaatattagtctcttttatgaacaataaaataaaaatcaggttgttttataatcatgcatatttcctataaaaaaatttttatgctttaaagcctgcttttcataatagaccatttcttgtaaattacttcgctatagagttatttcaggctataaagcaaaagatatataataagtagagttctggaagttagaaaatgtatgggtgactttgttcaaatttctaaccaataatatttaaaaatcaaaatatgcatgatcaaaaatgtgttcttaatactactaacctttctttctgcttcaaatgtgtatgtatacagcccatctacatcattaaacaccaagtaattattcaagggaatgtatgcactgtaatgaaaaaatgttcatctttatataattaaaccaagtcaaaacataaatttacatgcatattaaaaatgaaacctattaccttgtggctattttaaaaacctcagtggcacacacagctgaagggaggagaaaatacaggtgctttaactcaatggaaattaggcatgttaaaagtcagttataaatcagaacagataaatttacattggctcttcattaaaaaatacatattccaatttttaaaaactgagacagtaacaaattttacattgttttgtgtgattcatgtaatagagtaacactacatgtttttcttgtttatcagattaataaatggcctgcttcatatggaactaaaacgtctctttactgcaggtaacttaagacataatgtaagacaaaaaatatgcaaagtctaataactggttctttttcgacagcttagttacacaacccatccaagaagatatcaaattcctacaacacaaaaaagctgcagcaacgtcaaaaactaaagaaagcaaaataaactaagtgatggccttttcttcctcacctgcaatgactgcatttgtggaagctactgcaggaatgattctttttactacccctgaaaaaacatatcaattaaaatatggtcatttctttaaaataaaagagttctcttaaattagaaggcatgattattaaataccattttctaaaacttgatttttcagactttcaagccagaaaataaatttaaccatgaaacaatctttcacatccccatcactttgtagtaaattcagaatcttaagctacagtagcaaagaaaactctctcaagtaagtgctatagaaaggtgaaacaataacatcataatagttaacaatttagagtattatgttccaggcacaatgtaaagactaaatattatttaattttcacaacatcttcatgttaattactctgattttaaacataagaaaagtgagactgagagaaatttagtaatttatccacagctatatacttagcaagaggtggggttggcatatgaacacagatattaactgatacaccatgaagaataagtgttatctaattattcctgtaacagcttcagtcacttgattcacaaacattcaaaaaaaagaaaagctgccctttattatcttttactctacaaccgaggctacacaaaatattaaatacagttctctacttcaaccccacatttttctttttttttttttttttttgagacagagtctcgctctgtcgcccaggctggagtgcagtgtcgtgatctgatctcggctcactgcaagctccgccttctgggttcacgccattctcctgcctcagcctcccaagtagctgggactacaggggcccgccaccacgcctggctaattttttgtatttttagtagagatggggtttcaccgtgttagccacgatggtctcgatatcctgaccttgtgatccgcccgccctggcctcccaaagtgctgggactcacatttttcacatcagtattattcacatattaggaataaacaaagcctcaccttaaaccattttttaaaagtacaaaataaatactccattttataactatatttgaattgttcattttagaagacaaaaacttcaagaaaaagtagccattttatctcacagtgtgaggaaacactgtaagatgtgttcccaagactccaagtatagtcaggtttcaaaaacttaaggaaaaacagcaagtagctaagaagacatgaaagaaagacagttacgaaggctggaaagcttttttaaaaagttgactgtgaccatatgattctctatagttttggagaagaggaaatttaaaaagagataaactgcatgatggttaaactggaagctctccactgaaccacatgtagcaggatgtactgaaaggaggaagtggtagacacaaacagtgaagcgtgtaagagacactgcccagtaagaacattgccaaaatgatgaggactcccctctttctccaacccctgccacccatacccctgcccttcgaccaaaaaaagctagagtgggcagaaaggcaactttctgttatactgagaacaaggggaaaaatcatagaatagatagaaccactggcttgtgcaacttcacttccaattctccttctgtactccttgttgaggccctcattcaccagcctagaaagtacacaccaagccctggtaaaaggtaaagaaggatggatgagactacatattaaaatggggagtttacagtttctggttagaacacactgaattcgtttgttaattctaacaattagcaaatatgtgtaacacatgctccagacactgttctaggtgttgtgcatagtaacaatgaaaaaaagtatctgctcgtatagtgatttcattttgataggggagataacacaaaagtaaatacttggaacacctcagatattgaagagttctatgaagaaaatgaggtatgtgttagactgagaatgatggatgcagtccattagagagaatggtcagggaaggcctccttggagaggtgataacttgagctgaaacctaagccatgagagagatccagccatgcaattacctgaagaaaaagctgtttgtaaacagcaatggcaatggtcctggtcctggggcaaggatgtaagatagtttaagtgtgaaatattctttgcataggagaatgaggctaccattaatcagttctgagcaattaccaaaaaaaatagaatggtgaatggctcagaagtcattttaggttgaatgattaggaaaactggttaagcagacacctaagagatgaggagccagcctgaggggatccaaggaaacaccatccccggcgtaggaactcgggagtattaaagctctaaggtacagaagaacttggtgtgttcaaggaacacaaagcaggtccgtgtagggagaatgcagagggcaacaaggagtaagtataaatggaattttaaaatgacattactagatcagtaaatgtaaggaaataatcacaggagagaaatggcagattttcaaaaagaagacaaagctcattctggtgaacctggtaatgatcttgggcaaaattctaaaaaaggaaactataactagattggaaacattgatcactatgattgagcatgactggttactagacaaatcatgttggagtagcctcatttggctactatgactaacttagcaactcaggaaaatgcaaaagatagcatacctaggcttcagtagaggatctggaaaggtttttcatgacatccttgtgaacaagataaagaaatacaaagtaccaagaaggtctgatgaacagaatgagataaacctaaaagggcctggccagaagtatgattcagatgtctgttctcagagagttcagtcttattaaaaattttcatcaattatttgaaaaagaaataaaggatataattatcaaaacaggtgaaatgaagctagaaacaccaggtaagttggcagaatacatataaagagagaaaaacaggttgaattttaagaatacatttgtaaggacctatacttggatattaagaaaaacaaaaaaaaaaagacactccccaaactgccaagtttataataggcagatgtggcttagcaattgcatatgtggacaaaacatccagctttcagtggctagtaacatcaaagaatccaaagtatagcatcaatgtaaacaaaaaaacaacaacataaatacctgctctcctttaagactgcatcagttatcagaagtctattatctaaagttaagaccagtcccataatgctgcatgttggcctgaacaattaggaaaagttgttttctctaactatattccagttaaccaatatggatagctggaatatggttacagaaaaacaacatgagaacctgaagctgtacaacatatcaaagggttggatatagtttggatatctgtcccctccaaatctcatactgaaatgtgatccccagtgttggaggtgaggcctagtgggaggtgtttggaccgttagggcagatcccacatgcatggcttggtgccctccctgtgatattaagttcacgcaagagctggttattaaaagaagcctggtattccctcctctctctcttgctccctctcgtcatatgacatgccttgccatcccccttagctttcacgagtaaaagcttcctgaggtctcaccagaagccaagcagatgcttttgccatgctcacacagcctgcagaaccatgagccaaataaacctctttcctgaataaattacccagtttcagatattcctttatagcaaagcaaaatgaactaatacagggttaaaggaactaactagggaggtttatggcactgataaaaatttgcaaaggatgtgatcactgtcctcaatatgttaaaagctattacttaaaagggaattagactgtatacagtactgggacaacagtcagaccaaactgaagacgatttctattttgagacgaagttttgctcttgttgcccaggctggaaagcagtggcgcaatctcaggctcactgcaacctcagcctcctgggttcaagtgattctcctgcctcagcttcctgagtagctgggattacaggcatgtgccaccacacccagctaattttgtatttttagtagagacagggtgttgccatgttggtcagactgctctcgaactcctgacctcaggtgatccgcctgcctcggcctcccgaagtgctaggattgcaggtataagccaccgcagctgacctgaagacaatttctgttcaatatatagaatatttgtctaacagtcctgtccaaatgtgaaatagactgtctctaagagatgatgaattcagtggaagataaaatggacagtttgacttggatgacttatagcctaagtaagtaagattcaataattttattaaattccccctagctaataagtagtatgaattacatggtacctttactgaacttcaagtggatggtactgtctaaactcacttatcgattattctcctgaaagcatcccagccctaagtcatcccaacatcataattcatgacaatttgctgacttaccttgagtgagcctatacgtaacacccctaatattatattgtgatgctctctctagggatttttggaaaatccattgtatatgttcaggatcatctccatctaatggaaccccttctgtttaaaaaaaaaaagggagagagagagagagagaagacaggaatacgtaatcacaaaacaatgtttttaatgaaattatccaaaggaataatatagaaaaaatatgtattttatgtaattctagattattaaattaggtttattacctccaaaaggctgctccttaggccactgcaacatccttacatactcaatacagtgttctggtagcctgggcatagatgcaatggtgcacatgggaaaattaacctaaaaccacagtttgtccttttcagtgaattttaaacgaattattttaaaatgcaacttccagttatgatctagttcttaacaatttcatacaatttgtttcaactcaaaatattgtataccattaaaaatgcctctcaaactataatacagattaactgagtcacttcacttaggctgcactgcctgtaaagacaggtttgccctacatttacaaggtataaaatttaagctttgttagactatgagaagaaaaatactgaacagattttctcaaatatgaacaccttgttatttttacctaatatttaagtataaagcaaaccaaaacaaaagcaagttcagagttaagtgaatcccaagtgaatactcataaaattgtttacatttattattcaaaatttcaagtgttctttaaagtggatatgtaaaccaaaaagccccatccttggaaagatcattcttatccctggtatctttatttccctgaaataaatacaggtgaaaaccacatagattacagcttgacatcaatatacaactttgtaattctacttgatacctactccccaaataaaaaatacaaataaattatgaaagcagaatagtatcaaaacaatgtactcggttcatatctttcctcaaatagagcagaatttcatattttatctttcttcttagtgtaatttttaaaatacggccacttctaattaacaatcctaaatattaactagacttaataattaatccctaattccatgccaagatactataaaagaaatgcaggtgcttttttgattacctgtggtggataaagttccagcgtgcattcgatacaagcagtcattccaggcagaatcacccgggcatttcctttaaaaccttctgtccccccatctatcaaagggacaatggagcttggatctaagacaccatcttcataatttagaagagatatctaggaaaacaatttgaagggctttaaaggagaaggggataagaattcaaaagaagaagtatgctttcaagtaatcctatgagtcggttgtgctattgaataccaatgtatcaaatcaagggattataataacaatttgtgtcttcacctgaaaaccaatgactggcaataaacaatgaagtaaatatacttaattaaaaattaaactctgatttttcaaaaatatatcaattctaattttggggatgtgaagcacagcagcaagaacttcagagaactataacaatactaaagtctttaccagcatgccatttatccatcttctggcgatgatagagtccagtccacatacaataatatgaaattctacaaaaaaaaaaaaaagcaactttagtttttaaatatgtagttgcatgatgatctttcaatgtagattcatcaactgcaacaaatgtaccactctggtgcaagatgttgattaggaaggtagtgtgtttgtgggaacaggaagctctatgagaacccaagttttcaaaaattttctgttcaattttgttgtgaacataaaactgccctaaaaaataaagtttactaattaaaaaaaaaaagcacttgcagaaaacaatttgcacgttctaagaaaccaacaaaaaaaccacaagcactttttactgtaatcccacatacgttctcagagctccaattccttgagtgaactctcattcaggtaagcatagaaacttgtagctggtcatgtcagctaaaactagcattctcttttcagtctatcagcaacattactgaaaagccaacagtgagagaggaaagcaagtgaagaaatagccttgaaatagctagcaatatttgaatagctaccaactaaaaaattctaagaatctagtgagcattaatttcaagtaaaaaacttacgtcgatagaaagtgtcgttaaaatcttgaatcttgttgaaatgtctgaatacaagtaaaggaacttaagcagctaagttttaatttctaaaatgaatttgacaatgccataaggaacacactctgcatatatttacaacaagaaataagtaatcaatgttcacatcagtggaattcaaggaatctgactaaatgaacacaactctcctttctgacaaaacttttctgccattcctcccctaactacttactttttctcattcctgaacccctatatcattatatttatgcccttggtaggaggtatactttctactttgctttggtttttatataaaaccataagccccaggaaagcagaatgtgtgtcctcaatcatcagcatcaagaagagatgcaataaatgttttagtgaaggaaagatgcacattatagttcctattttgctaggtgattttaagagttactgcaaagctcatttttttaacatacagaaaatttcaacagctttttcagttggtaaagattttactgtttttattttttgtggggaggagaaaaagtacgaattttttctacctttctcatttaactcagttttcaagttaccctaccaaatcctattaccagtcttcccatccctggaggctaaaaaggaaactccattcaaaactgattgtgggtgagtcaatatagcacttaatgttttaatagcacatgtgtgcaaaaacttgttttaatttttctaatgaatggagcaattgtttaataatttataaattatgcaacttctctaaagttaagataaatagtccactataaattttttaaaagcaatacagagaaaaaagggacaatacatagaaaaaagggacaatacatgcttcctctagatttttaattcttgcctacaaataaagctatgaacaataatttcaattctagccctcagtcattcagacctctattccctttgaatgctaggcaagcaggagaacgaagctacagctagaaagaggtcaaaaaagaaacaaagcaaacagtggaggaatggcaatcagggaaccaagagccagactaagaaatctaatctggatttctagaaaatacccaaagtttcccagacccacataatggggatagacaaactgagtgccccccactaaccaacccacccccaccaactcttcctttttccctacaggggcctgtatttgcatttttaagctctttattttgaaataatatagattcgcagtaagttgcacagatagtataggtaggtaccatgcacctttcccagttacatcttactatagtacagtaccaaaaccatgaacagaacattggtacaatgtgtgtttataattctgtcatttaaacacacatagatttgtgtaaccaccaccccaggcaacacacataactattcgaccacaataaagatctctctgcagcctccacatcctgggcttaactgatcttcctgcctcagcctcccacatagctgggactacaggcatgtgccaccatgcccgggtaatttttctagtttttacagaaatagggtctcatttgttgcctaggctgttctcaaacaaccaggctcaagtgatcttcccgcctcagcctcccaaagtgctggaattacaggcctgaaccaccacacccagccatctctataattctgtaatttcaagagtattatataaacagaatcatgcagtatatgaccttttgagactggctttttttttttagtctaatagttgtgtaacagtatcgctcatggtggtcttagtttgatgtgaaacatcttttcatgtgcttttcgtcatcctttttagtaaaatatctcttcctatcttttgtctattttctaattgaatttttttttgttttactgttgagtttttagagttcattatatactctagatatgagtcctccatcagatgctttacaagtattttctccagtctgtggcttttcttcatccgtttaagagggtctttcacacagcaagtttttaattttgatgaagttcagtgtatcaattttttccttttatggctcatgcttttacaaaaaattattttaattttttagagatgatgtctcactacattgcccaggctggaatgcagtggctattcacagtatgaccacagcctactatagcttcaaactcctagtctcaagcaatcctcccaccttagcctcccaagcagccaggactctgtagtggtatgataaaagctcactgcttcctcagtgatctgcaccaccataccccaccttttacaggtcttgcttttgacgtggcctaagcactctccaccaaaccctaaagttctatcgttttatggttttttgtgtttttttttgtttttttgagatggagccttgctctgtcgcccaggctggggtgcagtagcgcaatttcagctcactgcaacctcagcctcctagggtcaagcgattctcccacctcagcctcctgagtagctgggagccactgtgcccggctaatttttgtattcttagtagagacggggtttcaccatgttggccaggctggtctcgaactcctgacctcaagtgatccacccacctcggcctcccaaagtgctgggattacaggcatgagccaccacgcctggctcattttatattttatatttacacctataatccattttgagttaattttgtatgtttaggtcaaaattcatcttttaactatggatatgaaattgctccagtacgatttgttgaagactatgcttcttccattggaactgttttgcacctttatcaaaaacaaattggccatacttatatggggctatttctggcttccctattctgttctagtcatctatatatccctctggtaacgccactgagtctggattactatagctatataagtctagaatttggatagtgattcctcccactttctttttcagatttgtagtaggtattcctttgcttttctatataaaattttagaagatcgtctatatcgacaattttgctgggattttaatagaaactatggtatatatgtatacaaatttagggagaaatgacatctttactatatttaatcttccaatctttgaagatggactatctctccatttatttagattttctttggtttctttcatcagcattttgtagtttttcactatataaatctcttacttatcttgtagtttacatctaagtatttatttttctttctaagcagttgtaaatggcattgtattttacattaactttcacaagttcaccggtatgttgattttgtattctgtgggactttctacatagaaatcacatcttctgactttctataaaatgccaaaagttctccagatctaaattcaaactacagtgtaaatactcctttttaaaaacatatttcttgtaaaaataaatttactgtgatgtaccttccatttggctaatactatattgactgtctactctgtctgctactataaagaaacaaagattaattggatccagcctaggaatttacactctagtaaaggagatatgtaattgatactgaaattaagggcaataatgcaaaataaagtagatgatgaaacaggctttataaacttaagttaaaaatcagggcccaaaaaatatttatataaccatacagaaaagactggaagaatagatagcaaaatgttaccagcagttatctcagtaataaagttactactgctgactttttttccctcttgcttatctgtattctctgttaaatatctcttataataaaggaaaaaagcttttaaaaattaagtaattttctttttgtcaaaaggatacggaactacattgcaattaggaactctgtcatttagaaattctgcagcaacttcagccttaggtcttccaatatctttaggcctacaggaaaaatatttaaattataattcatattataaatctatatgatctacataacttattttcaaacataaaagtaaattcacagtaagtttacttataggaaatttagaaggaatatttttgcctaagtattttgatttcagtaataacttttggtaaacggtcatttaaccttaaatgtcaacccttgctaatggtccaaattaacataagtctaattaagtattgctttaattaagagaaaatctgaacagtgttcttcctcccagataaagcataataatgctatgattcctggccactttccactgtaaaaaattatcccactcttagagctcagaaccttatggtgttactccacaggtcttggctgaaatatacacaataagattcatccttgggatgcaagaaccttcatttaaccccttcttcctgtgtgtgctgattaagcagcaaattttgtgtcccctaagaagctgcatgaaaaagaaaaaaaaagaaaaaaaaaatttcactggaccgtatataaaatggaaaaaaaaaaaaaaaagaggctgtaaccacgtttttttcttttttctttttgagacggagtctcactcactctgtcacccaggctggagtgcagtggtgcgatctcggctcactgcaacctccgcctcccaggttcaagcaattctcatgcctcagtctctagggaggtgagattacaggtgcctgccaccacaaccagctagtttttgtatttttagttttgccatgttggtcaggctggtctcgaactcctgacctcaggtgatctgcccgcctcagcctcccaaaatgctgggattacaggcatgagccaccatgcccggcaccaagtttttaaagaaagaataataccaaaagtgtcagctaaaattgcaaatgttactattacatcacagaagctgaatatataaggcctcaaaaggtcactcttaaaacaataaccacacatatagataggaaaggatatgaatttcctcctctaagttctatacaaatggtattttctttcctaatatttccatattctcctcagagaaatcactccatgtatataataagaacattattacttttttcgtaacatatttgctacatacacgtctatcatacccactagactattatttggatgaaagtgaccatgttcttactctcttcatattccttcctacctagcacacagtaaatacttttaaaataaatgaaaataataaatcgtgtgcttattagaaaaaaatctgaaatttcaaagaaaaacactttagcatgtcaatttttcttttctttttttttgtttgtttgagacagagtctcgctctgtcacccacgctggagtgcagtggcacaatctcggctcactataacctctgcctcccagattcaaacaattctcctgtctcagcctccagagtgctgggactacgggcatgagtcactacgcctggctaatttttgtatttttagtagacacagggtttcaccgtgttggccgggctggtctcgaacttctgacctcaagtgatccgcccaccttagcctcccaatgtgctgtgattacaggcatgagccaccatgccaggccaattttttttctctccaataaagcactgttcttttttgattcaaaacttttggtaaatgttttatcttcactttgtactaacttacataaaaaaggccctgttataaatcaaagaacttaatttcagtattgcattcaatggctccacacacagaaagctcttttggtttgtaaaagggataaagtagacttctaagattattttaagtaatatattctatgtgcttttatggcacggcccaaacaaaagaactcctagatggtttctgggaactgtttgttaatttaccattccaggatgaaacaatcagattgctccacctcaataaaatggcctttcacacacatcatccttgcaggacactctgcccaaattatttaaccttgaacacaagaacctaccctgaggttgctgagattaaatggaataatatggatagtttagaagtacttgctacatatcgttattaccatcttcaaccattttagccacaaattaaagggtatggcctgtatcaataacaaatcaattcagtggtatctttttcagagaattcacaactcaaaatttgacaagctggacagagcccacaaactttgctatagagaagggaaatttcaaaggttaaaaaataaacaaaaaataaagcttaaaagttaaacattaagggtcacactgcaattacaacacttcattaacttattttaatccatacttcagtcccattaagatcttccacaaagataatgtagaggttttatgcctatccaaaaacttaatgttaccttttttgctagctcaactttatcctatatacccagaacaatttgagcactgtcagtaacagatgcaaacttcctaaatagagagagaaaaaaaaagtccttatctctgtgtatctttgactaacaaatatacacttttacctaaactactcaaacccctcaatattacatactaaattcatgaatgaacatttcttcatgtctggatacatggtctacttcagtttttgttttttgggttgttttgtttttgtttttgagacagggtctcgctctgttgcccaggctggagtacagtggcatgaacacagttcactgcagcctccagatcctgagctcaaacgatcctcctacctcagcttcccatgcagcagggaccacaggtgcacacccggctaattttttaatttttttgtagagacgaaatctccctttgttgcccaggctggtctggatctcctgggctcaagcaatcttctcacctcagcctcccagtgttgggattacaggtgtaagccaccatgcctggcctctacttctcttcttaaactcatctttaacaaatcactccttgatgttctctatattccatatatgcctaaggtaaccatccctctttgttccattccaattggttctggtttttctctcctcgactttccattttctttccccttgtaggaaaagctcaaactctttcccaactttattgctccagtcaccattcaaaccttggctcacaaatccctgccaatctctcactagggcctaatactccagcgagtattctcttctgacatcaactggaggaagagctaccgttctttcctttcttcagagcacagttaacctgaggatattcccaaaaatcacataaacctttggaaggagacttcttcgaaaaaacaaaaacatgtatttgtttacataactactatcaccaagatgcccaaaattttcttacaaaactttacctacaatgggaatggtagtttttgttttttaaaataaaattagtattatcctctcaagtcatttttaaaaattattaaactgcaatgtacaagttcaaatgattatcagagcttaaaaaaagaaaaccgctaagatattaaaacttacctaaataaaaactgcctatttagattggaaacatctatagtgtccatatctataacatgaatctgtctaaaaccagacaaggcctgtgggaataaaaacaatccaattaagcagaagtttcctcacatttaaaaacgtaacatttgttttcaatgtagtcttaagtctacaaattctcagtaataaattctgtgtaatttgtattcaatggctgaaagactcttgcaaggtatataaaattcagagttcttgaacaggtcaaaagtgtacaatcactcagtttcaaataatctataaccaaaagagaacaactcaaaatttctacggattgaaactattttacatatatatataattccataaacacatttgtaaaatttgttgctttgctgctattgatggatactttaattttactatgcttgctattattttttcaaaatattgttaaaagcaattctacaagctttattttagtttacttaatattaagcatgccacaattcagaaatggtaactattataagacatatattataaaaacacacacatgggtaggctgtatttgtaaaaggagtatcttaaaagatattgaatcaagagcatgcaatttaaaaagcagggaaaggcaaaaaacaaaaaacctgttaggtttccataataatgccatgcattctgaacagtacaaccacattcaaatttagcagcagatgcaaaaaactgaaaaaaataagtctcaataactaacttttctggtcttggtcagtttacttcgatgatcaaataacttgacaataatttcctcatttttctgtccccctatataccaagagatcttcaagacttatccatatttgtgctttcaaagtcctgactgttctcaaactccacagaaactgtacttgtcaagttcaccaataacctccgtgttgctaactccaatgaccaattctcaatctatctgaccttacctttctgaggtattaggctgggtgggtcacttcctccaccctaaaacatgttcttcagttggtcaccacactcatgagaatttaaacactttttaaaaattggtttccagttcattcagttttcttcctactttactggccagaattcggagtagccttgtgctttgttctggtgatctcagaccatcttgtaagatatagaccatctagcagacatctcagacttaacagtttccaaaaccaaacttgatcacccttgctcacaacaaccaaatctgttcttttccagatcttcctcattgcagtaacttcctcattgcagtaactccatctttccaggtgcccgcccctagagcaaaaaccttgttgtatcatcctcgattcctttctctcacagcacaccaccaatccatcagctaatcctgttgattccatcttcaaaatatatccataatctgaccacctgtcaccacatccaatgctaccatcctgtttcaagtcacgttgtctcttgtctagaggactataataatctaattagtctctctgtttcttccccctctctgctcttcccttagtctattctcaatgcatcagcctcagtaacctaggtgaaaagccaatcaagtctctcattgcataaatctctccaatgacttcatgactcagagtaaaagcgacagcacttacagtaacctccaaagtcttttgtgatatccactccaagcccctccatctcccattatctgtctgatatggtctccaaaaatgctcccccaacccacttctgctctagcgatgatagcctccttgcagtccttgaacaaacaggagtgctccacttcacagctttgtacctgttattctctctaactagaatattcttcctacagataactgtatggctcatttgctcacctttgtactcaatagcacctttttgtaaaccttttcccttcacaccatttgacatactatatacttactttttcattcaactaaaatgtgagtcccaccaatgcaaacacctttctgtatttgttcaatgctgtatcttcagcatctaaaatggtgcttggcatatgggatggaggctcaataaatatttgctcaatcagtaatattagtatctttttttttttttttttgagacggagtctcgctctgttgcccaggctggagtgcagtggtgtgatctcggctcactgcaagctctgcctcccgggttcacgccactctctcgcctcagcctcccgagtagctgggactacaggcacctgccaccacgcccggctaattttttgttttctgtattttttagtagagacggggtttcactgtgttagtcaggatagtctcgatctcctgaccttgtgatccgcctgcctcggcctcccaaagtgctgggattacaggtgtgagccaccatgcccagtctagtatcatattcttttttgttagaatgagcctttagggggcttacaatgaattaaataagcaaaacaaggagtaaaattgaaaacccttagttttcttcttttgtgtaaaagattactataatgcaataaagaagaggtcactccttaaagttgcttggtgactaatcttcagatctaatcttcaattattttacacttaaaattagtaaatgtcacatttgcaaataatggcttcaaaatttaataagctttaggaaacttgtacatttataatacctaacaaaaaccaatgcccatcctccataaaccctttccttctctaagtctttggttctcacactgctagagtatttatgtttgatacggtactgtcattttggcattccaccacagagtatatcatgcatactgctatttatttcatgtgagatttatctccccaatgaaacttcagattgattgaagacagagaccacgatgacatataatccccacagaacccagcaagacattaaatacagtgaagtatatttaagtttttacaacttcactcaagcgacattagtgtttcttaacaaaattaatgtggctatgtttatatttaaactttaacccccttggccaattatttgggtcctccatctggctgtgacctgctttattttctaaagagtctattccagcatttccacttttctacacagcagtgagaagcctagcatacaactctaaaccaattctgcctctactcatttgttacataaactcattaaaatttatagaaagcgactttgtgattagaaaaagtcaaggaaaccaattaattaaatcaaattatatacttaatttatttctaaatatatgcaaataagttcagtaaaggtttagctttcccaaaccttaggtgtccacaatcgtcttattaggtcataaaatgacctaatggttcactgaaaaagaacacttaactaagaactgatgacctggattcaattccaggcaaatcgctataatccacaaaaacttcagcaactcagtcaacatctctaaacctcaatgtctccctctatataaaatggggtaatgccttacccacctagctgggttatttggggaagcaaaagaaataataaattatttgaaactatacattaaaatatgaattgccagttttgttatttacttcattgaagttaggagcgttttgccagaggaagcaccaaaagttgtttgttaaagatcagagaagaaaactgaagtatgaaattttatcaataactttatagctgagagctttagaatttaaaaagttccaaagttctaccattttaattactgtttggaatttggcatgctaaacttatctaacaaaggctcaagagaaaaggttaagaatcacgagaaattccctagtatgacagataagtaaggtttacttatcacaaagaagaaaaaaatatttatatatatatgtatatatattaccagatttttcaggagctcacatcctaagccgccagctccaatgactagaactttacatgtatctaacaagaactggagagactgtaaagaatggaaaggcatattaaaagctgggtgataaccgcaaagactataaataaagcaacaaactttaaaatagtttctgatgtttccaggaaaaaatgccactaggataaagaggagactttgtatttgctcaattatttgaaatttgtgaattctattgaaccaggaattctaaaactctaatgatttcaggaagtttcaatgttaatttttcttttttttttcttttttttgagacggagtctcgctcttgtcacacaggctggagtgactgatgggatctcggctcactgcaacctccgcctcccagattcaggtgattctcctgcctcagcttctcgagtagctgggattataggtgtgcactaccacacctggctaattttttatttttagtagatacagggtttcaccatgtgggccagactggccttgaactcctgacctcaagtgatccgcccgcctcagcctcccaaagtttcttggattacaggcatgaggtgccgcgtccggccattaatgtttttaaattgccttttattgtatgaaagttaaagggtatttttaacaaggaaaactatctctaatttgttttttaatttttgcaaagggatagagaacatcaaattcagttaactgacttcctaaaaatataaaagtttaaaaatttaaaaaacagaggatcaagcactgcccaaagtgtttaaaggagtaaaacaataaggtaaaaagagtaacagggctgggcactgtggctcacacctgtaatcccagcactttgggaggctgaggtgggtggatcacctgaggtcaggaaagaccagcctgaccaacatggtgaaaccctgtctctactaaaaatataaaaaattagccaggtgtggtggtgggcgcctgtcatcccagctacttgggaggctgaggcaggagaatcacttgatcctgggaggcagaggttaccatgagccaagatcacaccattgcattccagcctgggcaacaaaagcaaaactccatctgcggcagatggaaggggaaagagtaacagctgcttttttttttcctttttgagacagggtctcactgtgtcacccaggctggagtgcagtggcatgatcagagctccctgcagcctccacctccaggtgcagtcaagcaatcctcccacctcaacctcctgagtagctgaaaccaaagacatgtatcatcatgcacagctaatttttttttcttttctttttttctttctttttttttttagagatgggttctctctatgttgcccagggtggtctggaactcttgggctcaagtgatcctcccgccttgacctcccaaagtgctgggattacaggcgtgagccaccttacctggccaacatctccttttgaataaagtgagcgaaactcacaaaacatgagataacacgaaaacatataaaactcttagaaaattccttatcagcagaaatacaatcatttaacagaagtaacaatcttaaattatcaggcaaaaaaaaaaatttagaagcacaagaaaatatggtgtgttatctaaagaaagacagaattaatactttcaattctttttcttttttttttttttatttttaatgctttcagttctgcccagcattaaaggagaaagttattcacatgagacactgggccaaaccaagagtttgcacgttaatttatgggagtaacacaatatttctatttcaaaatactatctttttataaatacaaaagcacataaagatgtgctatacttttccctaccctgtaataaaaaaaagtgacatataagtgaacacttgccttaagatagacactatcagtccaaaattctacgcctctattatttagtacttacataattcttaacatgcaattaattatactcaaagctaagatgttcattccaactaaatttcaaaatttaagtaagcacacctatactcctatcaaaattaatttctcacagtagcactacaaaaggggagtatgtttcagaaagcattttaaatttttacatgaggtcatgaagttagatttttctcacaaaaattttcaacttatattacatgagaaatgttaagactcaaatattcaaacaaaatcagttgtgaatattcaatctcatattttaagaaaaatttagtttcacaaaacaattttattagtattttcattgtaagagcaaattaaaaaagaagcattctattagttttgaaacataaaactattagagcagttatttaaaaataaacgtttctcacttcagtgctcggttcgaaatcagggtgtgtgaagggtccagatcgctcgaggaacttctttacatggttccagcgaccttcccagtctccagtgtccccacacccaccatcaacagccattctgcacagaacacagtaaattcagctgcaaagatcagtatgaaaaaaaccacacctacaactattatggtatccccaaatgaaaaggtaaccacaccagacctgctcaaataaaaaggaaaatattcaatgtgattatgtttatgctttgaaattttttcttgcctattatacaattcatttaaagttaagaactgcacgtttctatttttatttcacccaatggatgaaataaatcagtctacatgtttttggtttcctaaagcaatccaaggttcaacttaggatattggtctattatgtgagaaattgacttctctacatttggtatttacaaaaaaaacactgcaagcttcctcaatctgttgtttcatcacacttgcattaggaaatatgagatacaacagagaaaaaaagtcacactttcagaattctgatgcttatatgtctgatgcaaatttaatatttatgtgtcctttccaaaggtgtaatctaaaaatcactttgatgagaggaattttcacacacttttctcagaaataaggttattttttctttttctttttctttttttgtgacagagtctcactgtgttgcccaggctggagtgcagtggtgtgactgcagctcactgcagccttgccctcctgggctcaagtgattctcctgcctcagcctcccaagtagctgtgcctacaggtacatgccaccatacccagccaatttttgtatttttagtagagacgggtttcgccatgttgcacaggctggtctgaaactcctgagctcaagtaatccgtccacctcggcctcccaaagtgctgggattacaggcatgagccaccgaacctggcagaggtcttaattttttaaagaatctcttaatgctgtgggacggcttttcttgccactaaacacaaagtttcagattacaattacgccacagatagacatctacaaaccttttagaacatacaacagaataaggtgggactcctctacaaaattcatctattttatacttagttaagattcacgtttggttgtgattatttttaattttctaatttcctataactccacagtttctaccgtcaaatatattagtaatatccaatttttacaaaagggaccaagaagtattgcctagcaataaaaaccatacgttttgatgtcagagttgtgttgggttccacaattaacagcactgtgaccttgagcagattacttaatagacataaacctcatctgcaggccgttcatagctacttctttcagccatgaggatatagataatcacacagaagactcagtacagtacgtgggatatggtaagcaatgtttaattgtgatttcatgtaaaagtgggagggaaataaaaggcaggaaagaatgtgaaattaagtttgtcatcccggtcctcttgcagctgaaattcaactgagggacacacataaagatcaaagcactgctactgggaatcggcacggaaatttacaaactcaccataaccaatgcaagagtattttttccctgcccaggcagggaggggagtaaattatgtggcgctggccaggttagaaaacacttcgattaaatctgtctcaccagcatagaattaagcatctgataagaaatagggtgtgtagtaaaagggataaataggctgtttgaagtcaacaacctctttccagatcttttaagagccaattattctgccaaaatgactggagtgcttagtacaatacctgacatgtagagttatcattaaaagtttgcaattagtactactgtctcagtgtttgcaaaaggccacaaaacggtcttgtgtccttttcctgtgtgtttaaggtagattgccttttcacagggtcactgctctgacaatttgggatggaggaagaggagtgcacaagggtccttcctcaagacctttacgtcaagcaccccggagggcccctgcaggagctggggcagtacagcctggccccgacgcccgcaccgggcagataccgggagcggcccgccaggcccccggggctgcggggcggggatcaggggatgaggcagcgcggcctgcgctccgggtgtccccctcccagccccccgggcccgctgcggctggtcccctaggcctggggtggggggaggcgggggtccccggagagggccccggcctcccggcagcactaacttctcagccagcagctcctctattctccttcttttcttctccctaaaagagagaataaaagaagggtcagcatcgcgctacacactgggcgccgcgaggggaggggggcgaggggacggggcggggggtgtggggaccccgggtggcggcggcaaccgcccaccgccgcgctctctcacaacccagcccagcccggcgcgtctgcagagccccggtacttacggctcctcgccatccgccatattgttctccgcctcttcccaggtgcccacgcgcggcagggcggggaggagcgggactggcaaagcggggaggggcggggctggcgaagcggggaggggcgaggccagaaacacaaccggcagggaggtgcgaggttgactgcggctgggctcccatgggctttaaagtcttgccctgtaattataatcttaattacctacgcttaattaggtgaatcttataccgtgcataatgttgctctgcagcgtgaaaatgtagacaatacattatgcgtttacacaaactatatgttaatacgtaattatacaaaatattggtatattctatgaaaaattcgtgaagaaccctcccagtatgccagagctttcctctgggggcaaagatcaaggaaattttcactttctgcttttcaggatggttccaaagtctttgcctttataagtactcacttgaataataaatttatctaaatccgtttacattggtggggtgggagattattattttctttgaacaaatcagcattaatattttcatgtcacattctgttagataagttcagcggaaacaaaatgattaaaacttttcctgagataaatgtgtatatttagatacaaagaaaaaagtataaaggaaaacaatcacaaaaatcaaagaataactgagaacacccataatcctatcacctaaagataaattgtgataaaagtttcaattattttcttctagagtcagaaatacaaatatacactgtgaatctggatggctggatagagggaaatgatcatgttcaaaaatgtatgtatatacacgtacacacacatctccttctatggagtgggacaagaatgatatttggaatcaaaagtaactgattttaaattcttctcagttgtgagctacgaaacccttagacacttctatttcttcatttataaagtgggcataacactattcaccttgtaagactgataattaagtaaaatccagagtggctctcaaaatacagttcctgatcaacatcacttgggaagttttttttaacacaaattttcacccctcaccgcccccaccacgctccccaccgcccccccgccaccccacccttcagccttctgcaaagcctggggtgattctccactggtaaagtttgagggccactgaaatggagtacataaagcctgatgggtactcagtaaatgtagctgctgttactacactgtgatatttaacctcctcttgtcctagttttcagtgaaccttaaggaaagcttgtcctttatggtcccccaattaggttcagttcaatagcattcactgagctgaaagtcaatgccaggcagtgagcgtgggaatagagttcacagtccctatcaagagataccagcctccttctgcatcacatgtctcagcgtcaactatgaaactactttttcttgcccagacaactccacagatggtttcactgaggatttaacctcagtgcttatcaaaatgggctcctgtagcctgaacccccaacaatactggataccctttgattagtggtagtgagcattgcaaccctctcagatagtgaaaagcagcagtcaccttaaaggccacctagtccagtctcacccatttcacaggggaggaaactgaggcctagggatagagtacagctagccgatgaagaagtctgcaaaggtatctggccctgcatctgcttgctttgagactaacagcctgactcaccatggtggtattttgataaacgacaccaggcactctcactggcttagattgattgacggattagaaatagccatctgcccttgccaggaatgaaagcaacagagacatgcaagcaaaaccttcaacagatttattttacttcaaatggaacatatcataaacaattagactatctgctatggtttttaaacagacagatagtctgaatggtcctatctagacacaccagtcccattataaaagccccatcaagcagggctcggcttcccacacctgtagtcccggctacttgggaggctgaggtgggaggactgtttgagcccaggagtttaaaaccagcctgggcaacatagtgagaccctgtctctaaaaataataataaattaaagctccagaaagacctctacagtgaatctgacccctccctccccggaatgaacactaacaaagagctgctactaatagcatttcaaacagttactggaaaaaagtaatgactcattacatgttcatttttatttaaaataatttaacaaaggtagaaatatttagagaaaaaaaaaatctcccataccccaaagagagagacagggttaacattttgggagggagacagaagggaatcatgctataaacagctttctctgtcttttcagaatttatttatttatgtttaaacctctaaagaggtttaattctttcttgggtatcaattgcctgtgatcaaggagtaatcatattgttactaatacactcttgacagcttttggtcatgcagttctgagcagttggaagataaagttcttagttacagcttctaatactcataaatctcaccaacagtgtggggccccactggagttcccactctcatcttgaccaagatgatttactcagcttgcccacagtgctgcctcttgacattctgaagccctggggaattcctccacaccctctgacttcctgtaactgagcactgaggctcagtgcatctctatttagcactcctcttactgtctcatatttaactagtgtttccactggattgcagaagttttgaaggcagagcaggattacatttttctcctctttaaaaaaaaaaagaaaagaaaagaaaaaaaacccacagtgctttcacagagcctcaaaagaactcgaaatacttgctggcattgtactgaatattctcaaccttttccccctacccagatacatccacaacaataaagttggagcaaggtagagaaaagttagtagatgtttataatgaaagcatagaaaacaaatcagattaaagcactattaatagcaaacaagaatcgtgggctatcctattgctaataacaataatagtaacatataactgtgaacctttattatacactaagcatttcctatacattccttcacttagcctcgtctatatggcagatgttccattatccccactttacacatgaagacaccgaggctgggagagattaagtagtttctccaaagtcacctgccagagaggaaggagctgcgactctaattttgctttctctgacttcacaccatcccatttttccagaatcaagaaaacatgagcactcaggaatattttcacattttaaactttattcaaaaagcagcacataagatatatcttagcactaattccatgcaatcaccaaattttcctaaacaacagtagtagtagtaatttcttagagtcgctgtaagctccttaactgtcttctgaattaataaggaaaattaaattatgttttctagactttgcattagtatatttcattactttccaagttttcaaaaattggtgatctgagtagagtgaattcaccttgtctaagccacttaggggcttagagactctgttatcttagaaatcttcaccttagaattctacctattacattatacaattaaacaaactactttttttctcatgcattgtaccaatcagccccttaactgaaaaaagatgacccttggaagcttagaagagaattgacaacgaatacttcttttgccaggtctttgggctgggatacaaaacatcacgttatctatgaatatattgtggtccctcagtgaaagctgtcaccaaatattgcaataaaactaagaaaacttttgaagtggaatgcatatttctgcccagaaaatgctggatgcagaacaactagttcactgcagacaactgtttgctttaaaatgtaagcaacatgcccagctcaggactgaagtggccagagtgcctactttatcagaatggcatagcagtccaacaatttagcctagagagaacagaggtggagaacaaagaagagaagtgaaaaaaacagaccagcccttctgttctacatgaccttctttcccgttttgccaatctgatttcacacatagtgactcatggtgaaacagagaaaacatgggaattgcattcagatgtgtagaggttagtaagacttagttttcaaaagcagctcattctccattaacactgtagtcgccttccatttcatttcacttagattggcatctgcacagctgccaaaatttttctctaagtcagagaacacactcctaggtaaaccttcaaaaaaggtatttcgaaggaggcagcttctctgctgctagagaaggcattgccacctcccttcagacaggggatttccgctagttgctttctgtcatttcgtctctattctgcactcagtcccttgttctgtctggaggttcctgttttcctgtacccaaccaagagccaatgaagaagtaaagaggagcaaacacgcccgcccactcccaatttcctttgctctgctgtctgccaaccgcaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtaagtggggtccccctacccgggacaccgatccggggcgagcacggaggggcctcggggtgcaagatcccgggatgtagagacgctctctgaccacgctcagcgcctgccctggcaattctgcaagcggccaagccagtggaaacttgtttgcagggcgaggccgcagtaacctggggccccattttctgcaccaagggctgagacttgaggggggccctaggggaaagaggacggggaaaatttgccagccgcagggaagaaaaatgagagttcccccacccccctgcccccgcccgcgtgccaggatcgggctcttgctggaaagatatttgtagcgccctcgtcttttaaaaataagaagaaaaaggaaagtggtgtaaccctaccctggagctggctggggcggcagggtgtggacccgggctagtgtaaaaagggcaaccaagtggcgacgcactttgctgctttctctgcctaatgcctgccacactgtacagtaaagctgagcttgggatcaaaagggggggtgtctcctggtggcgcatctcccattgtggggtaaaggctgccatgactgtgggaagatggccttctggcattttcttccagcagtggccaggcgtggtcactttctctgtcttcgcttcctagcctgaggtttcaatgtatcagaaggccttttcaatacctgatacttaacaaagtatcctgtgttgagactgcatgtacacctgctttcctagaaaccacctttccttctagttcaccctttaagaaatgcttctctcgcttatgcaggatgggtggtgatattctcaatcttgctgattatctcctacacatctttaaagaaaaagccaccctcagactttataaaggactcacttgcacttaaatgtctgacatttctatttcagggcagacgtagagggaagaagcagcaagctggcttgggagaaaagggagaaatttgcacttgaagggtgtgggaaagggtgaacagggtggcttcttcagttggctcgcagttaattggcttatacattgagccacctctctgtgcctggccccatgccaagctccaagcacaccaagatgaatcagacttgaattctggcccaggggctcctggcagttgttgagaagctaaaggagcaaacacacagcacagaggagagggggagacttcacagtttccgagtatggttcacagcaatcacccccatgcagaggtggaagcccacatgtgggactctatacacaatcgcacagatccttcttctgcattgcttaaggaattcttaaggaattgcattctgggaatggcttggtgtatagagggcacaggctctgagtggactcggaactagtgtggcagccaaggtacaagttagtcagggcagggtggggcaggcccaaggcctgaggcagctgccttctgaaccttccctcagctctgtgcttcaggctgctttcctggaacactaaaaaatttcttttttttttttttttttgagactgagcctcgttctgtcgcccaggctggagtgcagtggcgtgatctcgtctcactacaacctttgcctcccggattcaagtaattctcgtgcctcagcctccagagtagctgggattacaggcacgtaccaccatgcctagctaatttttgtatttttagtagagacaaggtttcaccatgttggccaggtgatctgcccgcctcagcctcccaaagtgctgggattacaggcgtgagcctctgtgcctggccaaaaatttctttttaaaaatttttattatttatttacttttgagacaaggtcttgttctgttgcccaggctggagtgcagtattgtgatcacagctcactacagcctcaacctcctgggctcaagcaatccacctacctcagtctcccaagtgactgggaccccaggtgcgtgccacaaagcctggctaattttttttagagatggggtctcactatgttgcccaggctggtcttgacttctgggctcaagccatccttccaccttggctcccaaagcactgagattgcaggcgggggctactgtgcctggccaaaaaagtctttaaaacaaaataagtagtaaataggtttgcatcaatttttgtttttttctttctctttgcaaagaagcaggagggcatcttatctggtgatctagttatggaggtattttcttgaggtaacttagatgtggggcaaagtttgacacagaccaataattaaaaaaaaaaaaaagtctattttcttcagacatgtgtgctgcccagaccaggcacaagctcagacagccttgctgcttttgatagaatccatttttcactgtgaaggccaggggccagccctttgactaaatatagctccgtcagtattgtgccttaggccactaactcaggtagtttaggggtgttggccctcctcattttcctttcaaataagagttgttggttgtcaatgaaaattttgaagtgaaaaagtgaaaagtagccatgaagtttttaaaacttatccttatttttaaaaacttacaaaagatacaggctagtagtaaaggttgatttgaaaattatgtggataaaatgtgaaatttccttcatacttcagtaaaagtttggtatataacccctaactgttttctatgcaactataagcacagtcagtagttttttccaccagttgttctcttttctttctttatcatttaataatataaatatttattgagtgctctgtgtgtcaggtaccttgcaaagtattttacctgcattatgtcatagaacccaattttaaaaaactgttactttttttttatcattaaacctgaggctcagagaggttaaatgatttactcaaagtcacaaacttaggcttgtgctcttaactactgttctgtcttactatgagtcacaaggaagaaaccaaacatcttcagagttagggagcgtccttgattccagaacacttctcattctaaagagaactatcctctttcggtgatgctagtagatgggtaggtcagagcagtgctggcagctgttcatctggatcctccacagacttctctctagtttctcagaatatcttggtagagtatatgtgaaaatgtgacctggataaaagagtgttcaacaatggttccatcccctgctggtgaggagagcctcaagggcattgtaggagtgctctagcctcagctctccaatgttggaaactggcttagatgaggatagagagggcctcctcttcaagatttcaggaagggtgagggaagaacatagcaaatactatctagatccagaaacactggaaaaaactgcccataccaagacggagattaagagggattaggatagagataaatctgtgtttaaacttctgatcagaagagattgaattatttaaaaggaatagcatgaataacaggctaggaaacttgcgttttgctggaaatgcctttggatcctttacatcaagaaggaaaagtgtctaagatcgaagttgccatagcttaccttctgcatccttgatgtgagacgttttgggattaagatattcttttcacatcacacacaacaatagaagtctctaccttgatcttcaaagtgaaaaacaaaggcaacacctaatgacacttgcaatttaagtactaagcgtgtgatacattctagttgtggatgaaaacttctttgtgcttaatggaatgccaaatgatttgagctggagaactctgttcagtgtgtgagccatggaacagcagcatctttcgcctgagagcttgtcagaagtgaagcatctcaggccccatttcagacctactgggttagaatctacattttaacaaaagtctcagatgattcataggtacattaaaatctgagaggcactggattggtctggctcaaaagaaaatttaaataaatatacctatatgcccaggtgtcaccttccgtgattcaaaatgtatagttcttggcagggtccaggcatctgttgtttttttctttttctctaacttcctaagtgattgtgattatacacccctaggagaaatactgatcctcttgaaccccgtaacttctgaaatgtaaaagctcgaggtcacaggctaattggaactaaagctgctaataataggaagtgaaatattttttccattaagccatattgcaaattttctaaagctcttgattaaccaaattcaactgcatccctgactcttacaatatttgcaatgctattgctgtcttattctgaaaagttctttcctggatgggtatagtggctcacacctgtaatcccaacacttcgggaggcagagatgggaggattgctcaaggccaggagtttaagactagcctgggcaacatagtgaaaccctgtctaaaaaaaaaaaaaaaaaaaattattttctgccattagaactcatattttctggtatggcctcagaatcaccaaccacacacagaatttgcaacatataaaaatgcctctgctgcttctccagcaagagagctgcatgtattcttatgtatatacatttgtgcctccccctttagatagaaccatgtagctgctgaaggaatgagcccatgatttctcagctgaagtaactcctcaccatgtggcctgatcatttggcctatggagatgttgcaggagggtggaattgacagctgccactttatgctttcagttactcaagatggtaaggagtttctagaaggctggtaattataagtttgaaaacagcattaatgtaatcttttcaaaatgaacgtggcttggtggctctgtaatatgttctaggcctgtggctcccagcatctggtattatgaaatgttcgtattgtttgtacctttaaatgctgtaaagatgaagaaccaagtttccagttggtagaggaaaaaaagcgtaaggcaaccctgggaggctctggatcagaatctattgaaatgattgcagatagaatgagttgcagtctgtttatactaaagcaagtggaaatgtttttgagattagtcagcttcaacaccagttctacaacattactcttatttgtgttgcttcattcattcaattaacaaagagtatgaagcacttaccaacttctcagacactgctaggagatagtgaagaataggacagctgtgattcctgccttcacggaaaggcagcaagaccacactgaacacatgataactaatttgtatacaagtatagcaagtgtacagaaatacacacctacataaacacatccttctcaacctgacttacctgatctcccctgtacattattactccaaattccaaatctctcaggtgttgggaataggggaggcattgagtatgtagacaggaaaaaggtttttttaaattttactatcctaacccacagctcagatccttctattccattgaacaaatactgagcacctaccatgtggtagacactgtctaggccctgaggatacagtcaggagtacaactccaccagccttcccaaatcctcccagaattctcctgcccttcgatgcccatttatttgcatttgaggctggcacctgtcttcctctgatggcttatgtgtttcttctgaatacagaactttaagaggtctgtcaacacacagtaacattttaatctcaaaatctttatctaggctggacatgatggctcacgcctgtgatcccagccctttgggaggccgaggcgggtagatcacctaagctcaggagtttaagaccagcccgggcaacatggcgaaaccccatctctaccaaaaatagaaaaaattagcctggcgtggtggcatgcatctgtggtcccagctacttgggaggctgaggtgggaggatcttttgagcgtgggaggcggaggttgcaatgagccaagaacgcacgccactgcactacagcctgggtaacagagtgagacgccgtgtaaaaaataaataagtaaatataaatctttaataaggattgcttttcattaaataacctctgacagtgtatgtgtgtatatgtgtgtgtatatacatacatatatatatattttgagacagggtttcactctattgcccaggctggagtatggtggcgcagtcatggctcactacagcctctacctccctgggctcaggtgatcctcctgcctcagcatcttaagtagctgggactataggcatgtgccaccagcctggctaattgttgtatttttttttgtagagaagggtttttgccatgttgcccaggctggtttcgaactcctgggctcaagcaatcctcctgccttggtctccgaaagtgctgggatgacaggcgagaggtatggctggcacacctttgatactatttatgtaactttgtttatctgaacttctctcccctctccgtccagcttttttttttttttttttttcaatgttgcctgctacttttggcctttggttggtagtttctgtttcctttccctaggtaaggatttacaatgattctaggtaagtgtgcaaataaatgagtgtattttggattcctggccccctgtcttagaaaggagaagctctccatcagcttagggacagagagctctgtacaggaaatccagttcaaaaaggtcaagacccattcttgacctacccacttaatatctaattaagcatcaatattggaaattttgtattttttattttttggacaaatgaattctatccttatcactcagcttcagaaaacttaacccttaataccatcctctgtctcttgaaatgagcgtggcttcctgtttctgagaatgccttcacccttaataccatcctctgtctcttgaaatgagcgtggcttcctgtttctgagaatgccttcaagccctgtaattttaggcaaaaccttcaggctaacaacttcaggtttgcaagcattcatcattgatatatgataggatttcctggccttccttctcgttatgcaatttgctaaaggagacacctggaaggcagaaagccctgcttcttctaatctgcttcatatctcattggtgcagcttctccttgtctcagaggaaaaagaatgcagaaattgggggttagtgaggggtaaatagacaggaaacttgtgagaaggaagtctgtgttaccaagctcgttagcatttgtccagcccctgtcttctctccacagctctgtaagaatttgccatgtgacagttctcagtagcttttgtttgttttgttttgttaagacagagtctctctgcatcgcccaagctggatgccatggcaggatcttggctcactacaacctctgcctcccaggttcaagcgattctcctgccttagcctccaagtagctgggattacaggcacgcacaactatgcctggctaatttttgtatttttaagtgattacaggcacacacaattatgcctggctaatttttgtatttttaagtagagacggggtttcaccatgttggccaggctggtgtcgaactcctagcctcaagttatccccccacctcagcctcccaaagtgctgggattacaggtgtgagccactgtacccagccttttttttttttttttaattttctaaaatcattcaagaagaacagtttgtaaacaaatatctttccacttctgttccccaaaaagtattggttgttaagagtaaccatgggttgctaattgtgaaagcagtgatgagcatacatgaagattcattatacattattctctctacctatgtatatgttagttttccataatgaaaagttaaaaagggttttatgaagtctaatcagagctttgtacacaactattatttgaagctccgtcactgtgggaagcgtcagatttatggtttctaatccgagtccaacctgttgtttattaaaaacaaaagaaaatctggaggttcctaaggcatgtcttagtatgaacacttttaacatgccaactgttaaaaagacaatggttggtttggatgcgagtgtttaatttgtgccaaattacacaggatacagtaaatatttagggaatggcaagaatacaataaatcctctaggccttcctaattcagttggttaggaaaatctcactatgacctttctgtaacaaaagagacaggctcctgttcagttttacctactgtacagtctcctttattccatgatccttaggccaaggagacactgttctcatttactcaagacgaatttgtgtccaaagcccacatttatgcctatagtcaaaaatagctctccactttgggaggctgaggcaggcagatcacttgaggtcaggagttcgagaccagcctggccaacatggtgaaacatcgtctctactaaaaatgtaaaaattagctgggtgtggtggcgcatgctttaatcccagctactggagaggctgaggcaggagaattgtttgaaccagggagtcagaggttgcagcgagccaagattgtgtcactgcacttcagcctgccgacagagggagattctgtctcaaaaaaaaaaaaaaaagaaaagaaaagaaaaaaattaaaaattagccaggcaagctggcactcacctgtagtctgtagtttcagctactcagaaggctgaggaaggtcacttgagtgtgggagaaagaggctgcagtgagctatgaccatgccatcatactccagcttgagtgacagaggaagaacctttcttgaggaaagaaaagaaaaggcatatggagctgtgctctggtcagagagactgaggaaaggctggctgagctgagacttgaaggagggtggagtgaggcctgtgtgcaaagtatcctctctgcctgattcacctcaccctgagatggcaaaaggcaaggtgagttctggggtagatagaaaccctgagtggatgggggtgcaatcaggagatggtgtgacaaacctggcaggtaggccagctgctagccctgagagttccctcatgctaattactaaggcacttcttcctctcctagcagttacagccaaagccaaattttggccttggcttgtggagtgtgtgacctggattccaggccccacttaccccctcagccaggcaccaactccacacctatatacagtggccctggctgcagaggcaggcaggggccagaccctgcgaagccttgtagaatgtttaaagaattctgtttttagtttaagaacaatgaaaagaaaatggttgggtgggttcatatttgcagtgatccctctggctgattaaggaccacagagaaacatcgccaatttagagaagtccaccgtgagtatattgttccccactttttcggtgagtcagccttcctcagaaaccacacttcaaaaatagctttttcggctagaaaattggaactcagtgcaaagctgcctgtactcctcaggaaatattttgctgcctctttggtggttctttttggccttgcagcctgacaggagtcaccaaatgtggccttgagttgatccgaggatttctgttatggcaaacttttattgccaactttgcaattggtggccttggacaaatttattaacttgtatattctttagcttgcttacgtgtaaaatgaggtgggttagcaagatccttcctagctctaaaattttgtgagatttttttttcccctttcagtaacttgtggtaaaactatagacatagctactgaatcacgttgggaagtttaggacctgtatccacacccactaatagccaccttgtttcagagagaaatgagagtgcagagggattttccaggatgatccttggttatagtaggttacttagagtgtgggggaaatccttaaagccggttaacatgacagaatgggttctactgtgagttgctgccacaactggcacccttgttttcttgtttctctcctggatccctttggatatgtttcttctctgggcctcagtttagttatctgtataattggactagactgattcatctttgaagactgctacaaaatttctgtgatgggattctaaacctttttataaccataaatgactgctctagaatgtgtaactattatagggaaagatttattaattatttattggaattgggtaatacatgttcatattttaaatatatataattaaaatatatacaaacatatgtattaatatatttttaatttcacaatagaaaaacataacggtttttgagttgcaaaactaggtcctgctgtttctcccttctttctcaccatccctcgttcttttttttttttttgagacggagtctggctctgtcacccacgctggagtggcacaatctcagctcacttcaacctccacctcccaggttcaagtgattctcgtgtctcagcctcctgaacagctgggattacaggcatgcgccaccacgcccagctaatttttatgtttttagtagagatggggtttcgccatgttggccaggctggtctcaaactcctagcttcagctgatccacccacctcagcctcccaaagttctgggattacagttatgatccaccgcacccagccctctttcttactctaggactatcagtaagtgaaactccacccagcagaccacagaggcagctgtctacatgaaagatgggtggcatgtttatggaaagttttgtcctaaaagtctttggggtttgtcgtgattgctgtgataaacagcccaactgttgactaaaaagcatctcaggcaagaactggttcccagatttctgagaatttctgttaatctgtagagggtgtgtgtgtgtgtgtctgtctgtctgtctgtctgtcttttgttccaaatacaggtaagtgccagggcattggagtggtatacattttatcagatacagaagaaaataatttctgctcagagtaacttcgttagtttttttccagcttggaaacttgcttgctttctaattatagactgttgttgggcaggttatgaactaaaaccagttctatagaacttcaggctctgttcttttctcttggacatgagcaaccagaacaggtgaaacaaatttggaattgcttgagttaggcctggatttttcattgttccttgtcctggactttaggcactcaacctaaatatgtattttacttgtctagaggaaaataaaaacagcttgacatgaattttgttatatgcttcacttcatgaattattattttaataagtattccagaatgaactgagtaggagccctttgatgctttgctgccagccaacccactcctacttgcagggtatgcaaaggaatttccttgaatttcaatcctccatttgagttctttgtgttgatttgatctttgttttgctttgcttttttttttttttttttttttttgagacggaatctcgctctgtcacccaggctggagtgcagtggcacaatctcggctcactgcagcctccgcctcccgggttcaagcaattctcctgcctcagcctcccaagtagttgggattacaggcacatgccaccaagccaggcttagttttgtacttttagtagagacggggtttcaccatgttgaccaggatggtcttgatctcctgaccttgtgatccacctgcctcagcctcccaaagtgctgggattacaggtgtgagccactgtacctggcgatctttgtttttctttacggctcagaagaaacatttgggtaggttataggtcaaagtcaaggctttgtaaagggttttttacattcaggagcctttccccaatttcatttgttcatttttaaataccaattttttttattcatcaaggaatacatggccattgaaaaaaatatgaaaataaaaataagcaaatggaaataaactccccttatcctactatactgtagtctttggtataatttttcagtttctctaagtatctttttattttttaattgagacaggatctcactctgttacccaggctagagtatagtggcaccatcacagctccctgcagccttgacctctgagctcagatgatcctcctacctcagctttccaagtagtggggactataggtgtgtgctgccacacctggctaatttttgtggggtgtttttttttttttttggagagatggggtttcgccatgttgcctaggatggcctcaaactcctgggctcaagcgatgcatccgccacctcggcttcccagagtgctgggattacagacatgagctaccacactggcttagaatcttttgtgatgctgggaattagataatattaatctataagagtttcaaggcctcttcattcactctccactctctacaacctgctgaaggggattgtggttttgattcatcagattctttccttcctcaggcgtataagggaattttttctttcccagaccaattccggggttgtctcagaagacagggcataatccagataaaataaaacagaaagaaagtgcagagaggccaagtagacccaggtaacacagaaccaagagggaggggaagagggcagagagaatagcacatgtgctgggtattggggaaggttggggcactggggtgctatagactggcacaagaggatctggaggatgagcagaaaaccaggatttggattggagaaggaacagcttcgctgtggttcatgaactgaaattccattaatgttgttggcgagatgggacaagtagagatggacttttgtggttggtctgtgccaagcggcggttgtgggttggagagcagctgcttttatgtttttgtatttccttttttatatattcattttatttctgattatgaaataatatactaattatagaaatttctatttcttttttttttggaaacagagtctcactctgtcacccaggctggagtgcagtggcgcaatctcggctcactgcaccctctgcctcccgggttcaagtgattctcctgcctcagcctaccaagtaactgggactacaggtgcctgccaccatacctggctttttttttttttttttttttgagacatagttttgctcttgttgcccaggctggagtgcaatggcaccatctcggctcactacaacctccgcctcccaggttcaagcaattctcctgcctcagcctccgagtagctgagattacaggctcccgccaccgagcccaactaattttttgtatttttagtagagacagggttttaccatgtaggccaggctggtcttgaactcctgacctcaggtgatctgcccgcctcagcctcccaaagtgctgggattacagacatgagccaccatgcccagcccaggcccagctaatttttgtatttttagtagaggtggggtttcaccacgttggccaggctggtctcaaactcctgacttcaaaagatccacccaccttggcccccacaaagtgctgggattacaggcttgagccactgtactcagcctagaaacttctacttctgagctatctaacttatatgataaatctacctaacagacaatgcattatgtattacaattgcttttacccactcaatatataatgtcttcccatattattaaatgcacttcaatgttttaaaaatagctgtgtatacaataccacagctattggtattgttggccatataggtcgtttctgaaagtttttaatcataaataccactaatatcaatactgttacaactcaatctttgcgtttttgtttaattccttagactatattctgaggaggggatttattggcttgaaggatacaagtatttgcaaggattttgaatgaaattagcaacttattattgtagagtttagttttaaattatgtacaactggctgggtgcggtggctcatgcctgtaatagcactttgggaggctgaggggcggggggggtggggggtggatcacatgaggtcaggagttcgagaccagcctggccaacatggtgaaaccccgtctttactaaaaatacaaaaattagctgggcatgttggcgggtgcctgtaatcccagctagtagggaggctgaggcaggagaattgcttgaacctgggaggcagaggttgcagtgagccgagatcgcgccattgtactccagcctgggcaatgagtgaaactccatctcaaaaaaacaaacaaaaaaaaattatatgcaactactcttaccactgtttagctttgtgcatcttaatagaaatttttagctttttcaaagcagtttgacattgattttatcccttaatttcacccattcaggtgtgaaaagcttttactcttaattttaaaatgttcaaaattccttttatgtttcagtaggcagaaacagagctaaaatttaaagggatttttgaaaaagaattgtatttatcctgaatacgaatcccaatatgagcatgagttcttcatctcttccatttcagagaaagtaagctcttggcatcaccctcccttatcctgtcttcccccttccctcatttcaaatcagcaatgttactattcagggcatgaggagaacacactatcgtctgtgtccttcccaagtaaagtcctcattagcctctagggtaaaaagttaagtaactcattgtaccagcccaccacagacgtcttgttaagggttttgtatacacagtggattggggtgggcgactataatgcccaaaactttgtctaaatttcttcttcttattatcattattgagacagagttttgctcttgttgcccaggctggagtgcaatggcgtgatctcagctcactgcaacctccaccttctgagttcaagtgattctcctgcctcagcctcccaagtagctgggattacaggcatgtaccaccacgcccagctaatttttgtatttttagtagagatgaggtgccaccatgttggccaggctggccttgaactcttgacctcaggtgatccacccacctaggcctcccaaagtgctaggattacaggtgtgtgccaccatgcctggcataaatttcttctacataatgtgtttcctccattatcaatagtagtgtaattgctattacatactaaacatttggcttatataagaatgaatctggaactgtgtgcttgaaaatctgcattggtaactcatctcctaatgatactttgggcattttaaaacacttataatgaactctctatgtgaggagtcataaactcaaatgcctccatggggcaggcaggttatgtaagagagcgattcaggccagctattagaaaaacaatgattagactgggcatggtgtggctcatgcctgtaatcctagcactttgggaggccgagctgggcagatcacttgacgccaggagttcaagaccagcctggccaacatggcaaaatcccacctgtactgaaaatacaaaaaattagctgggcgtggtggcatgtacctgtaatcccagttactcgggaggctgaggcacaagaattgcttgaacccaggaggcagaggttgcagtgagccaagattgcgccactgcactccagcctgggtgacagagcaagactctgtctcaaataaaaaaaaaaaaaaaagaaaaacagtgattaatagcacctcactttgggcctatgtgtccatgatgcagtagagagcagtgtggactggagctcaatggagactgtttattctgtctgaatgagaaggcactcaagccagctgttgacatgtgggaaagtgggcctagcactgttattttcttgttccaggagaacaagaaatcccaagttttctggatttttttttaacacatgggtttcaagtaaaagttttttaaaacactgtacaggccaaacaaaaatgtgactgtatactggatctagcccatggaggccattatgtggcctgtattctacattcgtccatcatgagcttctctgaggatttaaataaacctttagagctaagaaaacacaacctactgtgtactagagcccaggatgtaaggaagctaaacatagtaccttcaaaagaagttttagtcttcaaaattgtggacctctaacgagatactttgatgggaactgcctgggtgtgatctcagctccacctttttttttttttttttttttaatgagataaggtctcactctgtcacccagccaggagtgcagtgggggaatcttggctcactggagactcaacctcccaggttcaagtgatcctcccacctcagcctcctgagtagctgggaacacaggtgtgtgccaccacacctggctaattttcatatttttgtagagatgggttttgccatgttgcctgggttggtcttgaacccctgggctcaagtgatcctcccaccttggcctctgaaagtgctgggattataggtgtgaactaccattcctggccttccccaccattttctaacctctgtgccttagcttcttcatttgagaaatgaactaatagtatctcctttataaggttatgagaaatcaaatgagacaatttagataaagtattaaagtattagtaagttctcaataattgtttttactcctctttctccttttgctacttctattgctgaactagtcacccctcattttttcttcctcatatttcaggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgtgtaagtgaacttgagttttttcttccatcatcaaaaaaatgtagaagcaattatccaacgggaattccataacccatttcttatatgtgttggcatgtcagcaaaagtgtcagaattttctaaaacagctttctacttgttatccaactagacccagataacacagaactgaggtcaagaactatgaggtcaaggccttatagttcattaattccacaaatatttgttggggcatctgctatgtgtcatacattcttttgttgttgttgagatggggtctactctgtcacccacgctgtggtgttatctcggcttactgcaacctctgcctcctgaatagctgggaccacaggtgcacacccagctaattttttgtgttttgggtagagaccggggttttactatgttgcccaggctgatctcggactcccaagcttgagtgatctagcttccttggactccccaagtgctgggattacaggcgtgagccacttcgcccagctgtgtgccatacattcttatggggacacaacagtaaacagaacaaagacaaatcccaggtcatacagcaggaatgtggcataacctgcactagactccagatttgtctaataagagagtctattctcaatttttaagtgccattcctattgtcctgacacaggaatgaatgtatttattatttggaagtagactatttattctccacttgctcaggagatcataactagtgttaaaagtttggtaagtctataggaataattggctcagaatataggtactaaatactcagattctggtgaagagatctagatattctctaagttttacatgaattatttactaagactccaaacacttgaagcctgaaatagacaagaaataaaatcccagcctaatcagcagaaatctgattaaaattctagtatattaagtgacaggcacatccctttaactttcaataacatttgacatgtgcacttattccactaaatgaaattatttgcttgtttagggctttgttagattaagtccagaatatttatggatacatcccataccctattggataaaatatctgagccaacaaattcacacatttttggaattttcttcaggttttctgtaggtgcttaacgcttagtatttcaatgatactgtttaatcaaacagcttgctaattttaatacctttccacatcagaacctgagacaggccagtgtaacgaaatgtatcagaggtagacagttaagagtcctgatttctattcttagacctgctggaaaccagcatgtgatttggaccagtcatcctatatgggctgtagttcactcatctctaaagtaaggagattagataagtgattcccaaacggataattgtgacaagcattcaggatactttttaaaaatatacatttcccagccacatctttattttgtgggtcaacagtggtacccaaggatgttaggtttttagaaagctcgtcaactatttctaacgggtggtctaggttgagatcctccagatgaatccacatcagggtttttcaaaataagggtccaagatccacctacatcagaatcatctggagtgattattaaaataatgaattctggagccttccctcagttgtaacagtctgaatttggggtgatggagaccaggaatttgcctatttaacaggctctccaggtgatttgaatgtacatggaagttgtaaaaccactggtatagatcatatggagagagggttacctgtttaaaatacagattcccaggcctgtctctttaaggctcaggtggaggaggtccaggaaaggggatagggaatctgtggtaaaataatcaagcaagtttggggaacggtaggctatagaaactctgtaaagcccttagatttttacatctagaattctatacccaacactttgggtaaagcctccgggaggcactttaaaagtggactttactcacgtgctcctgcagggaacaagatacagataatcccgaatcgagcaagagttcttttctggaaagcctcgggtaagttgatttttaagtaggatggaatcccgttgattcactctgaatttcaggacatttaagtagcatctgcaaggtgatgatatcagtgtgtgaaggaaagggtgtggcttccagataatggtccttcctgttgaatacagcattttcctttaatgcagaaaaaaaactatgtatgacttgatggagagctttacataaagtccaaggagccatttgaaagcttgcatcaattcgagaagcagactggactgtggctaactaaggcagtttactaatagtgtgaagagagggagtgtaatattgatatggcaaaagagaattgttgctttggtgttaaccaggtgtcccttctctgcagtgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtttttttggtgagactttatttaatgcacatctgtcttaaatacctgagaaacttggcgacgaccctataaacagtgaagcaaacacttcagctgtttcaaatactgtttagtaaagcttgaatactttattaacttgcagccagaataaaacaattccagtgggatcctatttttaaacctggcacgagttttatatacatgttagcccagttttatatacatgttagcccattccattttctacaaggtgaattctgccgataaaatccaataaatttggagaaactaataaaaaaaaagatacctgtaattactaatggccagtagtcaattctggaagggtaataacagaaaaatgtaacatataaatgttgtaaattatgattacatttaaaaacaagctaaaatctgcaactaagatctttagggttgggtggtagaaaaagcataatgtgaactgcttcacctcttttggcaaaacctgtgtattgaggccataagctatgaaattggatcatcttttcttcttgtatatctaagataaaaaccctcttactgtgcattttgaaattcctgactttaataatactgtggctatacaaacaaatgcataggggctttctagaattttttttttttttttgagatgaggtttcgctcttgttgcccaggctggagtgcaatggtgcaatctcagctcactgcaacctccacctcccatgttcaggtgattctcctgcctcccaagtagctgggattacaggcatgagctaccatgcctggctaattttgtatttttttttttttttttttttttttttagtagaaatggggtttcaccatgttggtcaggctggtcttgaactcctgacctcatgtgattcacccacctcggccgcctacagtgctgggattacaggcatgagccaccgcaccggcctagaatttcaactactaatttacattaagcttttaattatgtttaaagtgcttttcctatcagagtttagcctcttagatgtagtatgtgctagacacttgaagttttgtttgttacagccctttcttagctatcctgctttgtatgcaaggatgttttctagaaatattgaagggtgagaaaacaaaactatcagccattgaaaactatatttaaatttggatacttttgtacatactaaattatcttaaaaaaatagaaacgccatatttctttcccatggcttgtctttccaaataatgtgttgtttttaagtctgtcacaattagacctattctcccctagcctgtttggtttgatacatgccacttatgataacataaaaggagaaagaaggcaggtgccaattatttactcaggtaaagaagagagaaaaggcaccaaaggtttttttttttttttttttttttttttttttttttttttttgagatggagtatcactctgtcacccaggctggagtacagtgacgtgatcttgtctcactgcaacctctgcctccccagttcaagcaattctcctgcctcagcctcccgagtagctgggattacaggtgcctgccatcatgcccagctaatttttgtatttttaatagagacggggtttcaccatgttggccaggctggtctcgaactcctgacctctggagatcctccctccctggcctcccatagtgctgggattacaggcatgagccaccgcacctggcccaaagcttgattttctaatttctagggttcacactacttctattattacaaaaatctcaaattctatgcacctagtggctagaatgaataattaaggcctctaggaacttggaagaaggacagattggagttgtctggaaaattttttatggaggacacaggatctgacccgggagttgaagactgggtaggacgttcattaatggagaacaggagggaagtctcttggaaggattaatgcgagcaaaggcacaagggtgtgcacaaggatgtttcatcgagtagagtataaaggatttgtgggaaataagacaggattagtaaattggggccaggcaatggagtgccttaaagaataggataagtagttcaagtttaatccttcctgtaagcaagtttcctttaaaatatgtttgagagtgataaaatcaaattagacttacagagtaaacacatatgagcgtgtgtgtgtgtgtgtgtatttagccaaaaccaaaagcttgtcaataactatattatgtaaaacttcttttctataaaaacagcatgctgtctcccattgtccctctatatatgaaaacttgctgccaggaagttttcatatatgcagggtttactttcccattacttttcctagtgacacttagttttcaccatgttctgtggcttacgtgttctgcccctcacaggtacccctatagaaagaatactccaaaacaccaagggagtcaccaagagagaaagccaggcagggtgggaaactgaaaatctccactgattctgcagagaagctctaaggaacaatccttccatttcaaagcatcagaagggccaggagctcaattcatccttcacatttccataggatgaaacattatttgttccctttaagatactatgtgatgaattaccgcagaagagatggaaggagaaaaaaatgggaatacaatagttaacacttctgttatatttattatttaccagaagaaaacaataataaagcaaatgtttaaaaaattttctttaacttctgcttcgggaaatatgactctaaatttcacctgagtcactcaaattgattgcaagtagaaaatattgcctctaaatattatattttatctccttccaccttcctcttcagcccctacttcttcatggcccaaacattctgccttttacaaatacccttatcagatggtagcattgtttccagttctgccacgtggatcctaaagtattgctgctgacatagtctccatgctgtaatccaagagtcactatttccatttcttgttcttctagatggctctgttgcctcttacgccagttcttttggcagttgcacctgcgatttaagcatttgaggaaacgggggaaattaatcctggaaatttaagagctttgcagcaaaatttacaaaatttacatgccttaaaagatacagaataggtttgaaattctggccaaagcacctccaaaatcaagataaaacaacaatcataaccacagccaccatttattagacatttactaatgccagggactgttccaagagctttgagcacatggcaaagtaacatcatggaaataagagggcgggtgcctaagttggcctgggttcaaagactggcactagcatgtagtagttatgtggtgttgggcatcagttttctcagctgtaaaatgataataacagtatctaattcacaaggctattatacaagtgagtaatccatgttaacactttttttttttttttttttttttttgagatggagtctcagtctatcttccaggctggagtgcagtgacaccatcttggctcactgcaacctccaactcccgggttcaagcgattctcctgcctcagcctcccaagtagcttggattacaggcatgtgccaccaatgcccagctaatttttgtatttttagtagagacagggtttcaccatgttggcctggctggtctcaaactcctggcctcaagtgattcacttgcttcggactctcaaagtgctgagattacaggcatgagcacccggcctaacacttatttttaaaacagtatctcattacatcctacaaaagccttgtagggagagaaatggctcagagaagacaataacttgcctaagatcatacagctaggaagtggcagagcaggatttgaaccaggtctgcctgatttcagtgctcattattatacactgcctgtaaaaatatcactataagaatataaaatatatgttctttttaaaacatgtctttcctctttgaagcacactcctaatctgatggtcagaaatatttaaacatgaaatataagccaggcaagggggcatgcacctgtaatcctggctactcaggagattgagatgggagaatcacttgtggccaggagttcgagaccagcttgaacaacaaagtgagacccatctcaccttgttaggatttttattttattttttttagacaaagtcttactctgtcacccaggctggagtggagtggcatgatcccggctcaagacaacctctgcctcccaggttcaagcgattctcctgcctcagactcccaagtagctgggactacaggtgcatgccaccacgcccagctaatttttgtatttttagtagagacggggtttcaccatgtcggccaggcttgtcgtgaactcctgacctcaggtgctccacccaccttggcctcccagagtgctgggattacaggtgtgagccaccgcacccagccacctgattttcttaaaagagttttataacaaggctgggcgcggtggctgacgcctgtaattccagcactttgggaggccgaggtgggcggttctcctgaggtcaggagttcaagacaagcctggccaacagggtgaaaccctgtctttactaaaaatacaaaaattagctgggcgtggtggcacgtgcctgtaatcccagctactcagggagctgaggcaggagaattgcttgaacccgggaggcagaggttgccttgagctgggatcccaccactgcactccagcctgggcaacagagacaccatctcaaaaaaaaaaaaaaaatatatatatatatatatatatatttaaagcatcccccaagacaaaaaaaaattataaaacaacaacagaagtccaacactgcaaacccacttcatacttctgcctcataggaaaaccttaaggacaaagcaagtttttaaagggtttcaagtgtcattgtatcttaggaaagtaactcatcaactcatccatcatgtatgtaccttccagaggacactgaagatgcccagtgtccccagggcatttgtataacaatgactaggaatgtttctccctgtattgctaatgtccacctgccagtgtgatgaaccattttggtcatctgctctggctcctcttgcagccagttctcagcccacgatctttggctaggaatgtttttccaatattctgcccaccagagaggacctttgatgtgctgctgcctgccagccttcaagccaaggggacttccatggcttctgaccctctacctcccttgtgccaaactttgagaagagaggggtatgactgcaccctgcagggctctcccatggagaacaccagtagttaagagaaaccatgagccaggtatttaaaataactgtaaagctgcaataaatagttaaaacactgtgttctttgtattatggaatggaaaaagaagcattttatataagttattccctgtatttgtttatatatgcatggaagagttccaaaataatattttaaatttaaaaattttttaattatttagagagatgaggatctcactgtcacccaggctggagcgcagtggtgcaatgataactcaaagcagccaggccctcctggactcaagtgatcctcttgccttggcctcccaaagtactggtattacaggtgtgagccaccatgcccagcccagaataatattttaaaaagaaaatgtggcactgacccagaatagtaaacccagacacatatttactttaaagtatgaccaagctggtagttcagatcactggggaaaagaggaatcagtcactaaatgatcactggttaactatttggaaaagaaataatgaaatagccttcttgctttctactgactttaaaaattaaccctttaatctatccataatatcaaatattttttaaaaaccaaaaactataaaagttgcaagaaaaggcaggcacacattttaatcattttcaaagaggccatttctaagcagaatacaaaaggtagaaatcataaaaatagctagatatgatgtcataaaaatgtaaaacttacaaacagaagaaaatcaacttgtgttattggtagggagcctttttcccctttgcttgttagttttcaaagaaagtatgtctagtgtgcttgtgtgtgtgtgtgtgtctagcatcacacagtgcacacatacgcatacactcagaggcttggaggcagagcgggtgggaaagttggtttcagcacaggctatttaatttggtctacctgtattaagttcctgctctggaccaacacctcagtggatgtccaggacagagatgagcaagacctgctttgaagaactcagaatcctgtaaggctcaaagtctttccaccactgtggccagaagggctgtcaacctgaagcagaatgtgggaggtgctataaaagaggtgtggacaaaaaaggtaatggaaatacacaggcagagtacccctaacgtttttttgtaagaagtagcatttgagtcaagccttggaaattggatagattctaacagagatagaagaaaaggtaatttgaggcaaagggtggtacagaggcaagaaagcaaggcccttcagggaagacagcagcagacatggtttaccatagatgtcaccgagtcgtgattgtcaaatgtggtcccagaataagcagcagcagcattaccagggaatttgtcagaaatgcaaatatttaggccccatccaagacctactgaatcagagactctgtcagtggactcagtaatctgtatttagccctttaggtgattttgatccacaataacatttgagaatcactatatggactttagaaaagtgtataaaaaaccttttttcccactacacatcaaaggcaagcaattctggtttatataattcctggattatacgtgctcttgatgagcttgaaatgttacattgcttttttcctatggaggctcccttcattagaattgtaacatttccaaagctatgatctatgtttggctttggcttttatagatcatcctggtttctttattggaggtcctaaaaatgggggaggaggggtcgaaggaagaaaaagaagtagaaggtaaccctggagtttcagacctgaatgcgtgacagaatggagataagacagaaaactgggaaccagaagcaaccactaggcctaaaaatgagcagcttggtttggggacagattgaacgtgctaagaaaaccctgagtgatctaaagggaaagggagatttgggaattgttctagattatgtgacaagagaaagaggagaaaatttcccattatgtgatgagaaagaggagaaaagtacaaaaggagagaatctagagaatctggctaaagagaaagaagacctcataaatgaggcaaagaagaaatggccagtgatgaagatgaatgctgaagggtttgtaaacttcagttctgtaatcataacaacccctaatgtgtcatggagtcttttgatgtactaaggcggcccatgatattattatactgaagtctttctggaggaaaatttagcaatggctttagccaactggatgggagcagtccagatatacatgagtaagcctgaagtgaaattgagtgaatgttaaaatagttatcttgcgtgattggcacagaagcttggatatgatacaaaatgcagctggcctcagggaattagacagttgctgcaaatgggattttatctcagtgaaaagtacaaacactcatttgagatggtaggagtgagcagaccacaagatttttgaagatgaaagaatatcacacatttgtcagggagggataggcctataccagcctaatgtctttgtgttatcatacgactcagctttattaactcatagggaaatgatttagtcattatccaataaattcagtttgttagataagacaaagatttttaaaaacatagctaaaaacaacaagagcataataaaaaaattctacagaagccagataagtcatgtaaatgagtgaagcatgccaggtacaaagcagtaagggcaaaagagaaaaactagagggtccatgagcattctcaaggatgaaaccaatgcatagaaacagctaattttttccatgcaagtgcagtgtggccagatctgatgttccaagtggtgctagatatctggatttttttgcatgtgacattcaaaaacttacacaatgatacccaagctaaataaagtgggcctgctttacctcatgctttaccagatctgacctcatgctttaccagttttcaatacctggcccacggagtaaacttcttttaaactgaattgaatgggtaatttctcagaggaggaagcatttgagcaaagcaagtatatggattttcctttatttttttgccagcaacttcatttcaggtatcccaggccagaagcgtggggtagggagagaataagcattaatttaaaatttttgagacagaatctcgctctgtcgcccaggctggagtgcagtggcaccatcttggctcactgcaaactccacctcccaggttctagtgattctcatacctcagcctcccaagtagctgggattacaggcgagcaccaccacacccgaatatttttgtatttttagtagagatgggttttcaccacgttggccaggttggtctcaaactcctggcctcaagtgatcgacctcccaaagtgctgggatcacaggtgtgagccaccgcacccagcctaaaaaagaattttaaaatacatgtgctctatcaaatacaaaagtaatatttccaaatctataaggaaaataactacttttatttttcacacagggtctcactctgttgcccaggctgtagtgcagtggcacaaacatggctcactgcagccttgacttcctgagctcaagtgatcctcctgcctcagcctcttgtgtagctggtaccacaggtgcatgccatcacaccaggctaacttttaaaaatgttttgtagaaacaggatctcactttgttttgttgctcatgttggtcttgaattcctgggctcaagcaatccttctgccttggcctcccaaactgttgagattacaggtatgaaccaccgctcccagccagtaactacaatttaaaaaaatttttctgtcgagcatggtggctgatgcctgtaatcccgccactttgggaggctgaagcggaaggatcacttgagctcaagaatttgagaccagccagggcaacatagtgagatctcatccctacaaattaaaaaacaaaaaaaaattagccgtgtgtggtgagtgcggtcccagctactcaggagtctgaggtgggaggatcacttgagccctggaggttgaggctgcagtgagccataattgagctactgcactccagcctgggtgatagagtgagatcctgcctcaaacacacacacacacacacacacacacacacacacaaaacttttctaagaaaaaaatttgtttctgaataatgttctctttagtaacatcatacacacacagagaaccccacaaggtttcaaaactgtgttttaattttaacctcgttcttgaaaatccagggatttggagggtatctgtcccaaatccccaaaacccttcatttcacctctatcaagtgaacattgtcttgtctcacttgattggctaaaactatccctttctgctgagattttgtgacattaccatttatagtgtttactgtactttgagtctaagatgtatattttgggacatttcaacagctctgaaatcagaatccatcttaaaatcgatggtgttttacaatagttggctggagacccaagtgtgaacacatcatagctactcatactattattacctccattgagtcatgtgccctgttgatactacacacacagatgtattgcctcttaaaatagcttttaaagaaagataagtaagcaaatgtggtaaagtgagacgggtatgcaagaattctttgtactacttttgaccttctgtaagtctaaaatgacctcaaaacaaaacaaaaaaattaaaatatcttttaaaagattatactatgttttggctttaaagcagaaatttatagtacatgcagaaaggcacagaaacagagtgctgggaagcaatctgatattagtgaagcaaattttcattagtgcaaggaggcattttcatatttttcttgccgagtgttttccaggaccgaatagatgaagttgtgtgacattttgtaactgagacacatgcaaacagatctgtcacaggccaagccaggcaactgaaggcaggagaaattgccaatccttcagaataaatgaagccctttcaaaaccgagggtgatatgcaagattgtcattcaaaaagcatgtcagagttcactttgcggcatgtttttcttgaattattttttttaaaacaccaccaccaaatacacttaaaattggtagtagttttgaattgattaaaatatgaaaaatgcagtgcttggtggggtgttttattcttgcaattatcatcatgaatttattttaatgtcttttgtcctagactctagacccaaaactgtagtgttctcagttgagtaaaaggcagaggggtgaaaaattaaacctacactgtaagctctgtgtgcggtcgagactgaacctgacttaccactatatccccaatccttctcatctgcctgacatatatatttgttagattaacaaataagtgaatggatagaatggaattgacccaggaaaaatggatttgctcagcagagcactcagaagtcagggagttggttcagatgctcttctgaacttcattccctcttctactccgaacttacatgccacctttggcacagattttttcaaaagacgtctcatcattcttttcagactgctcttttctgaatgtacagccaccaaggtggcttgaatattctttgccaatgactagttactggaaaagtggtagaactagtttctctcaaacaataccccaattcattcctaggggagttctggctgtccagagaagagcaggtgcagaaagtcttgatgttgtgcccaagggcaggcaaagaaccattgtctgacctcatgtgacctccagcgttctcaccctggccactgctccaggaagaatcagagcctctctaaatcatagatgaaagtcagctttgatttagaagaatgggctattgataattctccattctaggagttgggaataaggacgatacatatgtgaaagactagcaattatttcagaatatcaagctctttaaagcagaaaaagagcaagcatgcataaaaattcaacatgttttgaaaaaacatgaatctgtgtaacaaaataatatacagactattctgccaacataatctcgtggctatattacaggagattttaaaataatatagttaattatcaatcacctgcggcctctgaacacatctttcaacctcaataaacgccatcataataatgaccaaaatatcttcatttctgcaacttaagttgcacggaaaataacttttccactcggcagtaatcgtggatcatggtaaatgttaaattgaaatagtgattttaaaactccgtgaattcatggtgacaccaacctgaagttcaacatttatctgcctaaaaagtgagcaatacaaatgcaatttcgaacagtctctcttcatctactaaaaagaactgtttctatgcattttggaagcattccattatctacaaacaactggcccaatttgggtggttttttttttttttttttagatggagtctcgctctgtcaccaggctggagtacagtggtgcaatctccgctcactgcaccatccgcctcccaagttcaagtgactctcctgcctcagcctcctgagtagctgggactacaggtgcccgccaccatgcccagataatttttgtatttttagtagagatggggtttcaccatgttggccagaatgatcttgatctcttgaccttgtgatccacctgctttggcctcccaaagtgctgggattacaggcgtgagccaatgcgcccggcctggcctcattcttatttattcctcactgtaggttcctagggatctctgagtgtcagctccattgtggctggaatggtgttcttttgaatatgcacttgaagaggtcagaagaagaggtgaattaaagcttgactctagactcagaaccgggtttcaatgtcagctctaccacttcctagctgtgtctcctccacatgttattaaattctctaagcctcagtatcctttttattaaatggggagaataacagtacctagcttatagggttagtaagatgattacatgagttaattcatataacaactccagcctatagtaaatgctccctaaatgttagctgctaatatcgttgttacagaagtcatataggcgtacctagagatggggtgctacaggtgtacatccttagggatagcagtaatttagttctattggtaatgctcattggcttcccccagttggtctcaattagtgagtatccccttatgttaaaacagagagggaataaagttgggatgcatttactatggagggtgctcagtcaccatttctccctccttctacttacaggtttaagataggcgacactgctgtgacgaatgtcgtttagcagctgatctctgggagtgatttccaccaatgggggtggcctgtttctcggcactggcttgagcgttttgatgacatctttgaggttggttttctcgggtggttctctggcttccggcatccgagatttgcgctggattctcttcagcttcaccacccggaaggagtcagggtctgtcctgtacttcggggcctgcgatggctttttcatcatttcactgcgttgactaaaggggacattttgggggttgggaggccgaggtggcggtggctggaagaattcctgcattctggaatctggcttgggtcctcccaacagctcccacatcccagggggcagccccaacccattctctaacatggctatcagcttcttctgttccttgagttgctgctgtttttgctcttcctgtcgtttctgcctttgtttatcctgattcctggtgagcagattagtgaccaccattctgggacccggaagctcaaaatggtagcccatcttcaggagagtgttgtttgccttcaaaagcctggctatttccatttcagcatggtgacccaacatgtgcctctgattgtgaaaccgaagctcagttagcgtctcattaaactggagacacctcatgatggccacaatccctttacctgtgatgaaattggactcgatgttgagagtggtgatgcttctattttcacgcaacatgttagccaaggcaaatgctacattctcatctgcacccacattggctaaactgaatgttttgatgtgcttgtttttcttcattgcattgacaaagtccagtaacatttctttggggatgttttcaatgttgttcaggttgagttccttcatgtcaggatcatttttcctaactctcctcaagctcccatccaggtctgtctggtttcctgaaggccttgtacttaccttcaaaaagctggtgtctagagctaacttcttaggatctaatttcgatatttttttctcactttgttcttgggcctctggtctgtctctctgttctttgaatgctttgtcagttacctgctggcagttgttctcacaatttctaatttgttcctttgctttgccttcctcttctctgttcgtttcttcactctcttcaccatcatcttctccttcgtcgtcatcatcatcatcttcttcttcttcatcttcttcatctgtttcttggatattgctgctgccctttgattctcttttatttgcaactatttcattattgagcttttcttttaaatactgggccatatttttattacgtttttctatttcttcatgctcttcttgagtcttttcctacaagagaggtttatgagggttagaatacatagcagagaagaaatatgaagtggagcatcagctagtggagataataaaaatgcttatttaaaagagctggttgctattttaaataatccttatttaaatagctgattgctaaaaatgggtggttattctatcccataaattaaaatgagtattaaaaggaaaccttattaattttaatattctgtactttttaatggtgtttaatttcagaagcagttaaaaattgttttgaaaacctcatagaattgttcatcgatacactgaagctttgattttgtatctaccaaataggcatctagtacccaacagtcctgagttagggcaataatttccttattattccaatatattataaatgtgatactataaatatattagaataaggaaattattgccctaaaattaacatccctacaatgtctactaatctagtatagaatgtacatgaacttcctctgagaacataacataatgtatgggaaattagatacgtttgacattttggaatatatatatatttaaaaacctcaattttgattttgaatatatatatatacatatatatatttaaaacctcaattttgattctattttttcagttctttgacaactgccatgatactctgtctaggacaagtttactatcccagtttcttgtgaaagaaagtgcctaggaaccagggccagctgtaagatgaaacaggattatgcagacattgagaaataattgcttagtctgggaaataaaatgggccttttatcaataatatgtattagattcttgcacatcaattataatgcttttctatgcaacttgtgggcctcatagatatcattttgaaagccagtatagcaagttgagacacaggttcatttgagcaaaaatttcatgctcataacataggtcagaagagacagtgacaagtcaccttaaccacctgaagtcttcaccactgcatttctcaccttgaccagaagggggagccaaccatcaagctgttcaagttataccagaggaaggaaaaacatgttgcaagtactcgtttttaccccctgaaactggcattcacatagaattggcttttcatccattgatctccagttgtaaaaaatctgcaaattgtaccttgaactctaacctgatcaatccagctgtttcttttcttaatcttagcacatgtttaaactctactgactgtaaaaccaattgacaactttccttaattacagccagcttcagagtaatttaacaagatgtatctttgtaaacaggcataacctaaagagactttacctaggaggcatctctgtcctctttttgttaagtcattttcaagtggaacataaaaaaaaaaattatgctcatgcacagtaagtttgcagagttaacaattctagctttcaggttttagaaagtgaagaactagcttcaaaaccacttaatagccatcgatttctaaatgtcatcactgacagccaatacatagtaataatataagacattttctggttattcgacttggtttaattgcaggttgtgtggccagacttcaggaggactgaaatgtttgacactgtgtgcgaaacactgcgtatgtttggatgtgccagagagacagaggctacagagctgtcattactttctcaaaggggcctgcaataaaaaagaaagagagaggtaaggacaactgcctctgggttatgagttaagtcactaagtatcgtggcaatagaacacaggctttctgacacagcaaacccgacagcaatttttaaaaagagacatttgcaagaaattacccaattttccccttgtaaatataaatgtgtttcagaaagttccagtcggagtaggattaaatattatggtttaatctagatatggcaaaaacaaagcagaaccaaaccctggagtcttgagaaatcacagttacaacagagagacctaacagcccatcccaggcagccatttctcggttgtacacaaatctctggttacctcggatttcacaaaggtgacaggaactcgttcctcttccagcatgcgcctggatgccttttcccaatacatataatcaacaagagatttatgattgaagtttcctgtcggtggcttgtcagtttgatctttctgaatcattcccacgggaaggctggggtcaggggccatgacttccatttccgactgcagttctttcagttcttcagcagacaagttggccaagatttcatcttcattaatctcctcatcgagaagttcttcttgatctgaatttctgctgtgctctgacattattttttctaaatattattttactagaaaagaagaataatcaaagatgatttttaaaaagaaggaaaaaagcctcaagaaggtcccccagttaacgagtgtcccaagttaacacacccttgagatatttttttttttttcccaggaacctcagtggtttgctgagcagctaggagtgatcacagctaagctcttgccggatctatattaagcagggcttggctggatggggtcaatttatggaacaactatgctgctctctttttggcaacttgagtcagctgcgcaaatccatctgacatttcagtacagctgctatgtttgccagagactagcagagactacagaatctctgcaggaataaaattaattatcttcctatatgccatcatattgccatacacaaattcatgcagctcatacatacataccccaatactccaggggattccacttgtttttatttaaatattaaagcaacttacaatatttcagaagggaaatccaaccagcaacctgagttgtttctgaagtaaagaattcacttgaaggtagaaatcaagctcttagggtctgcctcttccctacaaggtgagtgtggaagcaaataaagtggtgcacagtggaacagaggtcttgctatgtcactcatcctctgtgtaagccgaacctttgcaagatgtcctgtttgcatctagatcctgtgatctaacagatggggacaaccagcacttggatttccactataagtgagtttaatattttaaattatttgcttttcttattaagtatccattaagccaatatcaatgaaaatggctctaaagtgaagtgttaaaaaagaaatccagaccactaatatactaaaagaaactatgagaagattttgttttcaaaccctgaaggggcaatatgcaacatttgtccaaattacaaatgcccatttcctttgacccagcaattccactttgagaagtgtatcctacagatatacccctacatgggtgaaacaacgtgtgtacaaggttacacaatatagcaaagtacaaaacagtgtgttttacatgccattatttgtgtgacaaagggtacaataatatataatatacaagttttattatatatatatttaagacagggtctggctctgtcacccaggctggagggcagtgctgcgatctcagctcactgcaacctctgcctcccaggatcaagctgggaccacaggcatgcaccactacacccagctaattgtattttttgtagagacagggttttgccatattgctcaggctggtctcgaatttctgagttcaagcaatccacctgcctcggtgtcccaaagttctgggattacaggcgtgagccaccgtgcctggctcgtaaatatattcttattccgaaatatacattcattgtacaagagttaggataacatagaaaggcacagaacaaaatcttccccttacctcactgtgaagctaccactattaacatttcagttttttcattccagtcctttcttttaggcatacaaactctatcattttttctcatctgtttttttgactgagaaagtcaggattctttttttctaggcaactgtgtactctactactaaataattttttattgccctctgttaggattctttatatggatgtaccataatttgtataaccaatcctcaattgttggatatttagaatgttttcaattctcacaagcacaaatagttctttaataaatatccctatacctaaatagtttataaacacacaagtttatttctttagagtaaattgaacaaattctaaaaagtgaaattgctaggtcacagaatacgaagaaattaaatactttttatatgtagattaaagtaacagcaaaaatcacaattacttttgcaccaacctactaggacccatctccaatctacttatattaaatatttacaaatactatacatgttggccgggcgccgtgctcatgcctgtaatcccagcactttgggaggccgaggcgggcagatcacctgaggtcaggagttcaagaccagcctggccaatatagcaaaactctatctctactaaaaatacaaaaattagccaggcgtggtagcaggcacctgtagccccagctacccgggaagctgaggcagagaatcacctgaacctgggaggcagaggctgcagtgagctgagatcacacaactgcattccagcctgggtggcagagcaagactccatcttaaaataaataaataaaaacaaacaaacagatatacatgttaccattccaacatttcatatatatgtaagtttgaaacttgagacacccccattcctttctccaaaagtatccaaggattttagtttcttgtgtatctgtccaaggatattttattgataaaatttgtgaaaaaggaagaaaaaaaaaatcaaatcaagtgtgagtttgaaatgaaagttataatattttcttcctaccctagtgttttatcttgagcattccaggttgaaaggcttttcatatgtaattaatgccccagaaaggtatttccaatttacttgaatgagaattttcaaaggacacagttatgtactggcaacttatccctggcctctcgcctatcaggtcttctcttcttcttttttttttttttttttttttttgagactgagtctcactctattgcccaggctggagtacggtggtatgatctcggctcactgcaacctctgcctcctgggttcaagtgattcttgtgcttcagcctccccagtagttgagactacaggcgtgtaccaccacacccggctaatttttgtatttttagtagagatgggttttcaccatgttggccaggctggtcttgaactcctgacctcaggtgatctgcccatctcggccttccaaagtgctggattacaggcgtgagccaccatgcctggccaggtcttcttttagtccctgtaaaagggggaagagttgagccttggtgggcagggaggtagaccactttgtagaccactgatttgtggaccatcatttcatagagttttctttgcagaacaatgatctaaagagattcagtcaaaacaaaaacaaaacaaaacaaaacaagaacaacaaatcaattttgttcagggaggcttgggaaatgttatattctgcatttgtgttttagatatttgtaaagcacaattagctttgagaaactctgagaaattctacactaaagaaaccagttttttaacctaaccctccccaatcttaaataattcatattttgggaaatacagagctaaatattaaagagcagcctctggagtcagtatacctggatttcagtgtcagctccattcctaacttaggtgatactgagcaacttagcccatatctgataataatgtctaccatatgcaattattgagaaaattaaatgaggttttatacatatatatgaggctttattatatctatatccatagatatatgtggtaggatggtacatggcacagagtaaccctcaataaatgttaaacagtattattctcataactcatggttaactgcagaaatatttaaagaaaaacaaaggcaatgataaaatgcagtatgtttacataatgcagtacatttacatgtactacattttaaaaaccattttcaagatagaaaccgttatattaatggcaataaacaaaagagctttcaaaatcttgttgcttttacagaaaggaactgagagacttttaggtggaattatgtataaagaaaatagaaaaccaccatttgcatataaatatgaagctcccccaagaaaatgatctgaaaggtggcttgtaagcttttagattcaaattctcttctgatgaattccacttattttaatgtgatcaaaatgcttttgatgatcgagctgatttaggaatttctgtaaggagtgctccttcatctgacttgcatcttgctgaatgagcgtaggcagtgggtaaatctctcccagctgcttctactgtgcattttatccatatgctgacagggagggttttgctggtgtaattagcctcatttgacacagagatgatttagttgtgctttctcttaatgatgttccagtgctgccacctcaacagcttctcacatcagaatccagctatgataccaaaagaatgtagctagctgtaggataatcgacagaatattagagccagatagggcatcacagatcatctggttttgaatcagagtcttcaggggaagttattaagtatattgtctctctggaccccacccagaagcaactcaggtctgggcccaggaatctgtattttgtgaaagcgctccaggtgatcctgatgtgtaaataagtgtgagagtcacagagctactgcaagccactcattttatagatcaggctcagtgagcttaagacacattgcactcattcatttattcagcagtatttgccaagtgcctagttgtgctatatgctgtgctaggcgctaggaatacaagagtggttgagacaaagtcactttccagtgatgaagacaagtaaataattgctggttgcattaaatgctgtggaaggagatgaaaactacattttagataatcacaggggagacctaccttggttagggaagttaggaaaagcctctctgaggtggtaacacctaatgaatgaaatcaaccgtaggataggagggaacagcaatctatgcagagggaaccaagtgcaaagtcctttagacaggcaagatcttgggcttttctaggcagtgacgcaaggtgacactcacataactggactctgttgtgcaaggaggagatgaggacagggacctaggcaggggctagatcagataagtctttatgacctggagtgagttggatttcattctaagtgtcattggaaaccattggagagtttgaagcacaggactaacagatgatttacatttctaaaagatcacttttgctgcaggctggaaaatggactggaagggttagggaacaggcaagaataaaatcaggagataagtgaagaccccagtctcctgacagctcttaacactcaaggctctttcagtgtttagatgatctcagaggccctgggtgttttgttttgtcgtcacaaataaggcttatagtgtgctgaggaaacaccaatgtttctttctacagctctgatcttcagtgattacagtgttttgccacatccccataccccctgcttcacacacccaccccctgcaaggagtatactaaattttaatagagaaaaagctcatgccaaataataataatttctggctaaatctacaactgagaaattctaatattttaaaataaactagaaaaaagagttacatgcatgttaactgatctctggtgaaagattaacattagttcatagtaataacatatatttatgtagaaaaattatacacacacacacacacacacacacacacacacacacacacacacagagatatatgcttgaagatgcatagaatagtcctagcaggatacacaataatggttatgtcctgaagtaaggttatctggagtggggaggggaagtgggcggctggaagacaagtttaagagggagagtttccactgaatactatttttgttttgttttgttttgtttttgagacaaggtctcacgttgtcacccaggctggagtgcaatagcacaaacatggctcactgcagccttggctttccagactcaagggatcctcctgcatcagcaccacaggtagctcagactacaggtacaagccaccacggaaggttaacttttttttttcttagtagagatgggtttttgccatgttgcccgggctggtctcaaactcctgagctcaagcaatctgtctgcctcgacctcccaaagtgctagaattacaggcatgagccaccatgcctggcctgaatactgttttgtactttgaaaaaacaactgtctcttttcttgtaccagcctgcagatttcctcattttttgctcaagttcaattaggattttttgtgacttgcagcttgaaggagtcctaatatactctcccacttaagtcccttcaatgattttctatagcctaaggatgaatcctaatttcctgacatggcctcaagatctagactctgcttcctttcccagttgtgtttctcagtccctgtctcatgctgtttcaaacacaaccaacttgaggaccccaaggggtgaaactccctgtcatgcccaagttttgtgcagcttgttccagttctgaagttacctcctccaggaagccctcctggacctgaaaactgggcttggtattgctctgatgtccttgcctagagctgggcatgtgtccccatggtgttgtcattgccatttcactgatcaatctttcccctagggactgtaactctgtgaaaacaaagttgaccttctttatcatgtcatcagtaatgcctagcatagtatttagtgatataatttttttgcagctaatctcttaattttttaaccacagaaatatccaaactgtgcaaaatagtgggcatttcaaaacatctgacatctgcttcatttggtcttcatatctgaaaacctgaaataataacttgaagtcaataaagcaagatgcttcgaacataagacttgggagtcagactggatccaaatcctggttgtgccactgactgggaaacctaggaagttccttctcccaactgtgtccgttggctctgtttgaacagtggaaaagcagtttaattcattggttaaacccagaggcttcagatttaggatgtctggtttcagataccaactctgccccatcctaactgtgccatttgggtcaagtcaatctctcccttctcggttacttcatctgtaaatatgagataataaacatacctactttataggatttttgaaaaaaactaagtgacaatccatagtaaactcttagtaaacattactatactttcacaagtaaattgtgtcactcttttctgcctagaaagtgcctgatatctcacaaatatttgtccatgactgaaaaatgagtgacttttccattttactttttctaaaacagcacatataatatatgcataaaaatgtttaaaggttaatacatttatgaaaagttctgataagaggaagcacttctttcttgtatccacttatttttccattctacattcactcaggatgtgaaggctgtggataagtcatcccatctctttcttcagcttcaaaccactggctataaattgacacaactataaacggtttccaaatgtcactaaataaatcagttctgtcctgtttgtggtatgctattctcttgtgcaattccatctggatcaccaaggttctgcccactggctgcaaattgcctgaagattttgtgagtgtaatataaatgcctagctctctcctcaaatttccctgacccatagctgcaaggcctcaggatgggctctgaaatgtatgaggcaagtgcttctctaaagttaagacacccagactgccttgcctccaccagcccccaggatagcttgaattacaagaggttatgtattactttaccttaattttttttgtaagccatctcaaaaattcttaaattaaattggttttattttttatttttttaattttataattattatactttaagttttagggtacatgtgcacaatgtgcaggttaattacatatgtatacatgggccatgctggtgtgctgcacccattaactcatcatttagcattaggtatacctcctaaagctatccctcccccctccccccaccccacaacaatccccagagtgtgatgttccccttcctgtgtccatgtgttctcattgttcaattcccacctatgagtgagaatatgcggtgtttggttttttgtccttgtgatagtttactgagaatgatgatttccaatttcatccatgtccctacaaaggacatgaactcatcattttttatggctacatagtattccatggtgtatatgtgccatcttttcttaatccagtctatcattgttggacagttgagttggttccaagtctttgctattgtgaatagtgctgcaataaacatacgtgtgcatgtgtctttatagcagcacgatttatagtcctttgggtacatacccagtaatgggatggctgggtcaaatggtatttctagttctagatccctgaggaatccccacactgacttccacaagggttgaactagtttacagtcccaccaacagtgtaaaagtgtgcctatttctccacatcctctccagcacctgttgtttggtttagtttcacaggtagatcaattctatgtatttctgaagtgtgttaggatgttgcttcagtgctactaatatagttattatactaaatagtactgctaataccattactgctatcatcaccaccactactggtactattattattacaacctctgctactgaaactggaactgttaccaactgcaactgttaccacagctattgctgctgctactgctgctgttgctacaattattaatatcattatgacattcctcctgctgctgctactactggtgctgttaattttacagtttcactgctaacatttattgatcacttaacattgctaagcttgtgataagtgctttatatatgacatatcaatttcttcacacaacaaccttgaaatatggattttttttttttttttttgagatggactctcactcagtcacccaggctggaatgcaatggtgcaatcttggctcactgcaacctccgcctcccaggttcaagcaattctcctgccccagcctcccgaatagctgagattacaggcgcctgccatcatgctcagcttatttttgtatttttgtagagacagggtttcaccatattggccaggctggtcttgaactcctgacctctggtgatccacccacctcagcctcccaaagtgctgggattacaggtgcgagccactgcgcatggctgaaagatggatatttttgttaaccttctttcatagatactaaagctgaggcataggcatttgaactgaagacagtctctaaaagtcaaagctcttaatcagtgtcctctattgcttcctcagtttagcagagatggcactcacatacctaaaaggctggaattacaaagcacaggaagcaactgctcttgttggtacaaataaaaaacggtgaagtctggcagaatttgagtaatcagcagcagaaatgctactgtcgtcagacacctattgagaatgttgagacattggctgtaaatattattggatcaaattattcgggagaatgttgggttcaagaaagctagaaaggccaggcgtggtggcccacacctgtcttcccagcactttaggaggccaagacgggcagactacttgagcctaggagttcaagaccagttctggcaacatggcaaaaccccctctctacaaaaaaattagccagctgtggtgggacatgcctgcagacccagctacctgggaggttgaggtgggaggatcacctgagcctggtgggtgggattgcagtgagctgtgatcgagccacttgcacgccagcctggttgtcaaagtaagaccctgtctctctctctctctctctctctctctcacacacacacacacacaaacacacacacacacaagctagagagcttacttaaccaaaaagacttaaacatgccaatgagaattatgaatttctaaaccgagaaaaatagccttttttgaactgatgaccacaaaaaaaagctttattctatgggacatattatgactactattccttagaacacattttgtgaatgttgatctaagtcaaatgaagtcaagaaaacaatatatattatgtgcttgcatagaaaaaaagattggaaggaaatactctaaaatgttacaatccagctggaggaattaccaatgatttttattttgcgatcaaaccatttttgtatttccatagaacaaataaatgctgcttacattttaaagcacagaaaataactgcaaataatctttaagttgatttcagaataactgctttaattttcctactaacctgggctatgagcagcctactaaaacaggtgaaaaataaatgtgggtctgatcagatttgcagaacaaaatactgtaactcttaactctctggcatctttaaaataaccctgatatggtttggctgtgtccccacccaaatctcatctcgaattgtaatctccacgtgtccaaggaggggcctggtggaaggtgaatgaataatggggcaaacttatcccttgctgttcttgtgatagtgagttctcaagagatctggtttgaaagtgcgtggcaattccccccaccctgctctgccgtagtaatatgtacttgcttccccttcaccgtcagccatgattgtaagtttcctgaggcctcccaggcatgcttcctgtacagcctgggaaactgtgagtcaattaaacctcttttcttcataaattatctagtctcaggtagctctttatagcagtgtgagaactaataaaaacccattcatatttttctttgacattagtaaaaactgcaggcaaatatcaagtctttctttttgaatatctcaaagataagacatttcccaactactttgacaagagtccaccttaccgaagacaaagatacaaaaatgtttttaaactagcaaatctatgatttcctgaatgttgtccccaacacattttaccacacaaattgatttcttcaatcaagctgtggaattaatgggaatttacaattaattcaaagccagggtggttacaccacagtgtgaatgtacttaaagccacccactgaactgtacgcttaaaaatgattatttggtaattttattttgtgtgtatatatatgtgtgtgtatatatatgtatatatgtatatgtgtatatgtatgcgtgtgtttatatatatatatataaacattttgtttttgagatggagtctcactctgtctcccaggctggagtgcagaggcacaatcttggctcattgcaacttctgcctcccaggtttgagagattctcctacctcagcctccctagtagctgggattacaggcgtgtgccaccacacccagctaatttttgtatttttagtagagatgtggtttttccatgttgaccagcctggtcatgaactcctgacctctgcctgccttggcctcccaaagtgttgggattacaggcgtgagccgctgcacctggcctattttatgtatattttttaaccatattttcttaaaagcaagagtaaataaatatatttaggtaaaatattttattttgaatgatcctcacaacttgaggaatttaaaagtgcattcgtagcattgttcatgggacaatgctgaaaatgacctaaatgcccagcaatgggttctgatcttatttctgcaaactaatgccacaaaacctaatttaaaaattgacatagggttatggaatggtgtctgtaatttattaagtgaaaaatgcttgctattaagtggcatattttgttacaaaattttaaaaacataaaaacatattccatgtacgtatatgttgtatataagcacagaaaaaaatctgacagaatctatatcaatatgaaacagtgatctttgttttcttcttaaatattcccaaatcatgtgactattttgctaatgtagataggattttatgatcagaaaaaccttcaactatattttaagtgtgttgatacagaggtaatatctttatgggggccattttatgttattaaatgtaggacgttatgtactggcattagcacagtaggagggctagaagactcctctgctttcttctctttaaaggaaagaaaacttaagaagagagagaaaaaaattttaagaaaacgacaaaaagtaggtgggtcagggagtcaaattacgtaggggaataaccctataatgaacaaaatcggcattttgaatattgtttcactttagaataaaccaacttatagacttagatgaacttgaatcattttaacatgttaagataaagtataattttaatgtatgaataggtaaacatgaaaaaataaatttaagatattagaattaaacaatatagttattgagataaaccatgcaatgaaagaaaaatgagtgggattttgaattgggacacagaactgagatgtccagaatgcggaggggagccaaaaggttgaaaggttgattgaggcatagagaatgattctaaggctcccacatgtttgaaataagaattccagaataagagattggaggcaatgttgaagaagcaatatgtaaagagaattattgctaattttccagaactgaagacagacctaagtccttagagtgaaagtattttctgaatactgagcaaaataaaattgaaaacatcttaaaccaactgcagtttaaaaaaaaatttgcacctggccatacctagacaattcttgtagtaaaactacaggatttgagataaactaccagagagaaaagacattatctacagaataacaaaaatgtgagtgacaacagcttttgggggatttaaggggaggtcttatacctcataatagatgcaaaaattcagtagagtaatataaacacatgtctgggcaagagaagctccaagttcagtacagtggcctctctgggcagagaaagagtagagtcaaaggaagagggaagcaagggcccaactataactgcaatatttcattttcttaaaacaaatgtttgaggccgggcatggtggctcacgcctgtaatcccaacgctttgggaagccaaggcagatggatcacttaaggtcaggggttcgagaccagcctggccaacatgacaaaaccctgtctctactaaaaacacaaaaatcagccaggcgtggtggcgggtgcctgtaatcctagctactcagaaagctgaggcaggataatcacttgaacctgggagatggaggttgcagtgagcagagatcacaccattgcatcccagcctgggtgacacagtaagactccacctcaaaaaaaaataataataataaaaattgagcactgttagtgagaatataaaatggtgcagccactatggaaaacagcatggcaattctcaaaaagttaaaaataaaattatcacatggtctgacaactccaccgctgggtatacttcctaaagaattgaaagcggggtctcacacatgcacacttatgttcgtagcaacattattcacaataaccaagagatggaagccacccaaatgtctgtcaacagataaaaggaaacaaaaaatgtgctacatacatgtaatggaatattattcagacttaaaaagaaaattctgtcacatgctacaacacggatgcagcttgaggacactaagtaaaataagtcagtcacaaaaagacaaccactctatgatttcacttatatgaaggacccagagtagtgaaattcatagagatgggaagtaggattgagattaccagggcttgggcagggagggaatcgggagttgttgtttaatgcagacagagtttcagttttgccagatgagaaagttctggagatccactgcacaaccacgtgaatgtacttaacactactaaaatgtacacttaaaaatgattagatggtaaattttatgttatgtggggttttttaaccacaatttttaaaatatcaaaaaagatgaatattaaaaaatatttaaagcaaataattagattgacaaagctgcatgatatgactactagtatttattatatacccttctagtcattttttctgaatttttttagaattgaaatttttttaaaaaaaattgatggtattaagtccatcaacagaagaatgaataaacaaattatgttatagggatacaaaggaagactgactactaagcaataaaaacagatttttgctataaaaataaaaacagattgagtcagagaagctagacagaagtacacatgcagtaagattccatttctgtgaaaatcaagagcaggcaaagtgaggctgggcgcaatggctcacgcctaaattcccagcactttgtgaggctgaggcaggagaatggcttgagcccgggagttcaagaccaggcgaggcaaaatagactccatctctacaaaaaacagaaaaattggcctggtgcagtggcgtgtgccttgtagtctcagctacatgggaggctgaggcaggaggattgctcaagcccaggaggttgaagctgcagtaagctgtgatcatgaaaaaaagagcaggcaaagtgaagccatggaattagaaattaagagtagttgcttatgaggagtgtagattgactggaaaattggcaccagggaacattctggggtggtagctacatcttattggggtgttggttacataagtgaatacatttctcaaaaataatctgtttttacatttaagatgtgagcattttgttcagtgtaaattttgcctcaatgtatacatacattctaaaccaaaaggtgaagcaaaaaatatatatataggctatttacaagtggaaaaaagaaatgcagctttggtgacatggaacaccagaggacaaaggcaaagggcacttcagttgattgaaatgcaaggagaaatttagatagcacaattctgttactcaagaagcattcaggacattggagaaaaggccagagcttccagaaactttagaagagtaacctgaaaccatatgcaatgtttcaagaattttatcaaatctcactaaagtacaaacaagcctcctctttggtccttttccaaagagatggctgaagaatatggtcactggaaacaagttaattctctctttaaaataacttggctttaagtatatatcatacatgttcatcacagaaaaatagaaaatacagataagcagaaaaaaataaattgaaatcacaacaggtaaacattcttaacatgttgcatgtttttcctccatgccctttttatttaaatgctgtatttttttcctgttaagatcatttccaatcttcttgatcatgtgggcaaatctcactttgcagaagcctgtggctatctttgttagggaagatctaacaatcagattgtctaactactcatatttgcttcctagactatgatgtaatctttttcttcccacaagaaaacatctgcaagttttttccccccctttttttgaggcagggtctcactctgtcacccaggctggagtgcaatgcacaattatagcctgctgcagccttgacctcccgggctgaagcaatcctcccacatcagcctcccaagtagctagaactatgggtaagcgccaacacacctggctattttcattttttattttttgtagagatgaggtcttgctatgttgcccaggttggtctcaagttcctgggcccaagtgatcctcctgccttggcctcccaaagtactaggattacaggtatgagccaccacacttagctggtatgatcttaaaatgctttttacattttctctttttctgaagatgagtcaaattgtcatttaagagaaattaaatttgacttagaatgttttctttaattttaagggagaagtatttctccatgaatgtttctttcctatgaatataaaattactgatacctatacttgtatatgaaacatgaccacaaattgctgatgaacatgatttaaaaaaatgaatataccagagtttacacatctaaatgtgcctattcccttctatagtctttagacgtgcacttatccaaatggttctgccaattcatccaaccatctacacaatgcctctctgagagctgcctttagactatggagaattctgtaaaatattttcaatcaggctgttcttcattagagtacaagctatgtaagatcaggaggtatacctgcctcatttactttgttatccccagtgcctagaaaacatgaagagggactcaaaactgatgtgttgagtgaatgaacgaataaatggtaataaattttcacttactaaggtcaagtttttattgaaataatttgtagtctcccaagatgatgattattctccctcccacccctatcctctccctctttccattgtgattgcaggttcatgaataaggtttagggtgatatgtagcaggtttgggaaggtaggcagtgtctaattgtaaagccttgtggactttacaattttatcaggtttattctctattctaaatgcaattgaaagctactgaagagaattccaagggaatgaaatgagtttttaagttatttattaatttatttttgagacagggtctcacactctcacacccaggctgtagtgtgctggtataaacatggctcattatagcctcaacctcccatgctcaagcgatcctcctgcctcagtctcttgtgtagctgggaacacaggtgtgcaccaccatgcctggatgattcgtgttttaaaaaaatccccgtgactgtatgaagagaatcaattctgtgaggacaaaagtggaaggagggagacatttaagaagttactgtgaaaatccagaagacagaggtggcgacatgtactagagaggtcacaacagcaaaagtgaaaagtggattgcttctgcatgtattttggtggtaggacacacagggcaccagcaatctagttaggaggaactagtcggagggcgacttctacatgccttatagagatgaataaattcctactatctcagccttcaaatttcacagtttaaaactcaaattccagcaaacaggcatctgattggcttagctaggacaccatgactggctgctccacaaacactcctatctattggggaagatcttagagcaccatctggtactctaaaaattattgatgtgctgttcttaggatgtatggtaaacacacttgatagcaataagttaagcataccctgagaatgaccctgtacggcagacacacctgaatgcatgttctgagctaggaaatctggaagtggctgacctggagatttattccttgtctatgaggaacatttgagcccctgcccagtcccatggaatactggctgtacaggggatcaaggccccaagttttgggttaaatgtaagtttccagatggaggttgctagggaaaggatgctaagtaaaaatgctatataaactgcatgccttttgtaagtggttgaggttaaactgcccagtctgctgccactgggctgtgtggtcctcctgtccagcccaccaccactggactctctcccctctatgtaacccccaagtaaaaccacatgtctcttttgctggctctgggtctattctttagtctctggaacctaatgccatccccagtggagtacataggggttcaacacaacacaggagaagaaggaatagctgctgggttgacaaaaatacaacatgtctcctacatgcgtgctaaatttataatcacctaatcgattctttgtagaaaaatatcacagcatatcacattattgaacacattaatcctagcttataaaacattaaagcatataagcaaaatagcaatataaaaattaagatattaaaaccgaatattttcttctgtgcctgagctcttcccaaaattaagttcaaattgacaaacgtttccatattaatttaaaagtttaagtcctttacattgcacttttttccagaactcaggtgagagctctaagctcaaagttaaaagtcacattttctctttccctgcctccttccttccttccttccttccttccttccttccttccttccttccttcctttctctctttccttctttttgttggggtctcgctctgttgcccaggttggagtgcagtagcacaattttggttcactgtaacctctacctcctgggttcaagctgttttcgtgcctcagcctccagagtagctgggactacagacatgcaccgccatgcccggctaattttacatacaggggtttcaccattttggccaggctggtcctgaactcctggcctcaagtgatccaccggcctcagcctcccaaagtgctgggattacagacgtgagccactgtgcctggccaaaagtcacattttctttagagcatcccaggagttgccttctccatctctttctctttctgttctgtacttgcttagctggcataaaacatggcactttatattctgccaataaatgcaaagtggaggcagccataaagtagtagacaaaccacttagttgggcaccagaagcctaaagcctgcctctcacaagatgtgattccacaagcaaatcacttaccctctcaaaatggagcttcctcctctgttaaatgttgtcgaatgtgtatatccaacaggttgttgttggaaccaagtgggagtgtctgtgaaagcacttagaaaattgtgaagaactgtccaaatgcaaggcatgattattaatttagactatttcaggatcaggactcccgatccctttatatttcctataaggttatctgtcttaccctcccttgtttatatatttggactagaatatcattggtgccatattttcctggctgaccccaatctaaattttgaaaagcagcttttagcacctcctccaagaagccttttctattctttccctgtgtgaggtattttctctttaaactctcaataacctgtgctacctttattaaaacacatgtcatattgtacgatttcttagataaaaggacttctctgattaacttgatttcctcctacgttagttcttccatttcatgattttgttgtcttccttttacgatgttagttttctcacctgtttgatagtttctatgtgtgcccacctttgactttgagattaactgttagactattgtgaatgctaattatctccttactgaagacttgactatagtgatttttagtaagtgatgtacaggttctaaaatttgcatgtgtcctctaaagttcatgtgttggaaacttaattcccagtctaacagtgttgagagatggcacctttgagaggtgataaggtcatgagggctctgctctcatgaatgggttcttgttgttattgtaggaatggatttgtcatcttgagagtgggtttgttataaaagtgagcttggctctatcttgatctctcttgccatgtgatgccttctgccatgttataatgcaacaaagaggtcctcaccagatgtagcccctcaagattggacttctcagcctccagaaccatgagccaaataaatttctatttattataaatcacccagtctcaagtattcttttataacagcactaaacagactaagtcagcaagatatgccagtagttagttttctcaatggcaatgtcttcagttgacatttttttccttttctacattatgtagaagggaggagaaatgacattctaatagatgaaagataactattagtaaaatgatctaaagtttacttggttattcctaatgttcttttaacaaaagatgtaccaatgtctcaagcatcaaacaactttataaagacaaaggctatatctgttctttatgtattcacattgttcagtgcacatagaagataaccaaatattttggctaagtgaatgaattagccacttaggaagaaatggaagatatgagtagtaaaaataatttgataaatttacaaggtcaataggaacacacaaaaaagccacgactcatgtgtccccttatctaccctgaagaaactggcctttctcagagtttctaccaagcaacagaacatacacaggggatttcacctcccactctatcaggacacagatctcatcatcttgcaattgtacgcagcctggaaagcaaccagagtgtcagtttacatagcgaggctgctggaggttgtatgatgtcttttaaacaacttgagccaaaaataaccaatcatagtccaaaacagccaaccatactgtagctggtcttcaaactgcaaaagtcacaatgaattcaccttgtgagctgttgttattataaataaaaatcatggtactagaggtgagaaaatgccacataagatcagaaatgagttagagtccattctttttcctccagtttttaaggcatagccaatatgcaggattatttcagagctaatcagtttcactggttcatatttcatttctcagcaaaccatttcactgggccataaacactttttagcaacgcagttcctactatcttctgaatttcatatttgaaaacacctcttctcttccaggagtttagacacttaacccactcaggaaggagaaacaatcacaaaactattgagagaattagaatgagagatttctttgtggccaccccaacatcatcttttttttttaacgtcactgtctccctaatactgtgacaaacatcattccttaggtatttcacatacttcctgggtcctatttttaaattaatgaaagtgcatcatgctaagtgcttcaaaacaaatttcacaccactgatttctgctgttgttgtttttttcctgataaacatcactaagtgatcgatttaatcattgcttattgtctttggttgctaaacattccctgactttgctcagcaaacatttccatgtagcacaaactggcctccctttaaaaaatacttctaggtatgatggagactcctaaaattgaaaaaaaatatttatctgtctctgtccgaggccatccactgaaatgtaatctggggattatagagggtcagatgttgcctttataaaaacaaacacccagcaactagaggaataaaagtgagaggctcaaggaaagaggcaaggctacggggacacagtagttgaatgtgagtgtaggcactaatttgggaagagatattctactacagtttttactaaaataatttttgaggctatttatttgtaacagcatgtatgatttctatgattgtgatctttcttttttccaaaatgtatgtttcaaaaatgaatatagcattccaaagtttcatgaaaaaaaaattactcaaatatttaatttaaagtaaatctatctcttgcatttattctaatagattttccatctttcttggcattagatcgtatgtaaaaaagtcacacttctcttgagaggccaaatacatgtatataatttgtttattagtcagttatttaaattaaaatacaattttaattagcgcaaaatttgttcttgcattaggtaagataaataaacagtggaactacccaatttataccaagccatctgaataccctgccaaggccatgttagagcatgacccagcagaaaattacaactactaccactggctgaggctcatgttacagatcgggaatgataaatacctggcacttctattaccactctcttacatcatgctcatggcagacattactaatcaatcataatactctctctatgcccaggagcaaccttagaatccttcacagagcctcacagtaggcagccactatcaatcgagtcagtgtctgagatgaaacctatattcaaatgcaattaaaaccgtttattaacatactaggttttgttctttgcaactattattagggctttgggatactattcactccttttcccttttaaagttctgatccatagagtatatatacagagatcaatagcaaaagccaaaggcaaagtgcaagtttattcactgttaggtgagaccactgcaccctatggcaaatcctcagacctggctcaggctcaaggacaaagtgagtccttcttctttctctcatagaatctacatcatggaacatgagcatctgggatctgtctgttggctaggggtggaggaaagagaagtggggaaggagagatgggcaagggaagagaacagtcaaaggagagggaaagaatgagcaggcagggcaggccctaaaagagcccttgaattagcttactgattttaccacatctccttacaaataatagtacacttcttgagagtttactatgcagcaggcacaaggcacaatgctaggctcgatgtcatcatcttacatggtaattccaaaacccctctgaggaagtttatcagttaaaaattgtatgggtggcataagaatcagaatccccctgggaaatcggtgttaccttcaaggcagaggtgggagcagggataagggtaactgtctagatgacataggggttggggcatggagaggttcttatccctctagaccttagggcaggaggcaggaggtctgtggaacccagggaaagagatgcagctatagcagagggccatctggccagaggtgtggctttgggtagaggaatacagctactgccccatagctgagaaggcgggagctagagggatctattctccaacctctctctctctctctcctgtttctggctagttcctcccattgaccaaatccctttggaaatcagagggcaatggccctttgatgtggttcaaggcagcttccccttgcaatgtagcacaagggcacaggcagaactggatctggaggggcaagcagaatatccagcacaggcaggtggcagaaaacccaaacatcagtgacttaaccatacaggtttctattgaaaagagaagttacagctgctcagcagggaagtcgttagcaacccagcctcctgcaagctctccgctcatgctggaaagacctcctgcagctgtgggtaccacactcacactccaggcagaaaaaaggaggaggggcaaagagcaaaagccacattctaactgagtctatcaggaaaacaattagtgtccccaggacatttttacttatatctcatcggccagacccaggtcatgggttcttttctggctgcaaagggagcctggggagggaagtatttttaactgagctagggtcaccagataaaatacataatacccagttaaatttgaatttcaaataaataatgactctttagtaaatgggacacacttttactgaaaaattattcatagtttatttaaaataacatttaactggaaagcctatatttttatttctaaatctggcaaccctaacctgggcacattgccacccaaacaaaattgagggttttactatggaagaaggatggtacaaatattgagtatggaatgagctgcagctgccacagatgagtactattattcccattttacagtttcagaagcaaaggcttagagaaagggaggaatttaaccaggttatatagctaataagtgctgaagctggaattaggttaaacctagtgctttttagcatttatattatcagcctctgtgacttaagaggcttcagaaaagcaaaagagaggtcaagagctctctaacacagtaactgccccaccagtgaaatatggcctaatagaggccagattgtcaccatggaagtcagattgttgacaatcagattagcaactacagctcttagagcagtggctctccattgaggagaggaaagtttgccccccaccctcaccccacagaggggcacttggcaattgctagggacattttcagttgtcacaacttgggggagtgctattggcatctaaaagttgaggccatggatggtgctaaatattctataatgcacaagacactccctcacagcaaagaagcatctgatccaaaatgccgagattctaaaggaaataatgagtagaaagtgtagaagagaatccctagtacatatcccccaaatacaaagcagccttgggcaaagactcatacgtgagaagatttcccctaacatctatatctttttgaaaaaaattacaatcattttatttaaaactgtgccaataaaaatgcaggtgatgcattcttctcatttttgcaatatgagggaacaaacaagtttaccaagttgcccacattactttaacatcttctttattattgcacatcttactgtaatgtatttattcctatagttcccacttgtttgtaagcttctcagaggcgaggaacaatgtcctcaatttgtttcactggtacaatgcctagtatatggtatgcacatatatttttaagaaaaaattaatttggtacctgtactataaacctgaaattagtgaaattagttcttaatcttttaaaaataatattaaaaaccaaaaattctctttttcttggatgtaatcctgagatcaatttggctgtttattgaaacagtaagcagtttgcataatacctgtttgcagacaggcctagttgcttatttccctaacatctgtatctgagagtacaactgatcacatgctattttcttgcttagatttggaaatttaaattttcctacagcataggaacaaaaataaatatgtcaggaaaaaatatcctacagccagagagaccagggcccttgcaagggactttagagttcaaaattatgagaacagttatgactgccattatagaactatttgtttaaaacaaatagcggtatgtgcccaaggaatttaacatcatttacagtcatgctattattaacgacagggatatattctgagaaatatgtccttaagagatttcattgtgtgaacatcatagagtgcccttatgcgctctatgatgtttttagatggtgtatacttaggctataaggtagagcctattgctcctaggctgcaaacctgcatagcatctgtctgtcttaaacactgtaggcaactgcaacacaatggtaagcatttgtgtatctaaacatagaacttgcacagtaaaaatgcagtattataatcttatgagaaccaccatccatatatggtccatcattgactgaaacattattatgcagcccatgactatacttctttactaaagccaatcataagtaaaagtaaaggctgggcatggtggcttgcacctgtcatccaagcacatcaggagaccaacacaggaggattgcttgagtccaggagtgcaaggctacagtgagctataatcatgctgctgcactctagcctgggtgacagagcaagaccctgtctctaaaaaagtaaaaataaatttttaaaagtagaggtattcctgaccatctctggggatatgaaaaaaagaaaaataaattaaaaagtagaatatgatgcttaaaatcatatttgtaaagccaaacagagattctgtatagattattttgtgtgtgtgtgtgtgtgtgtgtgttttagacaggatatcactttgtcacccagtctggagtgcagtggtgtgatcatgtctcactgcagcctcatccacatcgtccacatcctcctacctcaaccttccaagtagcttagactacaggtgcacaccactatgcccagatattttttacatttttttgtagagatgggatttcaccatgttgcccagactggtctcaaactactgggctcatgccatcctcctgcctcaacctcccaaagtgcagggattacaggcatgagccaccgcacttggcctatttagattcttttggatgaactgcactactattgtcttctcactatattggatacaaatgtagaaggccagcatgcacacacatttaatcttcccagattggcttcatttttgattcaagaatagcctgtgtcagagaatgactattcataaatgttcattgatttaaatttgcatgtaggctccttttcacagattatctttaaagggatagtagttgctttactgatatcactaatgaatgcatgagagcagagagctagaattgagccatagttctacctgttacaaatatattgttgatcagaatctagtttggaactattttctttcttttccaatgtttatctgattatcttgctagtctatgcatggtatcttttgatactccccaacacagacgctaggctaaagatgttgatatcccttgagattcttgccagatctctagcccaaaccttaccctgttgaaactgtgccagatctacactggatgtcaagccaccagtttgtgaagagtcgattgcaccatcattgctagtctagcattatttatatatcaaatctataaattatcatttgatgatcaaggtgcttgtgttagctggaacgagaattttaagtttattaacgaaacgagttccatgaggcttttccaaatggcactttagccaaaggataatttggctaaaagcttacttaagtaaccaaaggggaccattaagaaactgggttcatttccaaagtggcccgatggcataatcccagggagaggaaccagcaagtgtaaatcatctgctctgttaggtaccgtgtatgttttccctgtctacttctcatgacaaaaaatcaactcctcattaccattttaaggatgcagaaaatgcccttgaacatgcaacctaataaagcatccgtttatttatctacaaaatgggagtaataatagtacctacctcatgagcatgttgtgaggattaaatgagataacacatgcagaactaaagtacatgatggcaatgtaaatactgttaggtcttgattgttttttgttttgttttgtttttgagacagagttttgctctgttggggtacagtgctgtgatctcagatcactgcaacctctgcctcctgggttcaagcgattctcctgcctcagcctcctgagtagctgggactacaggcatgagcaaccacacccggctaatttttgtatttttagtagagctggggtttcaccgtgttggccaggctggtcttgaactcctgacctcaagtgatctacctgccttggcctcccagagtgctgggactacaggcgtgagccaccgccgagcccggtaggtcttgttattaatttctactaataaggctacagtgtgagaatgtgactccagagcctttcttcttttcacaattccacataaccttcaattaactacagtaacaattttttcagtacaaccttttaactacagtaacatacagtagcaataaactacagtaacaatgttttcatgcaatcttaggcctgcctcagatggaccatacacactggctttttttagtctcccaatttgaactatttaatttccagaactcacctccagcccccaaaacagaaggaaaaaaaaaaaccctgcacaccaagcaacatgtacacgctgttccctaatcttaaatcatcctttccttcagattttaagaaaatcacgatcattttagtgtgatgtgcttggattacagcagcatagaactctattagaggaaggatgatccttagggttcccagacaggaaacctatatttggctggtgacctgtaatgtgaccaccaccaactgctccctgctgactttgctcttggaaagctactgcccgctattgcctgacacttggtggtgattacaaaaggaaaacaatcatgcatggcctaaaactgtttcagtataaaacatgtaccacagtagtcctgtaacattataatggagctgaaatattcctaacacctagtgacatcataactgtcatatcacaatgcaacgcattatccttgtttgtggtgatgctggtttaaacaaatctattgtgctgctaatcatataaaagtatagcatacacaattttgtacagtacataatactggataatgataataaatgagtatgttactggtttatgtaagcatagtaattactatagtaatagtataataattacatagtaatagtaaattattattctttttatcattattttagggtacatgccttctacttattttttaaaaagttaactgtaaaacagcctgaggcaggtccttcaagaggtgttccagaaggcatttttgtcatgggagatgacagctccatgtgtgttactgcccttgaagaccttccagtgggacaagatgtggaggtggaagacagtgatattgatgatcctgaccttgttcagtcctaggctaatacgtgtgttgtgtctttgtttgtgtccatgtctttgttttaaaaaggaaagtttaaagagtaatagaaaaataaaaacctttaaatacaaagatataaaatttaaaaaaaattggccaagtgcggtggctcacacctgtaatcccagcactttgggaggccgaggcaggtggatcactggagggtcaggagttcgagaccagcccggccaacatggtgaaaccccgtctttactaaaaatacaaaaaaattatccaggcgtggtcgtgggcacctgtaatcccagctactcaggaggctgaggcaagagaatcgcttgaacctgggaggtgcaggttgcagtaagaaaagatcgtgccattgcactccagcctcggcgacaagagcaaaactctatctataaggtgttttaagctaaatgttattataagagttaaaaagttaaaaatgttttgaaataagttacaataagctaagatttattattgaagaaaaatttttaaaataaattttgtacagtttaagtgtacagtatttataaagtctacagcaatgttcaataatgttctaggtcttcacattctttcatgactcacagacttacctagagcaacttctagtcctgtaagttccatttatgataaattcactatacaggtgttcagttcctatattttacttttttcattgtttgtatatttttactgtaccttttatgtttagatatgtttagatacacaactacttatcattgtgttacttttacctgtagtattcaggacagtaacatgcggtacaggttggtagcctagaagcaacaggctataccacatagccttgttgtgtaataggctatcctacttaggtttgtataagtacactcttttttttttaagatgggatcttgctctgttgcccatgctggagtgcaggggcaatatcatggctcactgtagccttaacctcccagtacactctatgatgctcaaaatcacctaatttctcagattgtattcctaccgttaaaccactcatgattgtacatctcctttttatcatatttaacaagataacagcaaccttgagcatgtgcatacacacgcacagagtcagagttcccttccttgacttcacctattggtttcccatgcccagatgtctattgtgtccctaatcatatcactttgtgctatgttacaattacctatctgtgtgacgtagtccctgactaagctgtaaactccgaggagatggagcctgtgtctgagactgtggtattgccactgcttagcacattataggtaatcaatagacatttaataagcacacaaacaacatgtgacaaaccaaggaaataagaatgaatacgtgatgcgtttgaacacacttacatgggcatggctgtgttggagacaagaggagagtttttgatggggtggactgtggtccttggacattaagcagtaaggtgggctagaatatggagactttaagtattcaggcctggtgatctagagagtaaagaaccattttttttccaatttaaaaattgcagtaaaatatgtgttacataaaatttgccattttaaccatttttaaatatacaattctgtacactaattacactcacaatgtaatccaaccatcaccacaatctttttccaaaaccttttcatcaccccagagcagtaactccctattctctctcttccctgagtccctagtaacctctaacccactttttgtctccattaatttgctttttgtttttttttcctttggagacagggttttgcgctgtctcccagcctgtactgcagtggcacaatcacagctcactgcagccttgacctcctggactcaagtgatcctcccaccttaacctctcaagtatctggggctacaggaatgtgccatcatgcctggctaatttttaaaattttttgcagagatgagatctccccttgttgcccagacttgtcttgaactcttgcactaaagcgatccttcctcctcagcctcccaaagtgctaggattaaaggtgtttgccaccatgcctggctgaatttgcctattttagatgtttcatgtaagtgaatcctacagcatttgttcttctgtatttgttttatttcattttgcaaaacattgtcaaggttcatctatgctgtggcatttttaagtagaaaagtgatttagagccaccgacatcttggaaagacagtgttggaagatgcatacgggtgaggtgttgagcacctcattccagttgcttcagcaccttgctggcttgtttactattgtagagagcctttattaatttctaggggctggaaacctaaacatattacaagtgtgtcaccaaattttgatcagtatctacagcttacatttgctatgactgagggcatgcatggtttatagtgaaacctgttcgatgttgatatctgttataatgacatggcaaaacatgggatacaattgctgggagaatggagaggagtcataaacatcaaatcagaaaacaagccaagagagggataactgtggctgcttttagaggtgagcatcattgtgctgcagcagtggccacgtggtaatcatttctggtttgtcacaatgcatagagcttttgatacattttagtggttgccaaaaatgctagaattggagagcatgctacatatacaaaaagtttaagaacaaatatacctagagtcataacatgctcatatttcatttgtaaaaagtcaactctacatgctagagacagagagagagaaacagagaaagacagagagaaagaaaaataactaaactgtacaagtgatcctggttgccatttcactcagtgagtttatgtcccagagttgatgtgatctgggaaatacacatggattttcatagtttccattgtgtgatgttgcagaagagcatgagtccagggtttaaaaatatgtacttttcatacaacatggtcatgaaagaaagtctacttcatctgggactcaaatgaagaatcaacgtattccaaagtcagttgtgctggacttaatgaaagagggcatatcgctctttaatgtagcacatatctaatagattttctggcacaattttgacaagacacaattttcatcttatgggctgactttagaacctaacttctcctctgattctagattcatcttcattgtagaagacaatggaaaagcaacagcatccttcaagttttcttggatataacctgcagtgctattgagatttaggactggaaaatagcagaaaccaactagagctagctgaagcataaagaaaagaagatactggttgggggtattttataaaaaactgtatctgtacatgcaggtgtgaggatgcaaaggaagcaatgactgccttccaagaagatcacagactttcctctaagtgagtctcgagctgtaactgcatacgaatcacctggagaccttgttaaacaggcacatcatcattcaataggtctgggattatagatcatgtaacaagcccccaggtgagttgatgccactgaccctgacagcaatttgagtagcaagattcaaatgcagctattttgataacccagtctctgaaactttcacttcccaatttcagatttccaagaggggacatgattgccccagtttgggtcaggcatctaccactcctggatccatccacgacatccagcggtatcaggtcaagaaagagcaaaatcactatcaccaccactagcacgtaatgaatgttaacaactggcctttccctgggctatgcatctcatacacattatctcctttaatctgcaagttaacgctttgaagtgaggggagaaaactgaggtttagagaagcccagttgttaatgagtgtaaaagctggtctttggccacacggcctgactctagagctcctgtgttctaccaacttcaagatttggccaggagagtgggatcccttgggtttgtgggaagccagttctaagaggaagaggaatcactgtcacctggagttggcccctagattgactatatagccactttattagtatttgtgaacaaaggtgggaacaagttaggttactaaaattttatgatttccccaataaataatacccctctttccacccaacttcagaaaaaggacagagatgtcacatgggagtccaaagtatatatagcatgaagagcagctaaaagcaaggtctgtgggacagtttagaagcccactcctcgccagcatgccctgggccttgtctgtattccagacctggtacgtcaggatctccatgttcccagggtccccaggtgaagggttggggttcaccgacactacctggaatttcacaagcagctccagacaatggcagggctctctcagcattcttgttggtaggaaccaccaagctcagttaaccccggggctggggagctcacgaaaatgcgtcctctctgcagccaggctgattgaaagaggcagaagaggattctctgacaaggggaagaggcggggaggggccagagagagctctgcggttctcctgcctcacgctgcatattattaaagtatcacctgggaacgaaaaaaaatcaataattgggttcaccctcatatagtattattattattattatttattttgagacaaggtctcactctgtcacccaggctggagtgcagtggcacaatcatggctcactacagcctcaacctcctggtctcaagctatcctcccacctcggcctctggagtagctgggactacaggcatgcaccaccatgccaggctaattttttttttttttcagagatggggtttttccatgttgtccaggctggtctcaaagttctggcctcaagcaatcctccctcctcagcctcccagagttctgggattccaggtgtgagctaccacacctggcatgaatattcttatttagttggcacatcgtagggtgggccaattacaatatgtttttaaaaagtcttcttagatggatataacatacactggtctagcttcagtccctctgtggagacaggagtggggagtcagcgtgccttcttaacaattactctcctactttactgtggcgtgagggaaaggtattagagcagggcttctcagactttaatgtgcctaagcatcagctgaggatcctgtgcaggtgaagattgtgatttggtagtcctggctgggacctggaacactgcctttctaagcagctcccgggggtgcttgcagctggtccttgtaccacactctgagcagcaaggagctacatcaggggttctcggcatgcagtagagtcaccagagacacctgctcatgtgcagggccccagcattcctagctcagaaattctgatcctgtgggtgtggggaaggggtcaggaatcttcatttttaacagccatttctggggcaggtgattgagtgactggagagctccatgttgacaaacactgggctacagaagtataataaaacctgagaaatgctattacgaaaacaggaaaagagagaacatctgattaatactctgttctcaacagtcaatatcctgatctagtagagctatcattacttcaatgtcattattcagggtaattttgaataagactttacctccccgagtccttcccctcaagaatctctgctgagtagagatttttaaaacaaccagaacatgttagtctctctcgatagagagagagagagagatgaaagagaaatttattctctcagcattttggggccagaagttcaaaatcaagatgtgggcagggttgatcccttctagaagctaaaaagaaaaacatgctccacgcctctctttcctagttttcggtggcttctgacaatccttgcatccttggcttgtggatgtgttactccaatagctgcatccatagtcaaatgactcattttctctctgtgtctgtgtctgttagtgcataattttatttcagaattctaaattgccttcagatttggacaaattttcctcttcatttggtgtgtattatagttgatttgtgtccccacaaaagatctgttggattcctaaccccggtatctcagaatgtgaccttatttggaaattaggtttttatagatataatcacattaaaatgaagtcattaggatgagccctaaaccaattaggtttttttttttttttttttttttgagactgagtcttgctctgtcacccaggctggagtacagtggcaccatcttggctcactgcaacctcagcctcctgggttcaagcgattctcctgcctcagcctcctgagtagctgggactacaaatgcatgccaccactcctggctaattttttgtaattttagtagagacaaggtttctccatgttggccaggcttgtctcgatctcctgacctcaggtgatccacccgccttggcctcccaaagtgttgggattacaggcatgagccaggttgtatctttatatggctgtgtctttacaaaaaaaaaaaaaaaaaaaaaaagaacactgagacccacacagggagaccaccatgtgaagatgatgataaagatcgggtgacgcttctacaaaagccaaagaacaccaaagattgccagcaaaacaccaggagctggcacagagaagcacggagcagattctccctcacgttttcggaagaaccgaccctgccaatactttgatctcagaccctagaactgtgagataatacatttctgttgtttaagtcacccagtttatggttctttgtttacagccctagcaaactaatgcagtatgtatatactacacaattccataagcacttgctggaaagggaagtaggttttaaattctgtgtggaacacatgtatagataacacatgggccctgacttctaagagcttgcagcgtaggagagaagtctactaggaaaggaactcacacacagatcccagaaatcctgaaattggtagaccatgtaaagtggtaggctgtgctctggggagaatgtatttatttgagagggagctaggaaagtttcactagatggataggcagagtgtgaatcagaaattgattctcaaaaaacttaaagcagacttaccattcaatccagcagtcctgttactggctatatacccaaaagaaaatatattgctctacagaaaagacacatgcacttgtctgttcatcgcagcactattcacaataacaaagacacggaatcagcctaggtgcccttcaacagtggattggaaaaagaaaatgtggtacatatacaccatggaatactatgccaatataaaaaagatcaaaatcaagtcctttgcagcaacatggatgcagctggaggtcattatcctaagcaaattaatgcaggaatggaaaaccaaatactgcatgttgttacctagaaaggggagctaaacattggatacacatggacatcaagatggcaacaatagatattggggactattagaggatggaaggagggagggagaaagggggggcaactgttgaataactgttggatactatgctcactacctgggtggcaggatcaatttttccccaaaactcagcatcacacaatatacccatgtaacaagcttgcacatgtactccctgcatctaaaataaaagttgaggccagatgtggtggctcacacctgtaatcccagcactttgggaggctgagacgtgtggatcacttgaggctgggagtttgagaccagctgaccaacatggtgagacccccatctctactaaaaatacaaaaattagccaggcgtggtgttgcacgcctgtaatcccagctactcaggaggctgaggcggagaattgctcgaagctgggaagcggatgttgcagtgagccgagatcacacctctgcacctcagcttgggcaacggagtgagactctgtctcaaaaaaacaaacaaccccctcgtccccccccgaaaagaactaatttctcaatttttttcttaaataatagctaaagttcaggctagccttgaaatgtttccctctcttaatctgcatggagcaacattattagaagaaacaattgttgacaatatattccattcactgaactccaaggagttgaaccttgctaatgtttcagcttcagttaggcagcatgatcactagtatttttaaagaatgaatttcacacattctcaatcattttcattgctctgtgaatggaagcaaatcattggggttcagaatattgttctgccaacaaaataatttacgttgccaggagctggagatcctaaaaaataacaaataacatttgcaggccaaacaacacagtgcacctaaagaattttctgtattttattctaagtcaggcttgtaatttctcataccaaagcatctcagcaaaggccagaaaggggatttgggaaagccaaatgaagctcacaccgtccctttgcttttaagcctacatagataccaagccagttttcaatatttctttggcccttgttactctgttagagccatttactatttctgatctgtgctcagcacagaaatggcaggcctgatccagcagatccataacattttgaaatcgtgagctctgtttattaaaatgtctggtcacctgggtgatgaggcaggggaggatagactgtcagataaaataaagacatgcatgggacattacgaatcctaacaatgatttggtgatgtgcgcctgtggtcccagctaccatcccaaagtcaaatttaactgggaattttattttttatttttctaagaattaaagcaaacaatctattttgaagtaactcagatatgtttcatttgttacatctagttatcttgaaacacagtaaccttggctgggtggggtggctcaggcctgtaatcccagcactttgggaggccgaggtgggtggatcacctgaggtcagcagtttgagcccagcctggccaaaatggtgaaacgctgtctctactaaaaatacaaaaattagccggccatggtggcggatgcctgtaatcccagctactccggaggctgaggcaggagaattgcttgaacccgggaggtggaggttgcagtgagccgagatcgtgccattgcaccactccagcctgggtgacagagccagactttgtctcagaaaaaaaaaaaaaaaaaaaaaaagtaactttggtataatggttgaagaaaaaggagaagcaatgtaagcataaatgcctgaacattttactcttttatcaataaacattactagaatgcgatgcatttgaatccatgcttttttccaaggaaaaccttcattctatcttctgcttcctgatatcgaagctggatcttattacaagggtaggatgcaccatggaaagcatgcctaatttttttgttcgttagtctttttgagatggagtttcactcttgttgcccaggctggagtgcaatggtgcgatccccgctcactgcaaactccgtctcctgggtttaagcaattctcctgcctcagcctcccgagtagctgggattacacgcatgtaccaccatgtcctgctaattttgtatttttagtagagatggggtttccccatgttggtcaggctggtctcgaactcctgacctcaggtgatccgcccacctcggcctcccatagtgctgggattacaggtgtgagccatcacacccagcccatgcctaaactttttaaactacagaaggaaagctgatcttcatcagttagatctctgcattatgcagactgaccactgtgttattatatataacatggtgaaaaacactgttacatatggcttgttgatagccccacctcagtaatttagttaagctttagatagtctgttaaccacaaaggcagcatttgatgtcaggtcaaaaatcagatccaactatgattttgtggttgatagttcagagaatgctctacaacaaaggaattgagaatgcagtgtgacgatatctttctaacatttaattcagggaaaatgtcatcgccagcacagcttaacattaactgggcattttaaatttttatctgctcacctggcaaatctaattacagcactggtaaaattacaccctggaatagaaaaactgtagcctaagtcacatggtgaaggacaggtatgtgtgagagagaaaggggaaagaatgagctttagaattattctgatttgggcttgatttctgaccctctacttgatcatgtgaccttgggcagtgtgtctgagcagttcctccaggcttgctttccccctcccatctgtaaaatgggcgtctattttacagatgggagaaagatatctcctctggttatttaagatgaagtgttaactcagtgcagtgcagttctgagtcatattggagtctgacgcaaaaggaaaaatcggtaatactgaactcgtatttatataaaattttgacttttttcaattttatttatttttgagacaagatctggctctatcacccaggctggggtgcagtggcacgatttcggctgactacagcctcaacctcccaggctcaagtgatcctcccccagcatcctgagtagctgggatcatacgcgcacatcaccacacccagctaaattttgtgtttttttttgtagagacggggtttcaccatgttgcccaggccgatctcaaactcctacactcaagcaattcactcacctcagcctcccatagtgctgggattacaggtgtgagctactgtgctggggtgacatttttttaatcatgggaaaaaattgcgtgaagttggattttttcaaaagactgcattgaaatattatttatcttgtcaaccacgttttcgggtgcgctcttaaaatttgcacttcggcaggtacctcactcatttaaccctaagcctggccttggcactcaatgactgttaaatattaatatttaatgtttgtatttaatttaattaatatttaaatgaaacaatgttaaatgttattaaccctcttatattccatttccttgtagtatcccattagaaacaataaggacaacaaacatttataagggctcactttgtcccaggcactgtgctaagctcctgaagtacatcattttgttgaatccttaaaattttaggagattgttacgattatttccactttataaaaagtgacatttttaaaaatttaagctacttcccctagaagacatagctagtaaatggagttgatgggcattagaaattaagttttgtttgcttttttctgcagggctgctgaaacttgtttgtacacctcgtgttgaattaaagtatgaattcagactcagcaactcctgcctgcattaacccagataggcctctaggtgtcctcattgaccaagctccagaattctaggccagagaaaaactacttttagaaaagggtttctcaaatagttgtgtgacatggaagtgcacatttatgagaaatatagcagcgttgagtgtccgtgtgagatggtgatcatgactctaaaataaaataaatctgcttgcttatgtgattttctctatgaatattcagctccttggctacaggttgatcgctggattttaatacagtcctaaaggactgagattttgattggctgcaaatagatttgatggatggatggattcttgaccaatgttatgtagatgtgatggaacccaaatgtttgttttaagaacctttaaaactgtgcccacttagtccaaattgtaacagatttctaaataaataaaaagaagaaagaaaaggttttctcaggcgtttttcaggtttctcaggttttctcaagagtttgagttttcttaaactctttcaggggagtttctatatattctgtgcatgattacagaccaaactgggcctgtcctagaaggttttcagtctgaagaaagctctgggatcaagcagggccaacttctctgtggatgggaaggatatgacacccatttgctcagcctacaatctccaagggtgtggggtttctcaaacatctattattgtgctacttactcctgagcaggggcctggcaactaggtttcctgggtgtcttgaatctacaggacatgtcctgttttaatgattttgcttggtgtcctgtatggattttttttccaggatgccttaaatgtcctatattcagctttttaaaaaattaagttacaaaaatttggtggttagagctatttttcaaatttaattggcctccggtatttgcatttgttaaatctgaccgtcctactggctggcttgtttgcattcatatgaacatagaaaaggtagggacctgtctttgagccagcagcagggctgtcctaggacaagcctcaagtgcttgtcctagtcctgactaagcagaagagctgtagctgaactgttaggaaaatgccttaatcagtttgattcctcaggttagacctgtgtgaaacctccctgcacagtggactccagagtggaacaaattcatgctttacaaagtttctgtcttatacatttgtgaattggaatccaggcctgtgtaccttctagctatgtaacttgggcaaactacttaaccttcttgagcttctgtttggaattaataattgcaaacttgctgtgaggattaaacaagaaaaaagtggccgggcatggtggctcacacctgtaatcacagcactttgggaggtcaaggtgggaggatcacttgaggtcaggagttcgagacaagcctggccaacatgatgagaccccgtcactactaaaaatacaaaaattagccaggtatggtggtgcatgtatgtaattccagctactcgggaagctgaagtggaagtatcacttgaacccaggaggcagaggttgcagtgagccaagattgtgccactgcactccagcctgggcaacagagcaagcctctgtctcaaaaaataaataaataaaaataaaataaaactaaataaataaataagaaaaaagtgttcccagtacctacagcagtgcctgagacgtgaatcagccctcaacaatgatgagttagtttagtattgtcatttcagtggctaaactaaggcagtgcaaatcctccaaacatcatcttaatattcaacaacatcttctgacttttctccctcaggaaatagtttatatcatgaaataccttctagagacttgatgttatgctgagctggttaggtgcattatcttgttcagcccacacaatatccttgtgagatatgtactagagaggaaactgaggcccagggaggtcaggaaacttcccatagttcatataagcagccagtagaaaggccaggaaatattccaagcacagcagtctgtctccaggtctgcatgacttcaaagcctacacatttaaccactattttataaagatggggatgtctgcttagacacccactatcagatccctgaaaggcttcttccatcataattgaagggctactggaaatgcccttcccagtcttggactgtcagtattcttgatgatatatttctcatcattgctttccaatccttaatctttccttttttctttttagagacagggttttactttgtcaccgaggctgacgtgcagtggtgtgatcatagctcactgtaaccttgaatccctgggctccggtgatcttcccatttcagcctccagagtattttggactacaggggcatgccaccactcccaactcctttttattgttttgtagagacaggatcttgctatagtgcccaggctggtctcaaactcctggcctaaagcgatcttcctgccttggcctcccagagtgttggaattacaggcttgggccactgtacccagccctgatcttcttatgaagccattttcttctgaaaatgaggagggtcacatagagaatggtttctctggtgaagttatgtgtgtgttgggaagaagaggccaggtgctgtgatgctcatctagttaactacatctcctgtcttccaagtacattccttaaacaaacaccactgctcctttcctccagcctgtctgcacaggtaattccagcccagtcagtgttaatgggccctgcatcaggaatatcttcaagccatgccctgatcaggagtgttgcaattgcacagcttgaaaatccaccagctgcaggctgccctaggctgtcttttcttcccctggttattttcaccctgctagtctgatttccaaccttccctttgaccttccctctttcttcctccacaggcctactttagttgcttcttcccttcccttttcattttcattgatttccatttaagagaggtggttgttgagcaattgctgttttctttttttggttttattttgtttttgagatggggatttgctctgtcactcaggctggagtgcagaggcatgatcatggcttactgcatccctgacctcttaggctcaaatgatctcccacttcagcctcccaaatagctgaaactacaggtgtgcaccaccatacctggctcattttttatttttttgtatagacggggtctcactatgttgcccaggctgggctcaaacttctgggctcaagcagttttcctatgttggcctccccaagtgctggaattacaggcatgagccactgcacctggtgagcaattgcatttttataatgtcatggttaataaagaacatgatggccaggtgtggtggctcatgcctgtaatcccagcactttgggaggctgaggtaggcaggtcacgagctcaggagtttgagaccagcctggccaacatggtgaaaccccgtctctactaaaaatacaaaaattagctgggcgtggtggcgggtgcctgtaatcccagctactagggaggctgaggcaggagaattgcttgaacccaggaggcagaggttgcattgagcggagatcatgccattgtactccagcctgggcaacagagcaagactctgtctcaatcaaatcaaatcaaatcaaatcaaatcaaatcaaatcaaatcaaatcaaataacatgagatgtggagccaaacagacgtaggtttgaattttagctttaccacttacttactgtttggccatgtaaccaaaggaatattaaactttctgaacctccctttttatatcctcatctggggataagaccatttttcttgcacagttgtagggagaattagatgggtaatgtatgcctgtaacccactgtttatggtgagaagtaaaaaatggcagctttctgtcttcttaccttgatagatttctttaatcctggcataataatctgtcttcacattcttttagtttctaaaactggccaagcttctcctggctttacagccttggcgaatgttatatgtcattctcttaaaccctagagagcttctattctttttgcttaattgtatcttctcttaccaatcctcaagtctaagcttaagcatcacctttccaaaggggcccattgtgtccctacaatctcagctatagctccccacccctctcaccacccttggctctcataggattgtcatgttaacttactgagagaggttacttctttttctcccctattggcctgtaagcttcaggaaagcagggaccatcgtatccccagtgactaggacagtgactgactgccacatagttggtatcctaatgtttgttggacacatggtttttttctttcgagacagagtctcgctctgttgcccaggctggagtgcagtggtataatctcggctcaccacaacctctgcctcctgggttcaagtgattctcctgcctcagcctcccaagtagctgggattataggcgcatgccaccgcgccttgctaatttttgtatttttagtagaaatggggtttcaccatgttggccaagctggtcttgaactcccgacctcaagtgatccacctgccttggcctcccaaagtgctgggattacaggcatgagccaccacacctaggtgcagtatatttaatgatcctcgttcccttcaaatcattaggagaagccagaacatgtctccagatgccccacagggtgtggtacagtcccagttgaaaaatcacagatcttttaaaccttgggtacttcacatgaatgttataaccattcaagaagagaaaattatatgaaactcagaagttaggtgaactcccatccccctcctagtcccagtacaccattcttgccaaggcatctgatattcaaaagcaaaaggaaatagaatgtgtttgtgtgtgtgtttagtgttaagaagagcaatcaggtaagtattgccaaaatggatctttcgcacacttcctattttcttttgcagaggtgacagattctccctgaatcatcaaaggcagaaaaggatgacagtggtatcaggacactctgatggtgggctcagattccaatctgagattaatctcagatgcactctttccaaagagaatcaaggtgaagcccacaggtccatacatctgatagggctgaattttgagagggtttctcaagggcattgtagaagagcatttcacaattcacattatcacactgcccctaaacaattcaaaatggggaaggatcaatagatacttacagtgtcactgatcaatatttagttcattatcgttatctgtgattttaacaagtatattcagtagggtaagacattttattgactagaaaacaatttaagaaatgtacttgatccactagaaataaataatgtacttgatccactagcaatcaataattcagcccagtgggcaccacctgaaactgggtagtttcctaggtaagggttattttgacctgtgcttggatttagacctaactcagcccttctgccactagtaaatgaaagaaaattaggactgttacctttaagaagtaacaatgagcaaggagaactgggcttagcatgtatacattcaattttcattaatccgtttaaaaagttatgtttgctactttcactcttcctatggagaagttgttcctggatagcattcacggaatgaggaattcatagtttagtatttggagtatgccaactcaggatttacttcctgcttttctcctactagtggtaaattacatgacctttctaattctcagattctttctctgtaaaatggagattatctagcactatacaccccattaggctgttgtggggattaaatgagaaaatacatataaagcacttttgcacaccagcctggagcacattgaactagaattcaacaaaagccaactcgtttttgcagcaggacatactttcttttttctactccaaagtggcacaaggatgggggtggaagggatacagagtagtagaaaagacccagggaagtccagaggaggggcatatgaaaacagagaaacaggccgggcctggtggctcacacatgtaatcccagcactctgggaggctaaggagggcagatcacttgaggtcaggagttcgacaccagcatggccaacatggtgaaacccatctctactaaaaatacaaaaattagccgtgtatggtggtgcacacctgtaatctcagctactagggagtctgaggcaggagaattgcttgaacctgggaggcagaggttgtagtgagctgacatcgtgccactgcactccagcctgggccacagagcgagactccatcttaaaaaaaaaaaaaaaaaaaaaaaaaaaaaaaaaaaaacagaagaaaagagagaaacaggacgtaagaggctcgctaaacttttgagctgaaaaaggagtgaagcttttcattaccttctgggctttgtgtacatgtcaaaagattttgtctttggaaatggactgcatctccatgccctgtgacataacaggagacaactactgtttgtcttgtcttgataagcatggatgaagtacctcccttgacataactccaagtcagcacttattaaagggtggtctgtaacgtggtgcaaggtaagtacagaaattgagagttggtgtttagaaactttgattccaacttgacagagtagttttatgtctgctgaatctaataatacatagggatgtgtattttcttacgttttttcaataatctagcaatttttttctgaattagcttttctcctctagtaatttgcttttattttactttataaaactataggtacacaatggattggaatctttaaaaattggtctttcactactttgaaaagcactactctagaaaataatctaaacttgcctattgtaccgaagaaagtcattcttccagttctggaagctctttaaggactcacctttgtagtaactctttagtctgagcctttgttcctaagaacagaccaaactaatagtttaaaacaattccggaatctttatttcttgtaatatttaagcttttgtgagtacaaggaagaattttgaaaatttttgtcaaatatagaaaaatagataaacatctagtagggtgaggcaattttaaaaatccaccttgttaaacatatatctttatgaggtagatcagtatgtcttgatacagaggcccaagatatattaggcagaaaacaaaacaaacaaaaaaaaatgttgtaaaactgtacttgtaatatgctggactttaaaaaaattactatatgcatagaaaaaaatccaaacaaatatacaataaattaactattatatctgagagtgttcggctaatgggcacgattatgtttttgttatgtactattttggttttgcatttaaccatggtattttgtaataaaaaagaggaaacgtacatgttgaataatgtacttttgtcacttttggcttttaataaataacgtagtttaattggtttaataccaatgcggttgagaaatgtttttcaaaagagacgaagaaaaccgtgcagtaggattgctgaacttccatttctttcttttttttttttttttttttttcttgagacaaggtctgttattgcctaggctggaatgcagtggcacgatcctggctcactgcaacctccgcctcctgggctcaagatatcctcccaactcagcctcccaagtagctgagattacaggcacacatcaccatgactggctaatttttgtattttcatagagatggggtttcaccatgttgtccaggctggtcttgaactcctgagctcaagcaatcctcccacttcggcctcccaaagtgctgggattacaggtgtgagccgctatgcctggccctgagcttccatttctataccttcttttcctctgtgggagccaagttatatttgccctttcaaggcatgcttgcaagtgtaaccatactatttcaggaacagaaaaatgttattttatgcaagatacatgtatggaaatatatttcatttccactcccttctccacattatgtaggattaaaggatgtcagagaactaatttcttgaatttagaagacctgtttgccagtctgtgaaattagtataaattacttgctacaaataaacaacattcccaagattaaaaaacctaaaagttctcaccagtcatcctcagtgagacaaactaccgcatttcatcaattctaaggcaactttattgtaagacacagcattatttttaatgtactattaagaaaaaactgccaattcaagtagaatatgccatcaataaaaagatgaaccatgtttttaatgtaaatatttaaaaatgtacatcccggaattaataaaatacggtaatactataaataaaaatccgaagccttgcccaatatgattacttgaagtagagcactgcgacctgcttcacatgaacccctgacataaatggaagaaaacgtaaacattttcagtagcacaccttttgtttattgacctatgtaaaaaaataataggtcttgaaaagtcagaacaataaaagaatatgcaaaaaggttatttctgattctagaaggctatacaaatatgcaaaaaaggaataagttatttttttttgcttgtcttttttccaaaattttttcccaaacttcatttctaattatacaaatgactaaggaccagtttaacaaatcgtttttatgtatatattacatgctttggaatatagatagaaaatgttccaaaaaagttgttcagaaacttttctattcacaatatgaacaagaaacttgtataaaagaagggggaaaggagcaccttttatgtaattttgaagcaaagatgacaaaaaagatcaatctggaatatggaaatcatttgctttaaaaaacaaacaaacaaaaccctacaataaaccatagctaattagttcttccaaggaaagtatgaggtagttttagcctcataattaaatccactgcagcttggagctttttgtcgttgttgttgtttttcttttttaatgttaaccttgtttttgtcacttggtgacttggaactacttgtggaatccagacttgtttaattttctaacgttcaccattttaaggcacgcaattcatctaaaatgacgtggctttttttttctgttgttttggatactttctgtatcatcttaaaatgctttttcaaactcataattataaaaactttccatattaagtctgccacttcaaatgacagccgagttggagaattaacagccagaacaatagctcatcacgcaattagtggagaaaggaaaaaggagctccatgatattgtaccttagaatgttctccaagcagactttgtcaattattcagtgggctgcttcattttccccaatctgctaccataagttatattacaggatgctaaggtaatcagtttttccagaacccattttatggtgcttatgaaaaacatcactctttatagtatcctaaaaaacatttacactcattcagaacttcatgaaaatccagcttcaagtaattttccaatactgtctaaattgtccatgtctgtgtagaaagagcatgttactctttgtcagctcacgaattcaaactctgaagtgagcaatgactccggagcttctggttccccttctctcatcctgctgaattgtgctctgagatttcccctgttcttattgccatgggacatcctgaatgccctttcatgtttttgaggtttgcctttaacaacttttactcccttaaaaagtgcttgctattgatgaaggcttcacactgagtcctctcttggcaatacttcaacatgtgggcagaccctacagttacgttagtgcctagagtttgaaaggccaaatcctcctttaggggctttgtggggcttggtgtgtgattcactgattcacttccagggcaactaagtcttctcttcaacctttgatgtctttaggtttctaaaacgaacatcctctcggaagacaaatacaatttgcaaggcacactagtgtgagaacgcagtgcttggtcaggaggtccaactgcagttcagactaatgttccaggctttgaatcttcatgccaaaagagtctctgctcactactctccaggttgtcttccagctggtttccatctgtaccatccagttgactgatttctgtgtattgtctattaaagaaaaccagaaaagttactacttgtggccatatttttgtccccacagcacaaagactactacatttaaagaagttagtaggaagcactgttaagaaaaatttcccaaaatgtagagataagggaaaggagaagggtgactgcatgttctttcaatgtcatactggagcattgtttaacaggcccataaaaaggattatttaattctctggaaagatatgcctttgtttaacttgtgtttcattgatcaggacccagactgtattaagttacatgttaacttgtagatttttgtctcaaagaaatacaaataacttgtctagtaaaaaagattatggttacagttttattgaactataggacattaactggttttgtatctaatttagtagtcttttccaacattctctctttcagtgtctcggagtctctttgaaccagctttaccatcctgctagttcacttattaatgagttaaacaaatcttcggcccatgtccatttttacttgtgtgacagctatatttttaactttttaaaaagtatattgtgacaatcacattttaagtactcttcgaattgagggaatatgctagatgctttcctcagggacaaaataatatatttagaaggtggcaggggcacatagggacatatatgatatccctggggtttatgggtcaggcataaattggaagtgacccaggacacagcatcacatttaaaaatcatacgcatatttagatggcaattccaaatgagagcatcctatcatacaaaccattccgataagcaaaaccccattattgtaacggtaggttaagagagattagacagttagttgatttcttttttattttacattccaaagtattttagtaaaggtgattttttttttaaagtctttggaagaagagctttggaaataaaggtttttagtgttttcatgtaacataaaaaacaaagccagatttcataatttcacacatcagtcagtgcaagcaaaactcctgctatgcaagaagcaacacacagattggaggtactgtacttactacagctggctacacttagcaaaagagaatttacaactgatctcacttctggagacacaaccattcttggggatagaagcccttggttttgcctagtaatagagttagataggaaaggagaaagggaatggaaaataggaggtgaaagaaaaaagttatttgaaaatacagttggcagcagtagagccaagaatttgactgtattatatactaggtagcttcaacatttctacttcggaaagtttatgctaatgacaattatgccaattgtactagaaaaaaaattttattggtaaaaattagtacctttctataattttaagacccggatactctagggcaaaggatctttaaataatatacactttatttaaaaaaacaacaaaacactaatatattgctatgcatttcaaatctttggcttaacgggaaaatctagtttttcatttttatcgttaacacctaatttctctcttattttaaaaatcatgatttcataaaaacaatttacagaattttagagcaaatttataaagctttatgaatgattgttattatccttgccctgttaataggttaaattgatcagactgtatcctaaaaagaatcctaaataaacaaatggatggaaataagtacttctgtatctccgtggctggaaaggcaaagttgcaaatctttctggaaggcaagagcttaaaaaaatacacttttcaatttaatccattaactctacttattggaatatatcctaggaaaataatctgggattcagacaaatattttggacaaagatgttaacagctgcaatactgggctgggcgccgtgggttacacctgtaatcccagcactttgggaggctgaggcgggtggatcatgaggtcaggagttcaagaccagcctggccaacatggcaaaaccctgtctctattaaaaatacaaaaattagccagatgcggtggtatgcacctgtaatctcagctacttgggaggctgaggcaggagaatcacttgaccctgggtggcagaggttgcagtgagccgagatcgtgtcactgcactccaacttgggcaacagaacaaggctccgtcttgggaagaaaaaaaaaaaaatagctgcagtacttttataaaaaaaagaaggaaaaatctaaaagcctctcaaaaaaaacttcaaaaaatgaggagctgctacgtaaagtagggtatatttgagtggaatatcatattggtcatataaaataaggtttaaagagttttaaaacacatgggaacatggttatgttatgatgttaagtttttaaaaaaatggagatgtagaatttcatgtacaacataagatgtaaaactgtatgtacaatatcattataaccatgttaagtggacagagaaaaatggggaaaatatgccaaaatgttaacagctgctttctctggatggtggaattatggctaatttatttcctacttatttatctctttattataaattttctaccatgagctcatatatgcacacgcatacacaaacacacaatagggatctttaaatagcttctaatttcctgtatgttatgacccctctgatcccctatcaagccatcttgggctgtctgatatatatgagcagacttggtaaaaacagattttctctaaaaatgcttaacacttcctgagtccaattacagtagtgttaaggatatgagaactgagtaatgcaccaaaaactgtataatcatttctgagtcaacaaaaaggcaagtaaaattacacaaacacgaaaataatttgcaaatatattattaaaaaatggttagaagtaaactgaaaaggctaggctcaaattttaggccagtcattttggttcttgctcctaactcattttcaaacattatttacagaagtccaagctatttgacatcctctgaagtatattttcattaaaattctattttgagtatagcctttgtttagctgagacaattggcttaatatttgaagccaagaaaaactcccactgaatgcggaggaaaaaaaaaggcatttggggctgaatatttccaatttgattgtaacagtgagtgtcttaataagaaactgctaaattctcaaatttaccagcatagaaacctttataagttgtagtctgtataacttagtatgtagtctgtgtctgaagcactatgacttaaatcaaaactacacattctaaaaacaggagaaaatgccctacttcttggtaccatgggtgtggattatcttttgtgggaaagtaaaagggagacacgacctcttcaaacttaattcctgtgcataacaagaatttttttaaaaactaattcagagtttgcaattttttaaaaaatcagttttaacaaattgctcttgtacatttcctctaatgtttacaaagaactacttttacagacaaacaggacagctggctgtgtctgttgcttcataacaaacataggatcagataaaaaacgcagcaaatgtttgaaatccagcctaccaactgtctaaggaaccttggtatgaacagcctttcctggagtagagagatttttcctgcaaggtttcaaaagagacttaaatggacatatcactaataggatttcaagtaccataatttaaaaaataaaagcttcagactcagaattcaatgtacagactaaagaacagaatgcgttagatgaggggttagcaaactttttcttttcttctctttttttttttttttttttttttgagacggagatggagtctcgctctgtcgcccaggctggagtgcagtggcgcgatctgggctcactgcaagctctgcctctggggttcacgccattctcctgcttcagcctcccgagtagctgggactacaagcgcccgccaccatgcccaactaattttttgtatttttagtagagatggggtttcaccgtgttagccaggatggtctcgatctcctgacctcatgatccgcccgcctcggcctcccaaagtgctggcattataggcatgagccaccgtgcccggcagcaaactttttcttaaaggccagatatttttggctttggtgtctgtgcaagtagttctttgtaaacattagaggaaatatacaagaattcaatgtaatactgaagaccagggtcaaatctgaatgagttagattaggggttagcaaactttttcttaaaggccagatactttttggctgatggtggccagatatttttggctttggtgcaactactcagctctgccctcatagtgcaaaaacagccatagagaacatgtaagtgaatgagggtggctattctccaatgaaactttatttaccaaaacagatggcagctggagttggcccacaggctagagtttgccaacccctgaactagattatctgacgtttgtaaattaggatccctgaattcttttgaactggaacaggctcctaggattttcgagcattgcttcctcacctgcttggagagggtaaaggattatagacattgccatagcagctggtgtaagaagaatgtgctggagtctcgtaatccgacagccctatggttaactgggtcctccagttcccagaagcatttgtagaagacactggaaataaaaatggaaaaagataaaattaatggaaatattaaaagtgaaaaattgttaaggtcattcagaggtacattgcaatcagctttgtcagaggagaaatttaagagggtttgaaataacagagttcctattccaatttagtgacttcctggctatgtgaccttaggcaagtagtttatcctctttaagcctcagtttcctcatctatagagtagggataataatattaatatattctgtataggtatgatgccaggattaaataaggtaattatgaaaatctttagcactgtacttgatacaaagtactcagtaaataactattaatattattattgagaataagattaattgaaagataaatttgtcaattcaaaaaataatctaggttggggccaggtgtggtggctcatgcctgtaatccaagcactttgggaagccgaggcgggaggaccacttgaagctaagagttcaagaccagcctggccaacatggtgaaaccctgtctctaccaaaaaatacaaaaattagctgggcatggtggcgcatgcctataatcccagccactcaggaggctgagacaggagaaatacttgagcccatgaagtttaagttgcagtgaaccaacatcacaccactgcactccagccttggtgacagagtgaggctctgtctcaaaataaataaataaataaaaataatttcaggtcagctcagtggcacaagcctgtaatcccaacactttgggaagtcaaggtgggagtaacgcttgagcccaggagttcaaggctagcctcagcaacatggcaaaaccccatctctgcaaaaaatacaaaaattagcctggcatggtggtgcacacctgtagtcccagcaacttgggaagctgaggtgggaggatcactcaagccttggaagtcaaggctacagtgagccatgtttgcaccactgcactacagcctgggccaccaagtgagatcctatcccaagaaagaaaataataataacacataaataatttttaaaataactgaaaagacaagcaagaaaacaattctcatatattgcgagaatcttcccattcacgctatggtgttataaaggtaaggtgatgagtctgggtttgtcagaggccttggaggaaatgtgttccataagttgacttattgagacttgactattcctcagccaaagacaacactggccgctagcaagatcaaggctattttttgtcttaaaaaaaagtgtgtatgtgttggggtgtggattgggggaagaggcgaggtggtaagtagcacaggaaggaattcaggaagaagggatttagttctacagaggaactgaactggaacaagacaaggacataatttgggagcgaagcccaacaaatgcctcatcactgggcgtttgttgtcctctctataaaaccagttctgctccacgcctaggatggacaagataaccacacgccatgatactcgttcaagactcaaaaaccagcactgccctttttccatttcctgtttctggcttcagacctactcctcttctctctcatacacacaaagtgcctgtgatcactatgggacaaacgcatttcaaaactcatctgtggccctggatgtcatgaggtgttgactaacagatgtaacactctgagtttgagcttccaagccatttccaaactgaaatcagaggctctaagccttggtggttaagatgttagagctgtggggctgggtgtgatggctcatggttgtaatcccagcactttgggaggctgaggtgggaagatcacttgcagctagggcttagaggccagcctgggaaacagagcccagtctctacaaaaaaataaaattagccaggcatggtggtgtgtacttgtagtcctagctacttgggaggctgaggagggaggatcgcgttgagccaaggagtttgagactgagtgaggtataatagtatcactgcactccaatgtgggtgacagactgagactgtctctttaaaaaagaaaaaaaaaaaaaaaaggagctgagctaggacagaatccccagaatccccatcccaccacttagtagctttggaacttgggttatttaaactctgtagccagagttgcctaagctgcaaaattaggatgataacaataagcataacaatagcaatcactatatagaactgttgcatacattaaataggagagtgcatgtaatgttctgaatgtgcatggcatctagtaagctgccaacaaatggtagttgtcattactaaaactgagtcaccgagagatccttcaggtggctggaagggactacaatgccaggactaatctggcaaataactggaaatttatcactccatgagaatgacgcctgcctgttgtaatacatttctgcagttttaaagtggagacagaaatgaggggaattccagcagggaattctgggagtactgattccacccctgtagttctttaaagagtgatgccttttggtctgtggggccacatcttgctggtgtcagcaaggctcacaccaggtctgaaacaggaagctttacctccatttcacctttactaagctagcagccaggaatgttgagtttcctcagttaacacctgcttcccccaggcaccaccccagccctgtgccgtagtgaccatccacatgcatctcagccctccttgtttggtctttcccttgtagtactctgtctgttctgcccaggtttgacctgtgaaagtttctcacatcttgaactttaagaggaagaaaggtgttttctaggtcagagccataaataagaaataattaccgaagccctttcatatgttagatgtggtaatagatgggacagccctagtggaagtccaaagtcctgcacaaataggagagaacttgaacccaaatagaaatctccatggaaacgcctcatcaacaagtacatgaaacttttaaaggtgtagttttcacttgactattatacaatgactcaggaatccttatactatgtctcactaaggtgtcatgttaataagggagaaggtgagactcatgacctacaggttttctggcagtttgagaattcattcatttcttagcgttttaaaattgcttaatttttaaacattcctctggctgctgactctgagctcatcgtggccaggaactagttcaacaatgggtcctccacatcttgaatgtggctgctcatttgctgaataaataaaaccatacacagagcctcccctatcttctatttctctacttaaagtacctagtacaactgggagtaggcaggaagtcctccacaaatgttagcagagttaggggccaaagtcaacatcaagagtataaaggaaacatctctaatcaaaattatctttgaaaatcccttaagtcaaccacaacataggtatatatgaatactgaattacaatatgcatggccaggcactgcggctctcacatgtaatcccaacactttgggaggccaaggcaggagggttgcttgaggccaggagtttgagaccagcctgggcaacatagcaagacccaacctaagcctccttgtttctacaaaaaaaaaaaaaaaaaaaaaaaagcaaattacttagaacagtgcttaatcaatgccagctcctataaggattcttacgagccttatgcaggcacttgcctaagtacctgcataatcccaggcttgcattcaaagcagtccttagatgatcaatcttggtggtgaaccaggagggatgtataattctaatgttttctgcttacctgagggtttattcttttaaaatatcaagcctcaatgacgtgaacacatttaagagatgtgcctgtcaacgtaaatcctaaaaagacaaagcaagtgaaacccctaacacatcccagcctaggcgacagagtgagactccttctcaaaaacaaaaaacaaaaaacaaaaaaaaaccctaaaacagggcagcacagagagtaaatgctcaatcaatgtttgctggatttgaatctacaatttgcttcattagactcatgtgtactgagttctttggagagctggaaagaactgtttttaagttggaaattcttattgtggggttccaccgaatggttgccccacttttgaccctgagtactggtctcatgatccgtgaggcggttttaggtgggcaggaaacacgatgtaaataaaatccaggtgttgcgtgtttttacagtattctcacctgaagagtacgaggatgcacgactgcttggagaacaaggtacttgcagccccgcaaaccccaggcatctctgtgatcccctgtctgagtcaaagctggtctgcgggctgtgtccctgatccttctgcccagaggcccgctggtaccagccacgcaagtgctcggcaactaaggccttgtggatgtttttggtgatgtgctccgattttgcagcagccttccttggcagccggagagttgcatatgggttatggggtacccggtcgacctcatcttcgtgaaaggatctgctgtagtccctctggcgctcatatccatagtgggctgaggaccggtaggaagggttgacactatactgtccctcggtgtcattctcatagacataaccaccactgtaataaaagtcacactctgcatagggtgtgtacccggcaatgtagtaactggaagacggtggctcctgactctttgagtaaacaccattcctcaaactatccttttgtgctaggttgggcatgcttcctgaatttgaagtagaaacattctgtttctttgacctcctccgacccctggtgcgagtgtccagggtctgggtggtgtaataggggccggtaactggtgtcacacagtaatactctgtgcttgattggcttgtataagaagacccgtcatcgaggatttctgtgctgctgcttctttgggatttggagagggagaaaaatggcttatcgctgtccatctcggagagcaggtgggactgggactccaggcttccactccgctggcggcagtgctgagatgaagattcgggtctgaaagaggagaaaggcaaacttctcaacaccaagaagaaaaggaggacccaaataagaaaaaagaatagcatgctgaatgactgaatagctcgtgaattacaataggactttgagttgccaaagctgactgcacaatagaatccattgttctccaaatctgttggctcacatgtaggttcattttgaccatggtcaaaatgagaaaagagctggcttctgttagttgcgcaagccaaatccttccttgagggtagggaaagacacagactgaggatgcacagtttgcatcacagcctggaaaaaaaaacaaaaacaaaaacaaaaaacccaacgtgtctttggagggtcctgtcttcctagaggatatgaagatatggtacattcgagtggaggtcagaggtggctgggctgagtcatggcactgctatttcccagctgtatgagctcaggccagatatttaacctctctgaatcttgcttcctcctttgtaagatgaggatgaaaacaatatataatatctacctcacaaaaggcttgctgtagggactaaataatccagtgaatataaaacatttagcacagcactcacaaacatttcaaaatgttgctattgttactaacttcatcctcaccattgaataatgaatggtaatatgtgactggggaaattaaggtactaaaaatctaatgtatatttgaacaaatcaaatacattttctttgccaacatatttgaaaccataagttagcagaaaatgtaaaaccataaaacaaggtcctgctacagaaagtcacttgaaatgattaaaaaacacaataaagcaagacagaacctcaaagcaaaaatcaagacagctaaagcaatgagaaagaagctctcttactccaagtggctgctgctgtaggcgtttcgggtaagaactggcgtggtgggcatgcttcgtcctccctggggccgcctctccagagttttgtaagggctgctgtgtgtggacagcatttctctgtgatgataaaaagaagaattcaggaaatgatgagtctctcaacatctctggcaaacttgtcataagcagatacaaaacttactagaagcccaaggaaagggaaaatagggagaaagataggaagagtgtctttgtggttcactaaaccacaaagaaaacccgctaaaacagcgggagcacatatggtctgactttctgagtcacaaatatgtagggaaaaaaaggacttttaataaagagtacactgaataaaaagactcaaagcaactagagctgtttatgtaggcacctgaacattcaaaacagtccttagatgatcaaatctttgtggtgaacagggatggatgtataattcagcaaactccttttttgtaaacagtctagaatactaaatagcttttggctttgtgggccagatggtctctagagcgactactcagctctgccctttcagtgcaaaagcagccatggataatatgtaagagaatgggtgtggctgtgttccaagaaaatgacctatggatgctaaatttcatatcatttttacaggttgtaaaatattattgcttttgatccccccaccaccagctacctaaaaatataaaaaccattcttagctcacggtctgcgcaaaaacaggcagcaggatggatttggccactggactgttgtttgctggtccctggactaagaacaacagctttaagtcactatgtctacttcccagcatggtgacaacacaattagaagttaattttttttttttttttttttttttttgagactgagtcttgctctgtcgcccaggctggagtgcagtggtgtgattttggctcactgcaagccccgcctcctgggttcacgccattctcctgcctcagcctccggagtagctgggaccacaggcgcccaccaccacgcctggctaattttttgtagttttagtaaagacagggtttcaccttgttagccaggatggtctcgatctcctgaccttgtgatccgcccacctcggcctcccaaagtgctgggattacaggcgtgagccaccgcgcccagcctgaagttaattttttttaactaaaaataattttgatcaaattttacttactacaaaagcaagtctaagttcattaggaaaactttaaaaatacagataaaaagaaaaatttaaatgtctataatcttttttttagatggagtctcgctctgtcatccaggcttgaggagagtggcacaatctcagctcactgcaacctccagctcctgggttcgagtgatcctcccacctcagcctcccaagtagctggaattacaggtgtacaccaccatgcctggctaatgtttattttttttattttttttatttttagtagagatggggtttcaccatgttggccaggctgttttcgaactcctgacgtcaagtaatctgcctgcctcagcctcccaaagtgctgggattacaggcgtgagccgctgcctgtataatctgataccttttacatagtcaggcaacattaaatgttttcagattatttttcctaagcacataaacttattagcatgtatttatacataaacatacatatttattttttaacaaaacatgagatttactatatattctttttcaacgctcactttttaaaaagttaagttgtacctaacattttatgttgcttactatttgcctacagtgttattttaatgactgcatagcattttattgtatggatttaccataatttatttaaataatcagctagttgaacatgtggtttgttttcaatttgccagtagtgtaagcaatgctgtaatgagcatcctacatgtagttagttaattcagtagtaaaattcctaagtgaaattgctggataaaaaagcaaatccatcttaagtgattggagatgtgggtataataatttttaagacaatgattcccagctataattcttccttttgctgaaatagctttgttttccctaacataagaagcacacttgtctcatgttatccaataggactttctgcaatgacaaaaatgttccgggtctgttctgaccaatatgatagccactagccacatgtggctgctgagcatttgaattgtggctagcatgactgaggaaccaaattttaaattttatttacttttaattaaattggctagcatggctgtagctccttggatctcttaccatttcaggcaaaagttcctaaatgctaatccacaaactggggccgatatgtgataaagatttcactgctctttaacaaattagaaatataacaatgtgacctggcgcggtggctcatgcctgtaatcacagcactttgggaggccgaggtgggtggatcacgaggtcaggagatcaagaccatcctggctaatatgaaacaccgtctctactaaaaacacaaaaaaattagccaggtgtggtggcaggcacctgtagtcccagctactcaggaggttgaggcaggagaatggcgtgaacctgggaggcggagcttgcagtaagctgagatggcaccactgcactccagcctgggtggcagagtgagactccgtctcaaaaaaaaaaaaaaaagaaaagaaaaaaagaagaaacatagcaatgtggaggttatattttcataagtcacaatttatccaccttgaataatctaataatctaccttgattttgagaataatttcctttatttaaatttttttaatttatatttttggcccttgtagagcaaatacttcccatctttgctgagatgtggtataacatgttcactgaaatcagatcacaagctttggatcctgccaagttctaggctacctaggttcaaaccttgattcccatgtttactagttgatgaacccaaagaagttattcatggtccctggccctcagtgtgcttatctgtaaagggtaatgacagtagtaacactatcagggttgtcgtgaagattaagttcattaataaattacatagaaaaaacataaacagtatctgggacacagtaagtactcaatagcggccagttgtagtgactcatgcctgtaatcctagcactttgggaggccgaagtgggcggatcacctgaggtcaggagttcaagaccagcctgaccaacatggtgaaactctatctctactaaagatacaaaaacttgccgggtgtggtggcgggcatctgtagtcccagctacttggaaggctgaggggggagaattgcttgaacctgaaaggtgaaggttgcagtgagccaagatggtgctgctgcactccagcctgggtgacagagcaagactctgtctcaaaaaaaaaaaaaagtaagtgctcaatagaaatgttatatgaaattaatataaaatgaaattaacattacattaagtgaaatgttaacttcattcgattaatattgccacaacgatagtgaatatattttttatatcaaaatgtcatttctttcatggattcatggtgctatttttttgaacatttcttttttttttctttttcctttttttttttttttttgagacagcatcttgctctgttgcccaggctggggtggagtgacatgatcatagttcacttcaattgtgaaatcctgggctcaagcaatcctcctgcctcagtctcccaagtagctaggactacaggtaggcaacaccatgtctggctaattaaaaaagaaattttgggccgggcacactggctcatgcctgtaatcccagcactttgggagactgaggcgggtggatcacctgaggtcaggagttcaagaccagcctggccaacatggtgagaccctgtctctattaaaaatacaaaaattagccaggcatgatggcgcgtgcctgtaattccagctactcaggaggctgaggtgggagaattgcctgaagccaagaggcaggggttgcagtgagctgagattgcaccactgcactccagcctgagcgacagaaagagactctgtctataaaatttgtagagatggggcttcattaggttgcccagactggtctccaactcttgagctcaagtgatcctcccaccttggcctcccaaagtgctgggattataggtgtgagctgccgcactcagcctgtgtttgaaaatttctttttaggcaaagcaaacagctggtaactgtttgtttgctttttaaagattgatccatacagccaagttctgggaaccactggcctgtcatgtttctaaaacctggtctcattgccctgataatatttacctgagatatttgagaaaatgcttggattatctattttacagattatgagtttaagtcccatgtttatttgcaggactggaaatcagtcctgctacttggttttgcagagtggactttaacgacaatttccttagaccagtgactataaaactgaactgtggacactatgtctaaatccagatgataattaatgtccctataagttaatatagatcaaatagactttaaagtcaaggaaatggtcaaatgcattttaaaagacttcttaaaaacattttcagccaggcacggtggctcaaacttgtaatcccagcactttgggaggccgaggcaggcagatcacctgaggttgggagttcgagaccacccggaccaacatggagaaaccccgtctctcctaaaaatacaaaattagctgggtgtggtggcttgtaatcccagctgctcgggaggctgaggcaggagaattgcttgaacccaggaggcggacgttgcggtgagctggagttcacgccgttgcactccagcctgggcaacaagagtgaaactccacctcaaaaaaaaaaaaatatatatatatatacatatatatatatgtatatatatgtatattcatttgctgtgaacaacaaactgggttagtttctatgccccagttttacaagataacatcttttggaaggataaataaaaacatgtgaaaatgtatcaaccatacattgcattttggaggaaaaatttcctagctgtggggcattaaccttactgatgatatgacctctcacctggactgcctggtatccacaaactgttcattgatggacgactttctgaaatggattcgctcaataccaagagacttggggggaagaattcttggagaatgaggtactgaacttgatcgctgcccaggaaaagtgaaggcatcactggctataataagtaaatgggtgaatgaaaaaataagtaggcaaattaataggtaaataaatatcttgccaatacctcaaaaaagaaattagaaggtttagtgaacaaagtgttcttccaaagatgatatttttagaagaacataactctttcaagaagttaatttttatattttatacaccagaaaaaacgaaaatactgaacactcttctgggacctgaaccatcttttgccaaattcaacaggtgtcacttagagtgagtaaatcactcaaggggaatgggtaatactgcagcttttaaaaagctatattaaagaaaacccccagtgtgaaccaaggggaagttggcctggatcatttttgttcacctttacttttaaagtttttaggcctctttggccaaaggcttatcctgtcattgaaagtaaggaaactgacttatgctgcatctttagaggcttgttatgttttccactgatatttacattttcaaagagggatggcaagcatgaccaaacatcacctcacatgaagaattctgcagtggtgaaattttatgcaccataaaacttggggaagagcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaacttggggaagataaagcagtgggggtgtggtttcctggaattcttcaagtcataccacagagatcgccaactcaatcatgattaagtacaagagatgacaaagaaacactctattagttgatagtaaacccattctataatggaatgtattgaacggctgggctcggtggctcacgcctgtaatcctggcactttgggaggccgaggcaggcagatcaccttaggtcaggagttcgagactagcctgaccaacatggtgaaaccctgtctctactaaaaatacaaaaattagccaggagtggtgcccaatgcctgtaatcccagctactcgggaggctgaggcaggagaattgcttgaacctgggaggcagaggttgcagtgagctgagatcgcaccagtgcactctagcctgggcaacaagagcgaaactccatctcaaaaaaaaaaaaaaaaaaaaaaaagagagagagagacaagaaatgtattgaacaaatacaggccattacaatcgatacagcctgcctctatgaaacaacaaaatgacaggtagcccaatgtctaactgtgcctttcttcctaaataaaataaactttcctttatctagaatatgaaagtttatttcacattgtaaaacatacaatgattttatttcatattgtgatgaatacagtgataacgtgtacaatctaatatcctggttttgatattggactccagatatataagatgtcaccattgggaaaagctgggtgaaggaatctttgtattaattatacaactctccgtaaatctatgattacttcaaaataaaaagttaagaaacactttagagagccttaaagtccttactgagagacttagatactcccgtgagggcattctgattcgctgaggtcatgtgatttttgtggtcctgttattaacgctgagttaacctgagtaggtgttaatcatacacttcctttcccaaccattttgcataaatgtaagttagtttattctactttttctcaaaagaaaaacaaataggccttacttaactaagaaaattatcttaattatttcagaatatctaacatttttaaaccaaaaaaggaagagccacttacgatcatcataggtggtggtgtcagacaaagagctactctctgaggggattatgtcttctgtgaataaaaataactgcctttagtacaattgtgcatttatacaattagaggggtcttagataaacaattttcaatggaatgcattttcatttaaataaatgtaattaattacagtgcattaagaataattaactaccatagtaagaatggactcatatactaacaaaaatcaaaacattttacatattgtacgaatatcacattagattatttcttaaaatggaacagacttcaagggagtgctggttttaaactagttttcggtgtttcttctacactggaataaaactttacctatatatttagtgcttatgatcaacaaactggaaagaaaaaatcatgccattcttatcataaatgctaaatgttaaataaaacacatttgaatcctcatttgaaaatctactcttaatataacttggcttttgacccctccctgaaagaaaaggcctttttttttttttcttgtttgtttatgggacagagtctcattctgttgcccaggctggagtgcaatggtgtgatcgtggctcactgcagcctcaacctcctgggcttaagcaatcctcccgcctcagcctcctgagtagctgagattacaggtatgcagcaccacgcctggctaactttttggatttttagtaaagatcaggtatcaccatttggccaggctggtcttgaactcctgggctcaagtgacctgcctacctaggcctcccaaagtactgggattaaaggtgtgaatcactatgactggccaagcttttcaacaggtttctcaacagtggcactactgacattttgaactggataatcctttgtcctggggagatgtcctgtgcattataggatttccagcctccctggttgagaaccactgaattaggtttaagtcttggttttgccatttatcgactatgagaccttgggcaaattacttaatctctaagtatcacctggctcaatcccacaatggggataacaacagtacctatcacgtagtgctggggtgaggcgttagaataacggatgtaaagcccctagcccagctcccagcattacatgacaaatgctcagtaaatgttagctagacttaaatctttagttaactagacactgtgttctggttggcaatggccataacactctattgctggtatccatcaaatgttaaataatgtggccaggcacactgcctcacccctgtaatctcagcacttcgagaggccgaggttggtgtatcacttgagggtcaggagtttaagaccagcctggccaacacagtgaaatcctgtctctatgaaaaatacaaaaattagccaagcatggtggtgtatgcctgtaatcccagctatttgggaggctgaggcaggagaattgcttgaacctgggaggcggaggttgcagtgagccgagatcatgccactgcactccaggctgggtggcagagacagctctgtctcaaaagaaaaaaaacaaaaaacaaacaaaaaaacaaacgtattcagtaaagaaaagtatctcagatgtgttgatctgcatttgcaaatcattccatattcacctgagtgttttggcatgaggttctaggcaaatataatcctcaatgtaaacttcaagaccattatgaagggaagctctccaaccaatctctaatgttaatctgtatcagaaacaagtgaactatctctatcagacacacagtggagcttgaaggcaaggtgccagtatagtcagctgttaggcatactttcactgtaaaggagaacatttgaattttgcacagtttgaggatggatgggccataacaaatggccatgaagttaagcacaacactaatcacccatatctgtaggtccagaaattaaccacccccaagactgcctggatttcacattcaaccaaagctactctacattctccagctgtagtggactaacacttgtgtgttgatgctgtacattccctttccaaaagccatgtctgctttgtaaatcatatgctctacacccaattatattctaaactcacttaccttatttcatcaaatctaagatatatattttaagtaccagcaaaaaataataaaaaaagtactgccaagtatgactgtaaagcaccatctagtgtgttaagaactaacccaaggctgggcgtggtggctcacacctcaatcctggcagtttgggaggctgaggtgggaggattgcttgagctcaggagtttgagaccagcctgggcaacatggtgaaaccccatgtctacaaaacattagccaggcatggtggtgcgtgcctatagtcccagctgctagggaggctgaggtaggaggatcacctgagcccaggaagtcgaggctgcagtgagctttgatggtaccactgcactccagcttgggccacagaaagagatcctgtctcaaaaagacaaaaacaaaaaaagacaaacaaaaaaacccaaaactatcccaatttcatagatgttaaaatgtaaaggaaaaaatgtcttagaatcaaagaaatacaatcatatttcagtcaccaggctgaaaaccataccaataaacatgtaaggtcaattggactttaaatccacctgggatttctaagtttatgttttttctgaaaatgaaagtcataaatacataatgttgagaacttggaaactacagaatattaagaagaaaattaagttacttgaaatttcacaactgttagtattttgaaatatttctcagccagtctttgtgtgtgcatatttctataaaattgggatcatgttgtggtaacaattttatatctggcttttctgcatttcatgttatatcatgaccatttgcccatatctttattttttaattttgttcacttttttttttttgaggcagggtcttgccctgtcacccacgctggagtgcagtggtgcaatcatagttcactgcagcctcgattacctgggctcaaatgatcctcccatttcagcctcccctgtggctgggactacaggtatgtaccaccatgcctggctaatttttaaaatattttttgaagagacggggtttcaccacgcttcccagggtggtctcaaactccttagctcaagtgatccgctcacctcagcctcccaaagtgctgggattataggtgtggggcgccatgctcgtgctgcccatatctttaaatagccttcacaaatcacagaaattttaaatcaagtgtacatacttataaaactgaaattccaaacaatttttatcctaagaaacttagtttgtcaggcgcagtggctcatgcctgtaatgccagcactttgcaaggctgaggagggtggatcacctgagatcaggagtttgagaccagcctgaccgagatggtgaaaccctatctctaccaaaaatacaaaattagctaggtgtggtggcgcatgcctgtaaccccagctacttgggaggctgaggcaggacaatcacttgaacccatgaggtggagtttgcagtgagccgagattgccccattgcactccagcctgggcaacaagagtgaaactctgtctccaaataaaaaagaaaacttagttttgatcacctggttcttcctttgatctctcatcaactggtaactggtttggaaatgctatataccatgaagtactgagtaggggactcaaaaaaaaaaaccttacttattactaacctggtaacactgttgctttctggctgggtttctttccacacctaattcggtattcgtttattgcattttcaatctcctgaagctttttcatcgcatctgtgtaatcttgctttcgctttttcttcacagttttacaaaggtctggctcattggcaagtttctttgcagcttccaccagcttttgttgtattagaaaattactctccagttcttgcaaagcaggatcctgcatttatacaatgatagttttatttttatggacacatacaatcaactcttacatgcattgtgtaataaaacttcctgtgcactttcttgaatcagacgttctttgagaacactatcttcccaacttttactgcatagacatccttgtcaaacactttcctttactcgtcttaacttcaacttctcattagtccaaacctcttcccttttcaaggaagggaatggcctttcattcattcagttggttgggagaagatcacagttttcacagatatattctcaactcaaagctcatggatgcagaagattatatttatatgcatagctttagagacagataaatttgggtttgatcttcttcctggtaattcctggttgcatgaccctggatacacagcttcatctttcaatgcttcagtttttttcatttgtaaaatgaagataacacctaccttatgaagtaggatgaggattaaatgagatagtatatgtgcattgcttagctcagagatgggtacacagtgagcactcagtaaatagtaaagatttccaaagatgaaaacagatacaattttctaaagctaagatggtcaaatttctacaagaaacatagatatggttatattggctgatgacatgcaaatgagaaagtattatacattctatattggctaacaaatattttaacttgattgtagctcagtgctgtgcatgtattatctcatttaatactcattggatcccgtggagggaagtccaatcattacccccattttacagatgaggaaaactgaggcctgagaaatgagactttagagaggctaaactatttgacaaaggctattatttagttttaagtaaacaaacctaatgctggagttcttaattcttataatgctgactctcaaatgagaaacatttggagttcactgaatgcctatgatttggggagtaaattagtgagaagtaactcaattttgactggagtgggcatgaaagaaagagttcaatttggtctacacgatccatctgtactggtgagataacatacagcagagactcaaaaaccaaaggaaaatgtccactacactcagacagctttcctgtcttatgattaattgaaaggctcagaggcgttgttcatacttcttcactcggcagcaagttgtcatctaatttgaacgcagtacccacacgtcttctgacctgaggaggcttctcgcctatgttcaggggatactcctttggcattttgcctgtgagctcctgtaaaacaggacagaatcaagagcagataattgacactggccaaagttgtcaaacacaacttgatgagccccaaaaagcagactcacagcctcccgcagacagatcttcttaagctcctcaacttttttcagaagtttttcttgtaatagtttctccttcttctttagttcaaggattttttctctcttttgctcttcactaacttctgagtcttgagaacctaggggatgagggaagggcagggaaggtttatacaagggatgtttccttcctttctaagggacaaaggatttttaagctaaagctgctattaaatggtagtttatttcttttctccttgtttctcaacataataaaaggaaactggaaaacattttctcattcttctgggcatcaaacagaacctggtaataaaatgtgcctttttgcatcctggctcagtcattttgggggtaatgataaaatgcttaacgtcccagacacacccaaagaaaaatttcatttttctgagcagaagagaaggtaagatggtccttgaagagttgtttcaagtgttcttttaaaaagtaagcaagcaagcaaggaaaagaaaaatcagtgtgaaggaaggtcatgcttcagagtcacaagttgacagtgagatttagatgggacgaatcattttagtaaagttacatatacttaatgataagggattccagaatttttacagaggaagggcttaggggaagctaccacatttgaggggtatgcttgtaatcatgtttgtatagcattttatattgcatggagaattagacaattatctgtatcaaaaactgaatgctggaaaaagcagctgctgtggaaaatgttctttcaagccacaccttggtactcaccatccttgcatctcatatgacatgcacaacctatttataatttgactttctacatattctttaaaaaattagccttaaaattttattcaaagctgtcgcatacatacttattgacatacttatttattcccaaaataatggattaaaagatgaatttcgaagtggtttatgaccgaaaaaacaaacgaaataaagatggcttgcacgttctctaatcccaagatgttacctgaggagattaaactgccattacttgccatgatgaactgacttttcgtctccagtgtcaccagcttggaggccctttgtgttcctgtctctgtcaaatccattgcaatctcatctaaactcctggctgaaggaatttttgcctaagaggcatacaacaatgaaacagaattaactcaaacatacttcaaattaatgaaacaattaagttaacatacaataaaaatagcaacacagaggataatttagaattttcacatattcaagtggcattcttcagaccaaaaaacaaaacaaaacaaaaaccccacaagtagttaaaatgttttaataactatacgtgattttctcatggtgtggttcagttactaactttgaagtgtcaccggcaacatcaccgccagcagtgtcaccagtatatacaaacgtgcatgccaaaaagttggccagtcttacaacttttaaagcagcttatatattgcccatcatgtaaacatataaaaaacctgaaatagttggaagttaaacgcaaaaaaatctcagagagcaaaaatatatgtgcttgcatcttttgtgagaaggcttatcttctgaacagaatgcaaaaggggaatctgtccctatagaaatgatgccagttacttactttgctttgcttccggtccaagtaaaactgatgctgactaattgccattacccaaatggacttgatgagagaagagttagcataccatgtttgcacaaacaagccactttgcccaaaggttcttcttgaaactgaaatcctgaaagattaaagaaagcactcaaataattcccctctggcccagcatgatgcaaaatgtaccctgcgagcagcattgtaacaaagcatgttcctcttacctgtcttctgttgcaaaaactcttacgcaaatggggaccaagtttctgattttctccttttacaacaaaacaattcagacctaagtaatctctttctggataaacagcatgtttaaaaacacatacacatgaactcaaaagctgataaagaatcagtcaaattagagattatacaaaaacatttagttagaaactctaaggatgtgtagccatcacaagtggtaaggaataaatgggataagattttaaagaaacagcaaccaagtgtggggtgagcacctaattcaaggtaaaagagcatttcagatctaggtagatttggccggctctgacattatcagagaatgcacttaacgataatggctgaaaatatgcaagtccaaaactgtccagagtgctgcttgtacaccagatggaaagaggaaaggggacgggggaggagagaggaggagggagaggggagagggggagcggggagaagggagggaggggaagtgaaagagagagagacagagagaaagaaagagagaacaggcaagaggcagacagactgtgtgtgtgtgacgtggtactaatgttctttgtaggaatttggcttatctcttcaggtcacctttttatcacaggtatttcctcccatccctctggcctctaaacatccataaccatctcgggactgaaaagtacccactaaggactgattaagaatttctcttaaggccgggtgccatggctcagcactttgggaggcggagacgggcggatcacctgaggtcaggagtttgagaccagcctggccaacatggtgaaagcccgtctctactaaaaatacaaaattagcttggcgtggtggtgcatgcctgtactcccagctacttgggaggttgaggcatgagcatcacctgaacctgggaggtgtaggttgcagtgagcaaagattgcgccactgcactgcagtctgggtgacagagtaagactctgtctggcagttgggggcgggcggaggggggcgggatttctcctaagatatttgagaacccacatcctgacttcagttcatgttggtaatttggcttttttttttttttttaaatgaccaagaacaccaacattttaaatgagcaaaagatctgaatagacatttctctactaaagatataggaatagctaagcagcacatgaaaagatgctcagccatcattagtcatgagggaagtgcaaatcaaaaccacaagaaggtaccacttcaacccactaggatggcataaactatacatgcacacaaaactaaaaataacaagtgtcggtgaggatgtgtcggcattggaaccacatatactgctgcttgggatgtaaaatggtgcagcactttgaaaagcagccttgccattcctcagagggttaaagatagttaccatttgacccagcaattccattcctaggtatacacccaagagaaatgaaaacatatgttcatataaaaacttgtacacaaatgttgatagcagcgttatttgtatagtaactgtgtcatacagagaaacgtctttgatcctcaccttcgtggatcatgaacttcaacagcaaattttttctcacggaaatataagttctccagctgtttccattggaataactaaagaaaacagaaaagccaggaagtattatttatgcttatttttactaattctataaatcagcttaataatcaaacaattataagctccaagaaggtacactgatacgatgaaacatgaatatgtgattcagcctttttacaaatcaactatgacctgaaaccattttattccttcttctggcagcaatctttaactattaagattcacctcggccgggcgcggtggctcacgcctgtaatcacagcactttgggaggccgaggcaggtggatcacgaggtcaggagatcgagaccatcctcgctaacacggtgaaaccttgtctctactaaaaatacaaaaaaaattagccgggcgtgctggtgggtgcctgtagtcccagctactcgggaggctgaggcaggagaatggcgtgcacccgggaggcggaggttgcagtgagcccagatcgcgccactgcactccagcctgggcgacagagcgagactccgtctcaaaaaaaacaagattcacatcaccaataaatcttccttgaacaataaaaccaaccatctgtggaagaacatgtacactatttttcctctgactcaactatataataaggaaatctgcacagattccagtaagcaccagccttctcaaagatgttgatttcatagttaaatggaaagatattcaaagggatatttcaataacatcagagattgaatttcaaaagaatacaaagtgaaagtaaaacggaacccccatgcaggggtgattctctgagataccactttcctacctatgaagagttcccctaaatgccacagaaacctagcaccagtaattgggggcagagaaggggtaggagggaacaccagagcctcttcttggtttctgagctagaacctccagtttttgaacatagctagctcccagtgtctgtacactctgatatacacactactgatactctattgcggcactcagtgccgtcagtttgattgggaggaacaaactttactagcaatgtgcatttgaaaaccaaataatttgatagaaagcagctcattcacagaattgaggatgccttgctatgttttctgggctgcttcctaagctctttataagacattgtactatcctgagccttggtttgtcctgtcaacttggacttcatggtcaaattcctcttctctgcccccagacttgattagggaaataacagcagagagtttcattatattattagacttcggctggattttaaaattatgttcaaagaatcttaaaagattatttttaatagtctatacaataagcacttctctgcaatgcactatcagcaaaaccatttcctgacatacgggaacccaggcttttcacagacatgtaaacctcatcatgtaaaggaacaaaatgagctgaaggtttctatacgtatgcaggcatgggaaaaaagggttcagactggaccccccaattccgaacagtgaaataaaccagcacaccctaaaaacacagccctccggggtccgcacacatagctgtctgtaactataacactcactcaggttcacagaagaattaataaaagtataaagttacatacccatttcttaaaatctccacaaacttgaggttttcatttctttaaatccagaggttccaaaaatgggacagaaatgtgaggaaaaacctcagggttcttccgccctcccccctcccagacggcagctccggtgagttctgaactgagtttcataagacacttaggtgtaactcaatttcacaaactgagcctcccacggctgacacactactgacatcagcaactctcctgagtgacacctccctaattctactccttcctcccatcagggagaggagggcaaagttctcagtggcagattttcccagaaaagagacctttctaaaatggagggcagttgggatttgcctgatacttcctaggaagtaagttgctttgaatccaaggacgaatttcaccggaggctgttttaggaagacatttctaccctagtttactcaccctggacatgaacaggttctacaggaagagttacaatgcagctcagctgtgttttcctttgcgtccattcccacacacataaaaaccagggctggacttgaaacatgatctctgaaagtcaccacctccccctcttatcacttacaaatgtgaaaccctagcgctttggactccattcagcctgtccctgcattgagagcaaatacgctccctgcaagcaaaaactctacttaaaaggcgaaggacttcagcttagagaatttgaaataactggattgtaactgggtttgcacaaggttatgggaacaagactgggtttaaagcatgaaaggcagagagcagttcattcccctgcctgaaatcttaaaagtttgtgcaaagtatgatttcatatatgtgcatataataatataaatgtggattggaatgatacaaaattcagtgattacttctgggggcagatggtatggggggtacgttgtatagaaacttgaatatcattagtaatgttttcttttattaataaaaataggatgaaaaatgacaaaatattagtaacagctatttaagtggttttacaggtattgtcatatctttaggactcttggaatttctcaaaattaaagtaataaaagtttatatatataaaatgaatataggttggtctgttttgtacaagagtgagattttcaccatctaatcagttgggagttccctgttttaaacattaagtattattacattttaattattttcaatgtttgaagttgctaggaaaatatttctaattgtagtggtactttatctagctggcagctggatataagctggtttttcttttgaaattgctgaaatcattctcctactgtgttttttatttctggactcttcatatccgagggccaggatgcagctctacaaacggcaatggagctgaggtgaattcatttgctgaaagatagctcatgcaccttgcctcagacagcacctggcacagggcaggcagttgaacggtgttcattctcctccctttctccagtgtttatcttagaagataaataaaaggcaccctctggtcaaaatcaagagaggggctgggcgtggtgggttggccgggcgcagtggctcatgcctgcaatcccagcactttgagaggccgaggcgggtggatcacctgaggtcaggagttcgggaccagcctgaacaacatggtgaaaccccgtgtctactaaaaatacaaaacttagccgggtatggtgcgagagtctatgctcccagctatttgggagactgaggcaggagcatcacttgaaccaggtaggcggaggttgcagtgagccgagatcgcaccactgcactccaaccttggcgacaagagcgaaaatccgtctcaaaaaaaagaaaagtcatgaagggatttcagaccaatggtctgtatttgaggaaagaaatcaaagtttaaaggaagatacaagaaagctaagtatgcttcccattttctattatttggacaatattggtgtccacatagggtaggactatgacatatatgtgtgtgtgtgtatatataaaatatatgcatgtgtatgtacacatacacttgtaattttcatattaaaacagaaaaatgtattttgcccaagccaaaattttcactattagagacttaaaaaaaaaaaaaaaaagaggagctttatttgtcttgcaatacaattaagagtatggaactagaatgtgttctaaagtgatcattatataagcataataataatcattaatgagtatttataattgtctatgtggcacctactagaagctacgagtttgaacactatgttgtttttagacaaaatctatgctgctagtgatgaaagggaaatagttgtaaggtgaaaataaaactgtaaattaggtcttccagatttctttctgctctacactcatcttgaatcactagttgtgccttttgatatcaaaagaaggatgtagagagtgactgaagaataatatctgggactactttgcaattgcaaaagtaaatagaaagataaaatattaaaagaggagcagcataaataacattaacaaagagataatcaagaaattacaacaggaggagaatatcttaaggttacaaaccttatcttaaaaaaacaaagtgacaaaaatttaaaactgacacagaaaatcatggtggaatcaagctgtattttgaaagtgaactgtataaaatattgtcatcacaagaaattcccttaaccctaagatgaagtaaaaaaaaaaaaaagtgttgatggttttagaataatttgctgtagacgattacagtttatttaatgaaatgaatgtgttgaatatttaagccactttattgaaatctataatcaatatttagttagattccactcacttttatagacttaaagaactacaagaaatcacctgttccctgtcccaccccactattataatggttcctaaatatctgagggtactgtcaaacttcagcaaaaaaaaaaaaaaaaaaaaaaaagaaagaaagaaagaaaaatactataaggaaaagcagaggaacctttaggagacatggtccttatatttcagatatgtatttcagtagctttgagagtcatttatccatttcttttccatcaacagatatttcttgagtgccgtgtatgtttgaggtcttgttcttgtcagcaagtaatggacagagcccttccattgtggggctcacaagagccaagtgaaccaagtcagattgccttggttagcattctggtactgccacttctagctgtgttgtatttggcaagctgcttaactttcctgaatctcagtgtctgcatctgtaaaatgggaccaccaacacccacctcagagagttgtcggaagggatcagggaaactatgtttgtgaagcactcagcccaacgcctggctcagtatcaaaattcagtaagcaataaagtcagctgtatttgtaatgaagaactctcagttcacctctccaattttatcacatggagggcagtcacttaatagcagaaacaaaagcaaaaactgctctctggatcccacatctttccattgttgagaaacaattgggttattctgttaacatatctgtgtcactcagacttccaattctgtgagtttcaggctttataaaaactggctgctctatttctgtttatttcattgggggtttcctgatacaccctctaggtaggaaatttgctcaccgtttctgtatcatggaggacataaatggggagggaggggctggtcacggcatgccccacaggtagacaaagcaaactccctcctgccccaggtacccaggaaaggaggaatgtgtcccagcatgtacaaaaatgctgagaagtatgcacctgccacgtgctaggaggaccttcccaggggcatgaaagacccagggaaagccttggacaaaaagggtcaaactgtctttttaaatcttgatgaattgaaggtagatgccacctaaaggcttcacaataggccaggacaggaaagacatcaggagaggcttggctttttaatggcaactcatagtacctataggttaatcatttaactgcaaattcgcctggaaatgactaaatttgagacagtcacagctgcagtgtatgactatacatcagtgactcacacggtgggggatccctctgctattattacgtgaagccaaacaaaatcactatattattgatttattcttttttcattttgaaagattacacatgatacatatactgttagtaccttctggaatttcacagaattataggcttctataaagcccaattgatctaccttctttccatcaaatgtttatgtgactgagacaaagtctctgccctcaaggagggtacaggctgtcgaagtgacagtcatacaacaaatacgcagttaacaccaacagtgccagctggcataaactaagcgctcagctggagcactaagatgttgcatctattatcttatggcgtcttcccaacaaccacatggggcagtactattttagtctcactatgcagaagagaaaactgaggctcagagaggttaaagtaaattgaccaaggtcacacagcgaaataggggcagatattgatacttaaatactgccaggctccaagatcctcaatgtataaccacagcatgtcatcctgcctttcttatctgggaagagtgctgtatgggtatctgttatgtttttaacaaaaaaaaaaaaaaagaaaaagagaaaaaaagagtaattcttatttcttcctcaaataaaaaagaaagcaattacagcagccatttgcgggataggactgagtccccccccttttttttttgtatgagatagggtcttggtctgtcacctaagctggagtacagtggcatgatcacggctcactgcagcagcctcgacttctcgggctcgcgatcctctgatctcgaccttctgagtagctgggacaacaggtacatgctaccacacctgactatatttctgtttatttcattgggggtatttcactggaggctaattttttaatttcttgtagagatggggtcttcctgtgttgcccaggctggtcttgaactcctgggctcaaggaatccttccgccttggcttcctaaagtgctgggattataggcatgagccaccatgcccagcctgagtccctttaatttttcttagtgattctcaacctgtggtgatttttgcacccctcccactcctcccaaccatcaacctcaggacatgtggtgatgcttggagacatttttggttaacacactggaggggaggatgctactagcatctagagagtagagaccagggatgctgccaacatcttacagtgcacagaatatgatgcccccacaacagagaactatatggccctaaatgtctatggtgctgagattgggaaaccctgacttacaggataatatttggtgatataactaggctttggtaggtgaaatgtgctgatgaaggatttaacaatttttactctgaaacaattaattctggagttctatttctttcaactatgcctgttcacattgctttacatatgcaaatgctacccactagaggggcttacaattgaccagactagaagagtcagctgtgctgaactaaaatctcataaaagtacccaaatggtatacgctgtggtagtgaatgtttcaaatatgatctcaaccttacaaataaaacaccatatcttggccaggtgtggtggctcactcctgtaattccagtactttgggaggccggggtgggtggattgtctaaagtcaggagttcgagaccagcctgaccaatggtaaaaccccatctctgctaaaaatacaaaaattagccaggcgtggtgacatgcacctgtagtcccagctactcgggaggctgaggcaggaaaattgcttgaacacaggaggcagatgttgcagtgagctgagatcgtgccactgcactccagcctgggcgacagagtgacactccatctcaaaaaaacaaaacaaaacaaaacaaaaacccatatcttaaatgcaaggagtaaaactcttgagtattttcagaaaagtttagacaaagaagttctgggtattgggaaatgtataacgtaaaaacgagaacacctaaaaggatgtcatcacacccaagtttcctctgtggccgaatctctaaccttccagagctgatgtaatgacatcctgttaagactctcgttagcgtgctcactgatgtatttgatgccaccagggctgagctactgctctgggcacctgtataactattatggatatttacaactggtatcccttcttgtggttttgtacctagtctggtttttaaatatttccaataaaatacctaattttgaatacattctttctttccagatatattggcaggtacttgatggcagggattgtggctttttccttaaatgagacaaagaatataaagcactcatttagggcccctgtaaatgcattgggcttaatacatttttttttggtggaggggagcataaaatcaggtacatggcactctatggttagaaatgtaaagatagatgaatttaacaactttagcttatcagtgaagccttgctaccaaaaaaaagtcccaaaccagccaatcattggtcacaagtatataataaagaaactttggacaagcacaatggctcacgcttataatcccagcactttgggaggctgaggtgggaggatcacttgaggccatgagttcaagaccagcttgggcaacatagtgagaccctgtctccataacagaatttaaaaaattagtgggacacaatggcacatgcctatagtcctagctacttgagaggctaaggtgggaggattgcttgaactgaggagtttgaggctgcagtgaactatcattatgactctgcactccagcctgggcaacagagttagaacctatgtctttaaaaaaaaaaaaaaaagaaagaaagaaagaaaataaatctttactgtttatgcctcttcatagaactattttttacagtgctttatgtactaattgcttttctctgcattcagactagtcaatcctatttatgagctatctttcatttttcttcatgtgccaacagttcaaccatgtggtaaatgcttagacatgtaaaggaatagaaaaaacaatggacagtcaggcaccgtggctcatgcctgtaatcccagcactttgggaggccgaggcgggtggatcacgaggtcaagagatcgaaaccatcttggccaacatggtgaaaccccgtctctactaaaaatacaaaaattagctgggcgtggtgggacatgcctatactcccagctactcgggaggctgaggcaggagaatcacttgaacttgggaagcagaggttgctgtgagccaagatcgggccaatgcactccagcctggtgacagagtgagactccgtctcaaaaaaaaaaaaaagaaaaaacaatggacatctgatggttctgcctgtctggcagccacttccttttcttctagcagcatcttccatttctacacggaactccgtaagctccagctacagtggtgtgcagtggcgccatcttggctcactgtaacttccgcttcctgggttcaagcaattctcttgcctcagcctcccaagtagctgggattatgggcacccgccaccatgtctggctaatttttgtatttttatttttattttatttatttttttagacagagtctcactctgtcacccaggctagagtgcaatggtgtgatcctggctcactgcaacctccacctcccgggttcaagcaattctcctgcctcagcctcctgagtagctgagattacaggcacccaccaccacacccggctaattttttgtattttagtagagacggggtttcaccatgttggccaggctggtttccaactcctcacctcaggtgatctacccacctcggcctcccaaagtgctgggattataggcatgagccaccacgcctggcctaatttttgtatttttagtagagatagggtttcaccatgttggccaggctggtctggtactccagacctcaagtgatccgcctacgtcggcttcccaaagtgctgggattataggctgagccactgcaaccagccttctcctgggtttctaacatgcctatctccttcccatcggcataccctgttctttgatgagaacaagccatactgttctttatgagctttctgcccttcgggtctcaggttaaacatcaccttcctcagagaggctttccctgaacacaccaaatgtcccctccctgcatcccattactgtcccccatctcatttgtttccatcaaagataattacaaatttatgtctttatttctttgcttacttgtttctcaccaaccatccctccaaagacttcaaaggaaacaaatacagtgtgacagaaactactgatctcccctaggatctatttttccttatttttagtaatagaacatcttgagttatgccaggcgcggtggctcacacctgtaatcccagcactttgggaggctgaggcaggcggatcaggaggtcaggggttcgaggccagcctggccaacgtggtgaaaccccatctctactacaaatacaaaaattagctgggcgtggtggcgtgcgcctgtagtcccagctactcaggagggtgaggcagaagaatggctcgaacctgggaggtggaggttgcagtgagccaagatcacgccactgcactccagcctgggcaacagagcgagaatccatctcaaaaaaaaaaaaaaaagaacatcttgagttaaagctttgcccagggccacccacctagagacaataccacccagctgcccttgcactcagagttggtactttccaaatgacagaggagcctgcctaggcctccctctttccatcttcttcaccaatacctaaccaattttctaaaagttccatgttttacgagaactgcttaaaattctaattgcgatcaactatgggaggggaagagaaagaccatgctgtacaatacactttctataaattaaagtatggtgtggaggggaaaataacccactcagtgaaataactcactaactcattgggtcctcacaatgatctgtgaggtggacagcagacaagagttatctcaatttgatagctgaaaaaaatgaaggcccagaaagttgagtgacagctctgagtcagccagctggtaagtggaaatgcagaactggttcttatttcaaatccatgctgtaggatgggagttctcctcccactgactctgcagaaggttttaacaatcagattgattactggtgtggttaaagcttagatacacactttataaacaggatggaccagtctctggttgacattctaaaatccaattattttcttccataccatgctttatttggcattaatgtagaaagagaacaacccatgttctcttctcctacagttaatctcatctagaatttcagcagtgtcagaagtagcttctaatctaggtccaaggtggtatggtcatggtggaaagaagagcttagaaatgctcaagatagctgtgcttaaagaaataaccaagtcactgtctttaaataaaataaccttgtagttgtatgagaagaaaacaggaagacttttgtgcttgttacttaattcatttggctttagggatttgggaattccaatatatatagagacagaaacagaaagctaagagacttttcccaccttcacatgccctgtggtgatgaagttcacctcaagtctttcttggcatgatataaggcaaaaagatacttatcttgagaagcattttgtcccactatggacacctcgacagtatgtcattttatctctgccatctgacaggctctggttttccaggggaagtatttgccgaagggatacaaatctgtcatgacatagactaatacttggctcagtctctgacccactgtctgcttctttatgaagaacagacatttttccttgaaatactgaacaataaatacttagaaggaacacaaggctgcttttttttttttctttaagtgaaacttcatcagtctctaagtccaaatgtcttaccatttggaattcagttgagttctggtacgttttcacattctctaagagtttgcaatgacatattcatacacaaagggaggattaaaaagtaaagctgcttattgtcttaatttttaataccctgaatgtttgtggtttgtaattttggattaaaaatttttcctttaatttgcgtcacaccttcaggcatgatgcttaatgaattaggaggtgaaagaagtgctcacacatctccgaaaacagaaaatttgagggtggaggccgggtgtagtggcacacatctctattcccagaactttgggaggctcaggcaggtggatcacctgaggtcaggagttcgagaccagcctgaccaacatggtgaaactccatctctgctaaaaatacaaaattagccaggcatggtggcgcatgcctgtaatcccagctacttgggaggctgaggcaggagaattccttgaacccgggaagcaggggttgcagtgagctgagctgagctcgtgccattgcactccacccggggcaacaagagtgagtgaaatgccatctcgaaaaaaaaaaaaaaaaagaaagaaaatttgagagtggattcttagtacactaaagctgtgggcttgtagcaatgttgtgtccctctctaaccagtgatccaagaatatttcccatactcttttattgtctgtcttctcactactactaatgatgatggcgtatcagctatggtgctaaatttgtcctctaggtcttacaaccaccctacacagttggtggcaatacccttgtgcagatgagaaaaccacttttaaagagagattaaacaacatgctcaaggtggcacagtaaatagacaccaggggcagaggttgggatgtctcccaaactctttccctgcatcactgtactacactacacactggttgaaaacaacttgttggcaccccagactggcaaaaaaaagccatataaataaaagacttgaagagcatctgctggatgccctgggaggtcaaacaaatacctccctgcccttaacattcacaggtgataactgatacagaaaggtctgaaggtcactgctgggagatcttggaacaactccttttcaaaacagcctttcggcatcagttttcttattcttagtacttattctcagtaaatttcccttcttctggcctgcttttaagccacataattgtaacaagacgggatgtggctcaagaggctgagcaccttaaggcctctcattatagcctttgtttcattacagtttgccaatttgaccttcattcctgctggtccattggtaaacttgcagcctgcacaggtccacacaaacagctgaagcatgatcctcctttaatagaaggctgtgctcatggtcctttaaattatgcattctttcatttgtgcaaactaggccaggagagggacttgtaaaacagcctcaatccttacattgtctggacataaaaaataaatatatggaagcaaaatccattgtcagattttaacaaaagaagaaaggaagaaataaacaatggcacagagtagacaccccccaaaaaaaaaaacggagaaagagaaggcaagaaagtgataacatgggccgggcatggtggctcacgcctgtattcccagcactttgggaggcccgaggcaggtggattgcctgaggtcaggagttcgagaccagcttggccagcatggtgaaaacctgtctctactaaaaatacaaaaattagccaggcatggtggcaggcacctgtaatcccagcttctcgggaggctgaggtaggagaatcacttgaacccaggaggtggaggttgcagtgagccaagatcgtgccattgcactccagcctgggcaacagagcgaaaccccgtctcaaaaaaaaaaaaaaaaaaaaagaaaaaaaaaaagaaaaaaaagaaaaaaagcgataacaaaagatggactgtgtagggtctttttaaaaatggagtggcatgttttggaactgaaataaaaaaaccctgcaaatccaaaaaaggaagtagcttctgacccttttctagactctggaatgaacaagcaaaactgattatgatcagtgtcaagaagtatttgccaatttctatgaaactgtgaacgtaaagaaaggcctgtgagtcataagtacaggagaggaaattaactgcaatatttactgtgcagattctgattcactactgttttgggacaaagcctggttgctgttagcagatgcatttacattctgctggaagctcaatcttatcaagccacattagctaataaattacttgtgagttgtcctaatattttacatggaagattcagaaaaaccagtaagactcctgagtgttatttcttaagtaaaattcagaagagaaataagttagcaaaaaaatctcaatacaagtgaggtctaccttaagaaaacatgatagacagcattttggtcttgcaaaatagataaactagggtaaggtatttgtttgactgggtttttttattatgctctgcaaactctctccactcctacaaatggaaacaagtatgatgtccatcaaaagtgaagtggttaaataaattatgtatttccacatcatgaagcactaggcagctttaaaaaagtgaaaagaaatcggtttataagtgagctagagaaatatggcaaggtatgaaacactgtatatattagatttctctgtctttgtaaatgcttagaatatacactgacaaaatctaaatgaactggtaccatttttttaacagttgctggttgtcatggaggaaaaatggggattgcagaagacttcttcccctaaagcatttttttgtagtgtttgctgccattttttcttccttgccctcatgagtatttcttactctgggtaaaaaaaaaaaaaaaagctaacaataaataaaattgattttaaaaaatatttgaaaaaattgggtatccttcatttctaatattattgattagaaattaggttttagaagtcaattttgaaatataagcaggaacaatagtacttatactcctcctggaaattaattaagtattccttaaattgatcttggtcacagagcttatagaataaaaatgttaacagtatgattacaaacatgctctctcattgtcctctactgcttgttgaatgatgcgctgttgttttcattgatttttttttttttttttctgacacaaggttttgctctgtcacccaggccggagtgcagtggcatgatcatagttcattgcagcctcaacctcccaggctcaagtgatccttctacctcagcctcctgtataactgggactacaggcatttgccaccatgcctggctaatttgttaagttttctttttctttttttttgtagagatggggtcttgtcacattgctcaggctggtcttgaactcctggccttaagtagtcctcccatcttgacctccaaaagcactgggattacaggcatgagccaccaccctcggccttatcaataatttctagtaagaagcctcaacgccctactagcctgatccaggaaagctggatcagtattggaggtgggtggcagaggggatatggctttccctaatctacccttttgtgttatctgtgtcagtttcacaaccataaaatggggaaaagagggggttttatttattttcataactcatagaagactgtgtgcaatgattcaagctgcatggacacttagaagatgaagagtacgtatgattatagggctgttttataaagagattggctgtttttctaacacacatgaaagcaagagacagatggaaattacaggagttatttaaggctgtgatgtcaggttgtgataatgcaggtagctgaccatggtctgttattagaggccattgttttactcctgtgctttcagtgatggcaggatggcacagggagagtggcaaaaccaaccagggcagcatgagtcagtcttgatgtcactgtcataccaaaggaagccaagagcagctgcatggtgatctatatggattcttcaactctaatatgggcaaaaacgtgttgtacacttgagcttggatcaagagaagcagattcagctgagcacagtggctcgtgcctgtaatcccagcactttgggaggctaaggtgggaagatcgcttgagcccaggagttcaagaccagtctgggaaaaatagtcagactttgtctctgcaaaaaactttctaaaaatgatctgggcatggtagcatgtgtctgtagtccaagctacttgggaggctgaggtggaaggattgcttgagccagggaaatcgaggctgcagtgacctgtgatcaggccactgcactccagccaagggaacacagcgagactccatctcaaaaaataataataataatgaattttttttttttttgagatgaagtctcaccctgtcgcccaggctgaagtgcagtggcgtgatctcggctcactgcaacctctgcctcccaggttcaagcaattttcctgcctcagcctcccgaggagctgggactatacgcgcatgccgctatgcccagctcattttttgtattttagtagagacggggtttcaccttgttgccttggctgatctcaaactcctgagctcaggcaacccacccgactcagcctcccaaagtgctgggattacaggtgtgagctaccgcacccagctaataatgaatttttttaaaaaaacagcttcatagtaaaattttaaatggacattaatgttagttatttaaccctggaaatccaaatctgatagattgtgaccctcttttttttttttttttttttttttttgagatggagtctctctctgttgcccaggctggagtgcggtggcacaatcttgtctcactgcaacctctgcctcccagattcaagcaatgctcgtgcctcagcctcccgagtagctaggattacagatgcctgccactacacgtggctaatttttgtatttttagtagagacggggttacaccttgttggccaggctggtctcaaattcctgaccttctgatccacccaccttggcctcccaaagtgctgggattacagacaggagtcaccatgcctggcctgtgaccctttcataaatagcacacaactgatttttctctacaaaaagcagacatgttcactgcagaaaatggtgaaacagagataatagcagcagaagaaagaagacttatacctgcatcattgagagatcactagcaccaaaacttttgggtcatgtctttattattcatttatatgtctaccatccaattcaaatatgtatatgcataaatgtacatataaaatttataaaataaatggcatcatcctgttcatactaacataaaatagaaacctaatggtgtgtgcttgtggctcacgcctataatcccagcatttcgggaggccaaggtgggcagatcacttgaggtcagaagtttgagaccagcctggccaacatggcaaaaccccgtctctactaaaagtacaaaaattagccgggtgtggtggcgtgtgcctgtaatcccagctacttgggaggctgaggcaggagactcgcttgaacccaggaggtggaggttgcagtgagccactatcagcccactgcactccagcttgggcgacaaagtgagactccatctcaaaaaaaaccaaaaaaaccccaacaacctaatggtgtgtgcttttcaactatgttgtgattaacatgttttgaacagttcaaagttctcctaaagtgatccacacttaccttccgaggcttcaccttgtcttgtatatcatattggccaattcccttatagcttattccaagccaccaaggaagtccttgcttatcctagaagatgaaaaagcatgagaaccaagacctagctgttaactcttctagaagtgaataaaatttaccaatttcacctctttttttttttttttttttttgagacggagtctcattctgtcaccaggctggagtgcagtggcatgatctcggctcactgcaatctctgcctctgggtttgagcaattcccctgcctcagcctccctagcagctgggattacaggtgtgcaccaccatgcctggctaatttttttgtattttagtagagacggggtttcactatgttggctaggatggtcttgatctcctgacctcatgatccacccacctcagcctcccaaagtgctgggattataggtgtgagccaccacacctggcaatttcacctcttaacaagtatcagcaagtcaaaataaagctgtcttgataaacaaaacatttaaaaacctaacttgttattaaaacacctacttggagtttcttcaaataaaatctttaagttgaaatagtccaggactgttaataccatcaaaaagagtaaagcattactgttttgattaaacagttggagaaaataaataaaatgtaagtaattcaactaagaattaatccagtaaaaagccagttatccattaaaaaaaaaaaagctctttgcctcttaattagtaaccagttataaaaggttggggacgtttccaaagaattacaaagatgagaaaagtggttccaattcctgatgtttataaaacaattaacaatgaacacgggaatatcgaaaacccttttggagaactgtacaattcaatgacaggatgtttgaataattggtttgaggtacatacggggaggtgagtaatattgttttcataaatttatcttttatgttttgccaaagcaaagaatatactgacacaggaaaaggaaaatttaggcttagacagatacctatatgcacaccagagtcagtagaaattaaagttaaattggaggccaggcgtggtggttcatgcctgtaatcccagcactttgggagcctgaggcaggtggatcacctgaggtcaggagttcaagaccagcctggccaacatggtgaaaccccatctccactaaaaatacaaaaaatgagccagctgtggtggtgcatgcctgtaatcccagctactctgtgggctgaggcaggagaattgatcaaacccgggaggcagaggttgcagtgagctgagatcacgccactgcactccagactgggcaatagagctagactccatctcaaaaacaaacaacaaaaaaagttaaattggtaccgatttttagcacaggtattctcattatgtaaattttctaattccccatcattttgaattgtatagagatatgaacattatcataacatgaaaagtcaatcaagaactgatcaattataaaattatttctcttccaaacaagatatccttaacactttcatctcatcatctcaaaatatgtcaatctctccctgcttataaacatctgaaaatacttttcatcatctcaaaatatttgtcaatctctccctgcttataaaacatctgaaaatacagtgtatgtaatacactgattaaaacatggtattgcaaatcctgtaaaaatttcagaattttatgaagctgttgaaataacgctggagactgcataattttcaaacaaaagcactctcaaatgaagatctggtagtgctagaaaggtgaccaactggaaaaaagaccaatcagcaagcagaggtgtttcgaaagagaatgatctgaacattttaggatgaagagaggtcttggaaaaacattttaacgtagcaagtattttgcaaaaataatgtactttataatttgctacaaaaggcaagatataatcagccttttatatagtatgaaaaaagctggtattgtgcaataactctcaatcatcacgaaagctttgtcatgtaaaattacttacctttactgcataataatggacaccgtaagtcggtagagcttctactattttcatatacctatggaaaataaatatgtatcacaatcttattaaaatagttagaggacccttttgggaaaagtgatttaaagaaacaccacgtttctactttccttattataagaataattaatatgtttcactcaagtagaaacagaataaaccattttggggagtaatatattttagcttatccaaatgtcaggaaaatgctaatagaacctcaatttcataaagctatagaaaatgttactttccacacattcaaatgtttatggattaggaatgtaccatattataaactccatttgcaagtattttttaaagtaagcccctaatgatgcaagctatgggcaccaacttttgggtcatactcataagttaaacaataaagctatgccatatattgcttgtggtagaggttaaataactagaaacatctgtcaaaactcctagaaatatatactttaaaactatgaattatggtatgtaaacctgacttaaaaaatatgtccccccaggctgggcgcggtggctcacgcctgtaatcccagcactttgggaggccgaggcgggtgaatcacctgaggtcaggagttcaagaccagcctggccaacatgctgaaaccccatctctactaaaaatacaaaaaaattagctgggtgtggtggcggacacctgtaatcccagctatatgggaggctgaggcaggagaattgcttgaattcgggaggtggaggttgcagtgagccgagattgcactattgcactccagcctgggtgacagagtgagaatctgtcaaaaaaaaaaaaaaagtccccccaaaataaaaattaaagcaacgatgccactacttgctatttttaattcagtagtgtttattgtacacctttaaggctttggggtggactaaattttgtaacgcttcctctctgcccgcaaggaactgaggctcctgttttaacgcaagtagactttttaatgacattttgatgatcaatttctccaggaagtgtaatgaataatttgacatattttttaaaagtaaatggcccgcatgcaaatgaatataagaggttaaatgtgtcaaggtcatgcagcaactaaactgcacagccagaattctaacaaaatgagtcagactccacatcctagagccttaactaccaaatgaaaccgtctcttagatgaagccacacaataatgatcaggagaaagaataagactctgcatttaagcatgggtacttttttttttttaattgttttttagtttccagggcacatgtgcaggatgtgcaggtttgttacatagctaaatgtatgccatagtgatttgctgtacctaacaaaccatcacctagagattagggccagcatccattagcacttttccctaatgctctctcccaccccagccctctcctgacaggccagtaagtgttgttctcctccctgtctccatgtgttctcattgttcagctcctactgataagtgagaacaagtggtatttggttttctgttcctgcattagtttgctgaggataatggcttccagcttcatacatgtccctgcaaaggacatgatctcattcctttgtatggctacatagtattccatggtgtgtatataccatattttcttatccagtctatcattgatgggcatttgggttgattccatgtcttaagcatgggaactttgtaatatacagtcacacattgcttaacaatgaagatacattctgagaattgtgttgttaggtgattctgtccttgtgcacacatcatagagtgcacttacacgaacctggatggtagagcctactacacagttaggctgtatggtatggcctattgctcctaggctaccaacctgtacagcatgttactgggctgaaatactgtaggcaattataatacaatggtaagtatttgagtatctaagcatagaaaagatacagtaacaatatggcattataatcctatgggcccaccattgtatatgtgtacagaaatggtacatgactgtactcactagtttaccttaatacccttaatggaaattgtcactacttctttttacttttcagttcagaaaacaggcacaatgaattaaaatgtcaaggatccaatttcaagatgctaacttctgatttctgctgcaaagataacagaaggtgtgttttgataaaaacaagattagaggctaggcacagtggcccatgtctataatcccagcattttgggaggccgagttgggcagatcatttgaggtcaagagtttgagatcagccaggccaacatggggaaaccctgtctctactaaaactacataaattagctgggcatggtggcatgcgcctgtatcatcccagctactcaggagcctgaggcacgaaaatcgcttgaacccaggaggtggcaattgcagtgagatgagattgcatcacggcactccagcctgggtgacagagcaagactctgtctcaaaaagagagattagagcaaagaagtaggagtgtgaggaaaatctacaatctccaagcccttatttcagttttcacgggcatagaaataattttaaaagtttagtgtagcaacttttttttttttttgagacagagtttctttattgtcacctggctggagtgcaatggtgcaatcacggctcactgcaacatccgcctccctggtttaagcaattttcctgcctcagcttctcgagtagctgggattacaggtggttgccaacatgcctggctaatttttgtatttttagtggagatggggtttcaccatgttggccaggctggcatcgaacctctgatctcaaatgatccgccctcctcagcctaccaaaatgctgggattacaggcatgagccactgtgctggcctgttcttaataatgggtggtaactctataagtcacaaaatgtagaaatacattacaatggcttgttgttagtagcatgaagaaacagactatctaacaccaatatactatacactcgactcaaattcgaatcacaaactgggggacaaaacatggcttctagataggttttatttggctaacattgcattaaattttctttaaattacttcccaatgagataagatttaaaaatctgaatttccagcttctcctggaaaacaaaggatctggcaacattatgcctgaattctaaagctgagtaaccttgcctctactcaggatgaaagctcacctgtttaccacagtccccaccattctctattgccctacatctggtctacatttctcatttttttacttgcctgacactggtaggtatctgagttggtgacaccaatgtatagaatgaccgaagacattttctaattcacagtaagatatttctaaccagataaggactatgttcacaaaaactacacaacagaaatcatttcaagtgataccttcagatgagagatattaaaattatatctaagcaaaaggaaagatacttactgaaccacagcttgacctcgagtgagacctttgattttcaaataatgctcaattaccctgtcctcactgtaaaacaaagaaatgagaaggattgcaatgcatgattatctgaggtacaggcacagtttccacattatcaggtggctgtcaggaaacttgagagagaaagccttcaccaacttgtttggtagatagagtttggcttttgtttctgtaggagatggattcctgaacttcagacatttgactgcctccattatcatctttaacttatgttttatgtagcatatttatataatatatatattactacctttaaaacttaaagtgcacagccaggcgtggtggctcacgcctgtaatcccagcactttaggaggctgaggggatcatgaggtcaggagattgagaccattctggctaacacagtgaaaccccatctctactaaaaatacaaaaaattagctgagtgttgtggcatgtgcctgtagtcccagctcctcgggaggctgaggcaggagaactgcttgaacctgggaggtggagatagcagtgagccgagattgagccattgcactccattctaggtgacaagagtgaaaatccatctcaaaaaaaaaaaaaaaaaaaagacttaaagcgcagtggctcatacctgtattcccagcactttgggaagttgaggcaggcagatcacctgaggtcaggagtttgaggccagcctggccaacatggtgaaatgtcgtctctactaaaaatacaaaattagctggttgtggtggcgcatgcctgtaatcccagctacttaggaggctgaggcacgagtatcacttgaacccaggaggtggaggctgcagtgagccgagcttgcgccattgcactccagcctgggcaacaagagcaaaactccatcacaaaaacaaaaaacttaatttactagaaaaggaaacaatatcaatttctccaatgggaaatgatcttttgccataattggatggaatataatacacataaaataatgatatcaaatgttagctgtagaacattattgaagaaattttgagcctaaggcctatcctctctttggttaaaacagggagatcagcaagtgttaggcattaaagactttctcattgaatgattcagaaagattttacaagaatttaaactgcttctgagtctgtgtgcaatctaaaatactctactatcaccatttacagacatgttgctttaggagaaaacccttttattgccctagagtaaaacttgttgactggaaaggaaatctcaagtataacctagaagatgaagtatttctatctccatatgactagttctcattagtaatgtctttttttttaattaaaaaactatcaaggctgggtgcagtggctcacgtctgtaatctcagcactttgggaggccgaggcaggcggatcacgaggtcaggagttcgagaccagcctggccaacatggtgaaacaccttctctactgaagatacaaaacattagctgggcatcgtaccgtgtgcctgtaatcccagctatttgggatactgaagcaggagaattgcttgaacctaggaagcagaggttgcagtgagcggagattgtgccattatattccagcctgggtgacagggggagactccgtctcaaaaaataaaataaaataaaaatagataaaactatcgcgcttggtcgggcccggtggctcacacctgtaatcccagcattttgggaggtcaaggcgggtagattgcctgagggcaggagtttgagaccagcctgatcaacatggtgaaaccccgactctactaaaaatacaaaaattagccgagcctagtggagggtgcctgtaatccttgctactcgggaagctgaggcacaagaatcacttgaaccaggttgcagtgagctgagttcatgctactgcactccagcctaggcgacagagcaagactctgtctcaaaaaaacaaaacaaacaaacaaaaaactatcacttgaaaatgacatggctagaagtttccagagtcaagatgctatgtagcctcagtacttactttcactatatatttgggaatatacttccaacttcatactaaatgtctcaatattgaatatctattttgtaatctttattttgtaacattttagtggaaagaaaaaccatcttgaggattcagactgaaaccaaggagaatatatttaacaagaatgtaagtattttaagggaaaacgtaatttagaaaaaaaatatgggatgaaaatggatactatggattcactaatgtacaaacaactaaaccaactcaatatatacaatatctagctgtagtagaaacctctggtcattatgaaaatctctgatccaaggaaatctgtattttataacacttatattgcattctgctagattaaagctgcattacacagtgactgcacatatattgaatattatatattcacctaggagcatactctacagacattttacacacttgaaagaaacatcagccagctgctctttgcaaatgactgcaagacacatcttggtacaatgatctccagtaagctttgagtagatcctttcactgaaaggatcaaggtctacctatggttactttatacaattgattggcaatgtgatatttttcccacttatatttcttttaatgccctgaaaagcatgtagttctgaatggaggctatgaaaatgagacacctgttatgtggatttggcttaccagtaggcaagggatggatgctcctgaagagttttggttggaaaggctggtaatgtctttaaatctttcctggcattttcatcactaaaaagaaatggaatatggtaatgtcaggtactgttatccaaaaaattatgcaagccggtcaccaaatgaattagattaaaaaaataactatttacagcatgttggagccaacatacacatggttatggactctaactagaagcagcccccaaatttaacaactgagttatatgatgagatgttgaagtttataatattttctgcacatgtctattttacacgtaactatgattataattgtacatttttcacattgtatttttacagaatattcttcacatttcattatccactttctctatgttcctacagtatcttactaatcatctttagtggctacataatattcatcatggtggaatactggttatcatgaaaccattcacataacatcaacaatttttcgtaatagatatcattgcaatgaaaaggtttatgtagtcttttatattactcttctgttacttccttacaaccctctgaaatatagcagaccaactcaaccacctgtagaaatctcttgaatagaagatgactggaaaacgtgtttctaatgaaacccaaggtatctcttaagtcacattaagtgaactaaaatgtacctcatgtaaggttagctattatctaattataaaatggcaaaattctagttgtcaagagaaagttgtggtctttacagaactttaaaaaagggagaacaggccggacacagtggcttacgcctgtaatcccagcactttgggaggccaaggcgggcagatcacaaggtcaggagattgagaccatcctggctaacacggtgaaaccctgtatctactaaaaatacaaaaaaaaaaaaaaaaaaaaaaaaaattagccaggtttggtggtgggtgcctatagtcccagctacttgggaggctgaggctggagaatggcatgaacctgggaagcgcagcttgcagtgagccgagatcacgccactgcactccagccttggcgacagagcaagactccgtctcaaaaaaaaaaaaaaaaaaaaaaaaaaaaaaaaaagagggagaacacgtaatactacccagtcatagttggttatgagagaaaatactctaactactgagtatttaaggacataatctatgaggaaatgaacatgattatctaaagcctattagagggtagctactcaaaattctgatgaaactggtgttcatcaaacagcataatgctaactcttcctaccttccacttcttcctatctttaccactagctacccttcgatgaaaggctcccaagtgccagataccatgcaacacacttcttgggcattatttacctcatgtaaggttcaccacaagcattcccatgcagtagatactattattatctatttaagtagacgagccccccagctggagggccaaacactgaaccattccttgttgctattacatttcaaagccagggttgtggcctttcctacaggtgaaagatctagctttccaaattactacaggaaataaaaagtcacttggctcctgttcttacataagaataaatctctctattcatttgaaatctgagagttatggcttaaccacactgacaatcttgggaaactggtttgtgcttcctgaaaatcaaaatataccacaatccaattcattcatattaaaggtcaactgtcaactcccagtatatttatttttcttaataatctctcttatgttctgtctggcataccacatttacttttttttttttttccaaacctaaaactgtcagatacctttacttctaaattgtgagtttttttaatgaagggcaaatgcatgcatgtattcaaaaatgataaattcaggacaacatcgtgttatgaaatcatccccatcgaccacatgcatgttgttatttctggatccaggtgaaccataggctatgtttcaagaacccagcctagcattcacttacttggattacagttaattctgtggcaatggagacctcactagatcagaagttgctatttatcataaatttatttattcagttaacaaaaatatgtagaacgagtgtcatatgatggaactgtttttaactcatacaaatgcagtcagccaaaagggaaaggagaatagggaaagaagtgagggagaaattttatctgtcattccattcaataagctcatggttgagagtaagtacaaaacgggtgacttgaagctgttgtccttagtcctatgtccctcaaagcacaagtatctcacgacactgagatttttccagcattcaggcatttaatacatgtctgctaaactcaagcaatctttatatctagtgcctaaagaaatagctgtgtgtttcaactggagaaaaataccacctgtgttggatttattgaaagatgaagtttagtcttcagcatatcattttcccagcgattttcaagagtaatttgaactatacacaatcagaatctactccagttataagatgttatttgtttagaaattctggctgaataaatcaataaattactacaggttaatcatgagccagtatctgagataatgatgaatattcattcattaagacctttttttgagtactgatcaatcactgagaagcaactaaaatgtgcgttaatagggaagtggattaggatcattttaaggagagtttagaataccttgaaaaaaagtattcttaaccgggtgcagtggcttagcctataatcccagcgctttgggaggccaaggcagggggatcacctgaggtcaggagttcaagaccagcctgaccaacatgtgaaaccccgtctctactaaaaatacaaaaattagcctgctgtggtggcagacacctgtaatcccagctactcaggaggctgaggcaggagaatcacttgaacccaggaggcggaagttgcagtgagccgagatcgcgccattgcactccagcctgggggacaagagtgagactttgtctcaaaaaaaaaaaaagaaaagaaaaagaaagaaagaaagaaaaaagtattcttaaaaagatggagcacagaagatttttagggcactgaaactattctgtatgatactgtaatggtggatatatgacattatgcatttgacaaaacctgtagaactgtacaacacaaagagtgaaccctaatttgactatagacttttgcaacaaatgtaccacactaatgcaagatgttaataataggggaaacagtgggggtggggaaagggggtataaaggaactctctgtacttttcattcagttcttctgtaaatctaaaactgctccaaaaaatgtttattaagaaaaacgaagaaagaaatatactttagattagtggttctcaacgtgggcaattttgcccctcaggggacgtttagcaatgtttgaaagcatttttgatagtcacaactgaggaaggaggtgttactggcttctactgggtagttcctataatgcacagaacagccctcaacaacaaaggatgatcctgcccaaaatgtcaatagtgctgagattgagaaaccctgccttcaatgataagaatcctgaaaattctacactaatactctacaaagcatatcttttagacttacagaatttttctcttatgtcactctgaatattagacatctcagatgcaaatatcttggggccaagtgagacaggcattagaaaatcaactgggtaagcgagctgagaaatgtaagtcaaactcaccatcagacctggggacactgagatatggtgtgaactctgaagagaggagaacattgcccatgtttcatataagatacagatttgactctgtgtgatagagatcaaaactttaatttatcttcacataagtcagagctcgctgggcatggtggctcatgcctataatcccaacactttgggagactgagctgggaggatctcttgagcccaggagttggagaccgacctgggcaacacagtgagaccttgtttctacaagaaatttttaaaaaattagccaggtgtcatggcatgtgcctgtggtttcagctacttgggaggctgaagtggaccactggagtccaggagttcaaggctctagtgagttatgattgcaccaatatattacagcctgggcaacagagtgagattctcttatttaaaaaaaaaaaaaaagaatggagagaagatgccttctcagtttcttggtttctagtttcagataatcagataatttgctaactgcaaattgtcaatagtgattgattaaaggcgacaagtaatttaggcaaattacttgtctcgctacttgtggaatcttgactatccctcaaaatcatgtttttttttttttttttgttttgtttttgaggctgggtcttgttctgttgcccaggctggagtgcagtggctcaatcatggctcactgcagcctcaacctccagggctcaagtgatcctccccgctcagcctccaaagtagctagaatcacagctgcgtgccaccatgtctggctaaatttttaatttttcatagatatggggtctcactatgttgacctggctgatctcaaactcctggcctccagcaaccttcctgccttagcttcccaaagtgctaggattacagacatgagccaccatggccagccccccaaaattacattctcagggaagaacatggccttatttcttcacgttagaaaaggctcctgttaatcatccaaatctggtcgtttgtactattgcaaaatatcccttgtgaatatataacatcactttcctataagaacctgtttaatataggaattttccagcaagccatcaccgatatttgaagtggttgagctgtggacgtgactataacactaaaagagaaagccagcagaataatcgaaagacgactgacacagatagcttggcagaaaaatgagttaaactcttcaacaagcagtgtatagaagtagaattccaaatggccaacagaaaaaagtgttcatcttcataagttatcaaggaaatgcaaattaaatcctcaattaattaccaatacacaatggagtctcactctgtcgccaggctgcagtgcagtcgtgcgatcttgtttggtcctaaacaaggacccgggttcaaatgattctcctgcctcagcctccggagtagctgggactacaggtgtacgccaccatgcccagctactttttgtattttcagtagagacagggtttcaccatgttggccaggaaggtctctatctcttgacctcatgatcaagagatagaccgcacccggccagactatcaaactttttttttttttttgatatggagtctcgctctgtcacccaggctggagtgcagtggcgcaatgttggctcactgcaacctctgcctcccaggttcaagcaattctctgcctcagcttcccgagtagctgggattacaggcgccctccgccacgcctggctaatttttttgtatttttagtagagatggggtttcaccaagttggccaggctgatcttgaactcctgacctcgtgatccacctgccttggcctcccaaagtgctgggattacaggcatgagccacctcgtccggcgactatcaaactttaaaactccaacaaggtctagtttatatggagatgaagtgcaataggaactctcatccattactagtaagagtgtcaatcggtacaatcattttggaaatttgcataccctataacccagtaatcctctgctaggtatattccctagagaaacttatatacaagagtaagatttaggaccaggcgtggtggctcacacctgtaattccagcattttgggaggctcaggtgggtggatcacctgaggtcaggagtttgagaccagtctgaccaacatggtgaaaccccacctctattaaaaaaatataaaaattagccaggcatagtggtgggcacctgtaatcccagctacttgggaggctgaggcagaagaatcgcttgaacctggcaggcagaggctgcagtgagttgagatcgcatcatcgcaccccagcctggacaacagagcaagactctgcctcgaaaaaaaaaaaaaatttacactaacattgttcacacaaaagaacaactcaaatatcccataacagtataaatgcttaaactgtaatgtattcatgtaatagaataccacgcagcaaagacaacagacaatagctacacacatcatgaatgtcacacatattgagcaaagatacaagtccccaaataagaaacacaatcactacttcatgtacataaaggtccaaaacaaacaaaatgaaactagaaacaatcacacataggtgataaaactatgaggaaagacaagcactcgatctcatctcatctgggaagctaagtaaggttggggctggttacttcttggatgggagacagcccggaaatactgggtgctataggcttaacaaaacaaagacaagaaaacatttaccatagagtcagaatgcccatgaggaaagagggaattttattggaggtaggaaagtacaatatacagtggggggcaggaggcttctggggtcctggcaacattcctcactggctgtggttgtattgctgcatcctttttttctccttatttttttctccgagactctgtcacccaggctggagtgcagtggcaccatcttggctaactgcaacctccgcctcctgggtttaaacgattctccttcctcagccctcccagtaggtgggactacaggtatgtgctaccacgcccagctaatttttgtatttttagtagagacggggtttcgccatgttggccaggctgttctcgaactcgtgacctcaggtgatctgcccgcctccacctcccaaagtgctgggattacaggcgtaagccactgtgcccggcccagctgcatccttctaatttgttctttataccaatatacatgttttacacattattctatgtgatataattcacaacaaaaatggaatcaagtatggccagttgagtggatgtggggaaagccgaagttcaagatcactgccctgttatggggaggtgctgcaacggtaacgtaagaggttagaacctactaaaccaaaaatgaatccactgggatgttagaaacactggcatattattatagaaggttaagctcgatcgtttccatagtttaggatcaaacgggatttcacgtttgagtggactggcagtagctgagtgctcatttgttcaccctcccggggaatctgtctgggagcctgaggctgcaagggatctacggagcttgtaggagcagccaggtctggcttctgcacagaaggcccctccctggccggctgggcaggaggcatgatttatgagtcaggatcaacctcagagttcagagggagggcccaaaagtagtaggggaggtgaacaagcctcaatcgggatgtctctgcctttcaccagcaataaatacactcaaactgactggacattactgaccctaatggcaacggatatgttattttaaagatgcacttgaccagaattgccatgagggactggtttctccgggtcctagccagagagaatgcccataaatctacatcacttgctacttctcagtgaccaaaccagaaattgcttctctccataatttcagcaggaattcagatgtcacaatgaagaacatgcttgcattttatctgattatctaggctgaactcctcccttaggcattccagattcctatttcgataactttccagaaggaagctgcccatgacccactatttagctactacaactatttctcaggcaacaattcctttggtcattctgaagcccccctttcacaggctgtttttctttactgaccccaagtaccctgacggaatgtgccaaccccactcatttttgagaaagccacatggctggcaaaactgaggctactctttgtgtgtgctggagtacttgtgtggaaaaagccacccccagcaaatgggtgcacctgcttgtggctaattgtgggcttgtacacagcaacaatcagccacctgctatcagagactggcgtagaagggagtgcaggcagttagcacactgggcatgctagtacttcctagagaaaactaagacccttgctgtctatgcttggtgtgggggcatcctccatttgtagaacagcttaaaaaaaaaaaatgcccaagccccaaagttgcaaatttcacttttgttgtttgtttttttttttttttttggtagggatgaggtctccctttgttgcccaggcaggtttcaaacccttgggctcaagtgatcctcccatcttggcttctcaaagtactgggattacaggcatgaaccaccacaccagctccgcatttcacttttcttctccaagcaaagcgcttccttacctgaaacccaaaccaaaggtgcataaaaaatgtatattaaatataatatccaaatggaaacagctacagaagcttcactttctaaacctaagctgtttagaaagttaacttggggctggttgcagtggcttacacctgtaatcccagcactttgggaggcgagatggatcacttgagcccaggagttcgagaccagcctggccaacatggtgaaaccttgtctctatgaacaatacagaaaaattagttgggtggggtggcacacgcctgtagtcccaggtacttggaaggatgagttgggagaatcacctgaggccgggagttcgaggctgcaatgagccacgatcgcctactgcactccagcctgggtgacagagtgagaccctgtctcaaaaaaaaaaaaaaaaagattaacttgggtctggagttcttttttcacctacacataattgtaactcaaaatccttatttcagaaaatgtgtatgtggatgtaaaaatgccatagttaagtgcctatttgaacactcagtaaagtctaaagcctgttattaagtgtatatgtaccatacagcttacataacatgagaaattaaaagatcatgacaggggcctcccaggatttgggcaagtcatcacagccaagaactctatttagtactgtgtcccaggcaaaccaaagatttactgttattaggaatggagctaattggaaacatttgccagtcttctagtgttgccttgtataggccttgatgagaagtcatttctttgtctgtgcttactagaaacctgtgatgacccatcaaggttctgaactacactgaagaaatgggacaggattagtgatcatagcagctacaaaagtttatttaggccaggcgtagtagctcatgtctgtaatcccaacatttagggaggctggggctagcagatcacttgaggtcaggagttccagaccagcctggccaaatggtgaaactccgtctctacttaaaatacaaaaattagctgggcctggtggcgcgtgcgtgtagtcccagttactcaggaggctgaggcaggagaattgcttgcactgggaggtggaggctgcagtgagctgagatcatgccactgccctccagcctgggtgacagagtgagaccctgtctcaaaaaaaaaaaaaaaaaagtgtattaaatgtctgttacataggtgtaacaggtgccaacttaactatcaatcaaaccatttgagctggatcttctattgaaggatgacagattgcataaacaagtaattattaaaaaggatcttggttactattaacaaacaccaatttcctcaactaatctactggcactgaccaagacctgggtgattagcagtttaagagcttttcactggctagcttgccttcaaattgccctttattgaaaaagaatatcatgtttctttcagttatttgtagaacctggccttcaatgatgaattcagtgtattatctgctggacttaacaactagaaatttctaatagtaagtttctctctactgattcctaggtaaagcaatattaaaggtgacaaacaaaagaaaacagtgattatcattgtaccctcgtaccctggccagcagcatcaacattatcggatgactttctggaaaggcaaatctcaggctccaccccagacctactggatcagaaaggctgagggtggggctcagcaatctgcttttaactaagggcttaagaaccactgcaataggataaacacaacataaaacagagattttggctaggtgtggtggctcatgcctgtaatcccagcactttgggaggctgaggcgggcggatcacttgagatcaagagttccagaccagcctggccaacatggtggaaccccacctctactaaaaatacaaaaaattagccgggtgtggtggtgtgtgcctgtagtcccagctactcaggaggctgaggcaggagaattgcttgaacccaggaggcggagtttacagtgagccaatctcatgccactgcactccagcctgggtgacagagcgagaccctgtctcaaataataataataataataataataataataataataataataataatattttcaagaaagaaactgtaatcaactccttaaattgtagagatggtcagggagcctgagcaaagcttttgggtggacagctcaggtttgttttaggagactctagcaagtgacctgacctagcagtgacaaaacatgagtgctgtcatctaatcccccaaaagaaatacttctaaagggccaggcgcagtgactcatgcctgtaatcccagcactttgggaggcagaggtgggtggatcacctgaggtcaagagttcaagaccagcctggctttgaggtgaaaccctgtctctactaaaaatacaaaaatcagctgggtgtggtggtgggtgcctgtaatcctagctactcaggaggctgacgcagaagaatcgcttgagcctgggaggcggaggttgcagtgagcccagaccatgccactgtactccagcctggacaacagagtgagactccatatcaaattaaaaaaaagaaaggaaaaaaaaaaagaaatacttctaagggacaacagctctttcactgggtattaccaggtggcagagagtgggctaacccctttctctacaggcatattatgctattaacatcagtgtccctatttcatggatatgaaaacagagttaagggagattaagcaatttaaactcacaaagcaaatacgactccaaacctgtgctttaacaactttgccttactcctccaggattctaggaagaggggacaggaaatagggaaggagcagaggaaagattttaactttgaggcttcagcatttatcattatggtagccactgattaattccaccaaaatatgtattgcttaggtgatgacagtctgcgtttttaaactagatcaaactggattaaccacatcaaggatctgaacatagataacaagacttaatgtgttagcagtgtttcttgaaccacaccaaaccagaacaaaccaaacaaaaaccatagcctagttgtcccttagtagtgaggacaccaaatttagggttttattgttgttgttattgttttggttttttttttttttttccgagatggagtctcgctctgttgcccaggctggagtgcagtggcacaatctcagctcactgcaagctccgcctcctgggttcaacagatcctcctgcctcagcctcctgagtagctgggactataggcacctgccacgatgcccgggtaatttttatatgtttagtagagatggagtttcaccatgttggccaggctggtctggaactcctgacctcaaatgatccgcccgccttggcctcccaaagtgctgggattacatgcatgagccaccgtgcccggccccaaatttggtttttgaaaaacacttttacatgagctgcaaaaccagactccagtcattttcggcagaaccttaaaacagggagttgcaaactgctacaggtgagaagtccaatatatcaattaaagctccttaaaccacacaaggtattcctgaagccccactttttatactgattcaaaaagctcagagtaagatctctaccctggatgagttatctctgttactgttagggtatactaaggcctgggatgggatgaagaaaagaagaaacaagctgacactttcattcacagtcaatcatatgcaaaagcagaaagctagagctcaagttcactcaatgcctaatgccactcctgattattgcaagttagttccgaaaaactgattacagactgagctaactgcataacagctaaaagaaagagccctcttcactttctacccacccagactaaacttaaaagagagcagctccacctagccgggtaagcgaggtgaattcatttggtccaacccctaaatgcacagatgagagaaacaagacccactgaagtttgaaaacttaccaaagttcccacagtaggtggcaacagatctaaaggaccagaggtttgttctctggacaactgcaggccggagcacaagaggaggaagaggagagaattggaaagctagggaggaacggaagaggagggaggggccgggaaaggaaacacccagctggctgtgccagcccttgctctcctcccctcctaagccacagggtctttcatttttggaatttcctccctacctttaaacctttcttgatttaaacctttcttgatcagaccttaaaccaagtcaggttgcagctatttacagagtgaaaagtgagaactgaaagaattatataagcctttctcctggcctctggccaaatctagggatgcctcccactgtttctgtgagaggtgggaagttgttggcccatccttcatcctaagaagctccttcacagggctacaggtgtgagcatgcaaagaaggccttcatgggggtttaggtgtgagcatgcatttctaggcttcatgcatttctagcgccttcatgggggttcaggtgcgagcatgcatttctacaccatctctggtccccagcttcctcagacctctcagcttctctttcataggatgataaaagatattctttgggcttttatttatgtactcatttactgagacagagtctcgctctgtcatccaggctagagtgcagtggcgcgatctcggctgactgcaacctctgcctcctgggttcaagtgattctcctgcctcagcctcctaagtagctgggattacaggcacgcaccaccatgctcggctcattttttgtatttttactagagacagggtttcaccatgttgcccaggttggcctcaaactcctgagctcaggcaatcggccggcgttggcctcctaaagtgccaggattacaggcgtgagccacagcgcccatccactttgggctcttaaggtggccatcctaggcacttgctatgtgtgacaagtgcctaggatgcattttacttacacaaactcatttagtcttcatggcacccaagatgttggtgctctaatttacagataaggaaactgagatttagaaagatcacctagctgcccatcattttactagagctagtacacaggcagccagtacatacctaggaaaaaatcaaaaataccaaccaaccaatcagctctaggcctatgatttgcagtaatacggtttggcctttagaactgcattcagtcccaggtctctctgttcctaggagttttgtggtcttagataaactaacctttgtgagcctgcatttccatattataaaaatacaaatagtgacctgttgcataggattcttgggtatattacaatagaatgcaatgaaggcacttgcctatgttcaataaatgtgttccttcctggccaggtgtggtagctcacgcctgtaatccaggcactttgggagactgaggtgggcaaactgcttgagcccaggagtttgagatcagcctaggcaacacagtgaaatctcatctctatggaaaatacaaaaattaatcagacgtggggtacacacctgtagtcccagctactcgggaggctgagatgggaaggtcacttatgcccagggggcacgtgatctgcagtgatccatgatcatgccactgcactccagccaggataacagagaaaaatcctgcctcaaaacaacaacaacaaaaatgttccttcctttctgaaggtagcataataaaccaaagattttaccaaacactttattcctaccactctctgcccaggctggtggtcgattattactattgagaagaatcctaaaggggtgatctgggttagagttggcagatttaatatattggacatacttatactaaaaaattgctcgttgttcatctgaaattccaatttaactgggcgtcctatatttttatttgctaaatctggcaactctaagggcttataataaactgcctgggaaaagaactttgaaagtaacttgccaagttccgagttgtgagcagtttggggcttggtttgacagagtctattggcaaccagtggaagctcagcctagaaactcacttttccaacatcatgactgatccacaggattggtgtcagccttttattttctcagcattctaccaaagatgcatcctgtagcaggaaacctgcttgtgttctgggaagtgcagtgtcctctcagctagaattcctttgtcattacatttttgtctgtggcctaacttgtaacaggggacaattactctgcccatctgcatgcttgatggggatcaactgtcaagctatttgtttttaggtctaaggaatttctaatgagaatgaaaatgtgatgaaagatttttctaaacgtcagccagctccctgaggactccgatcatgtctactttgaacctttaactctcttaataatgggtagaagaaatatcatccataagaatgacttaggttgggaagcaggttaacatgaaaatctacaaatatttaaaataaaaatattttatttctctcctgttaaattcatagagacagaaagtagaatggtggtggccatggactgcgggaggagtgaatagggagctgtttaatgggtgcagagtttctgtttttccaagatgaaaaagttctggagattggccgtacaacataaacacgtccaggcgtggtggctcacgcctgtaatcccagtactttgggaagctgaggcgggtggattgcctcaagagttcgagaccagcctggccaacatggtgaaaccttgtctctactaaaaatacaaaaaattagccaggtgtggtggtgcgtgcctgtaatcccagctattcaggaggctgaggcaggagaatcgcttgaacccaagaggcggaggttgcagtgagccgaaatcatgccacttgcactccagcctgggcgacagagcaagactctgtctcaaacacacacacacacacacacacccaacataaacattacttaacactaccaaactctattcttaaaaatggttgagatgataaattttatgtatattttactacaatttaaaaaaatttattcttaaatctagagttagaaaaaggatacataggccaggcatgatggctcatgcctgtaattttgggaggccgaggagggtggaacccaaggtcagaagatcgagaccattctggctaacatggtgaaaacccatctctactaaaaatacaaaaaattagtcgggcgtggtggcatgtgcctgtagtcccagctacttgggaggctgaggcaggagaattgcttgaacccgggaggcggaggttgcagtgagccaagatagcgccactgcacactccagcctggacgacagagcaagactctgtctcaaaaaaaaaaaaaaaaaaaaaaaagaacacgtaaaagaaaaacaatcaatgcagataatgttttcctacaaaagaatggaaagtcaaagaaatgtgtttctcttctgggaaacttcctactagacaagtgaaaaattatttatggtcaacttgaagccccaactctttaatccttcttcctgtatgtgtgattcaatgtgtctttcctgatcacacaaaaaaatggattaaccgcattagccatctgaacacagataagaagactgtattgttatgtgttatgttatcacttagtgtgtttccagaaacaaaccaaaaggcctggaaatgcttatcagcgggggaatgtagaattctccctcaacaatgtcgtctcacagctcctgtagactctggatggtttgcactttgagaagtggaagtagttcatgtcatgctactttctattcctaccgaatgccacgcatgcctgtgtctcagccagccgctacctgaagaggccaagtatgctgagtttcatttcaggaccaagtagctatgatgggtgtaacggcctggtccactccagtggagaaagaaactgagaactcaaatgggtcaagagagttacttcctgtataggactgatcctatgtggtgttagtaactgtctaaagatgtattaaggtgggacttagggtttttgtgttcatttagttgcatcaggtttttttaagctgtgaaatgcaaggggttttgaaatgcaaaatacttaagctgtgaaatgcagaagcctgactcctactctgattctatggttcatagagtagagtgtgtggtccagcaagaggctgaaataagagtggaaaatgctgcttatgtgtccccttctgggagattcatagcgctcatgagcagattgaaaacttagccaagagaacttgggaaactttgtttaacttttaaccaagtattgtagagaggaaaatcacttctcaagagttttcacaaaagtgttttgttgattcatcaaaggcccgacctgaaataagacaaaaacgtttcatttctgtcaagtaagccttctttattctgctggccaggaaggtaatgattctaacaaatttgtgttgggatacaaaaaaagaaactggttgggtgcagtcgctcacacctgtaatcccagcactcttgggaagccgaggctgacagattttctgagattcaggcgcttgagaccagtctggccaacaaggtaaaaccccgtctctactaaaaattaaaaaattagccaggcatggtggctaatttcaagaagaattgcttgaacccaggaggcggagtttgcagtgagctgcgattgcaccactgcactccagcctgggcaacacagcgaggatccatctcaaaaaaacaaaacaaaacaaaacaaaacaaaaaaacccccaaaaaacaaaaaaggaaacctctaacagtggtaaaatgcatgtggtttggagccctaatttgccactctctagctatgtgacctaaatagtaagctacttaacagctacaaatctcagttttcctatctataacatggggacaatgacagtgccatcaaagggttgctgtgaggattaaacatattaataatagtaacgatggcaaatattgtttattgagacaaagaaatggttccagagaggctaggcaaactacccacaggtacataacaagtggctgggcctggatttgaacccaggcagttaaattccaaaactcctctcttcactacagccttcccattgattccagtgggtactcagcatagcgccttgcccatgggagatgatatttttattattatcattgacggtaaagactctggaaatgaaattagattttagagctttaagtgctccagaggtgtaataactaaggggcaaatttcttgaaagtgtttttatcctcccttccttaactactctccagggcatccaaagaaattcctttcccatgggaaatagctgcatttttttttttttttttttttttttttttttttttttttttttttgtagcacagctgtaacttgtgaatattcccttcccacttgaagctgggtgttaatatactctcattctgacccagcactgaattgcaaaatgtagtcactcactttttcttacaagtagaagcaccctaatcacatagttacttggtaattttcacctctcaaaatcttaggaaaaaaaaaaaaaggccgggctcgttgctcacctgtaatctgtaatcccagcactttgggaggccgaggatggtggatcatgaggtcaggagttcaacaccagcctggccaacatggtgaaaccccgtctctactaaaaaatacaaaaattagccgggcgtggtggtgggcacatgtaatcccagttactcgggaggctgaggcaggagaatcgcttgaacccggatagcagagggtgcagtgagccgagatcgcactactgcactccagcctgggcaacgagagtgaaactctgtctcaaaaaaaaaaaaaaaaaagctttgcttttacaaactcatttgtggctggcagctgggtgataaagccttgcctccttgccgtgtcagctttcaggaattctctgtttgtctgtgttgtgttacccaagtagcctgttatctttgcggtttaagggctgacttggaaattcagactgtcatctatttaaagaaaatggaagtccccactccactattttaattaactttcagagagcagggtttcctactggttatgataatgttaacttaaaatactctgaagggaacacggcaggaaacaaaataaaaagggaggattgctgtttttaaaggtattctaggaagaagagtttgaacaaagccatgaaggcagatagcatgggccatgcggagaaaaaatgaagagaggcatgagcagatactaaggagtatgcacagcagagaatgggagactaaatgtgtaatgccaaccaaatatggccttgaatgccaggttgtgctggtgttggtgggcaggtgtctgtgtgcaatgagaaattaagagatttttagaaataaacaatgatcaaatctatgtcgtaggaaggtagctggaagttacgcacaggcagtagtgtgtggtggaatcagaacagatctgagaactcaccagcaatgtaacaatctctttgggcttaaattttacatttattactttgttcaatggagataatagctaatgtggtaagactgaatgaaatcagacatgtacatttaaaataatgctgtaggccaggtacggtggctcacgcttgtaatcccagcactttgggaggcctagacgggcagatcacctgaggccaggagttcgagaccagcctggccaacgtggtgaaaccccgtctctactaaaaacacaaacaatagctgggcatggtggtgctcatctgtaattccagctacttgggaggctgaggtaggagaattgcttgaacccgggaggcggaggttgctgtgagcaacctcacaccactgcactctagcctgggcgacagagtgagattccatctcaaaaaataatatataaaataacactgtaatacccaattattagctcaacacataattcacacacacacacttttacagtcaggctgagtgggaaggaatgagggctgagaaagttgcggtgctgatcagcagaaggaaatctgtctgacaggtgggaaaaagatgggaaaggaaaggggaaatcctcagacagcatgcaagagagaatggagctgtaattcaaagggagacaatggaagaggagctggtttggaggctgggctgttggtgaggtcagcttcggaaatgctgaattcaagaaagaggtggatattcacaaggagtggaccagagcagccttaagaattaggtggtcagtcattgtttttactgaaaaagccactttgcctaggaaggtatttggggacatattttggtcaatgtttgtttgtttatcatgttttttgagacacagtctcaatgcctgtagtcccagctgcttgggaggttgaagcaggagaatctcttgaacccaggaggtggaggttgcagtgagccaagatggcaccattgcacttcagcctgggcgacagagcgagactctgtttaaacaaaaatcccagcattttgggaggctgacgtgggcggatcactgaggtcaagagtctgagaccagcctggacaacatggtgaaaacttgtctctactaaaaatacaaaaattagccgggcatggttgtatgtgcctgtaatcccagttacttgggaggctgaggcaggagaactgcttgaacccaggaggtggaggttgcaatgagctgcactccagtctggataacagagcaagactaaaaataaatacacacagatgttcatcacagcattatttatattagctttatggggaaaaaaagctaatataaataaggccatgatgaacatcttttttcccattatttatatgggaaacaagtaatatttgtaacaataggggagtccatcatgtccatcaatttggtaaaataagatggattacaggaactgttttaaatactttacaaatgcaatattaattcatttaatcctcacagcaatcctatggagtgtgtattataattgtaagtcccattttacagatgaggaaactgaggcttggagattttaagtaatttgttcaagattacacaggtaataagtagccaagctggcatttgaatcaggctgtctggttccacagtctttgctctaaccactacaacattgcctcatggtattttattttgcctgactttctttgtgtgtgtgtgtgtgtgtgtgtgtgtgtgtgtgtgtttttagacagagtcttgctctgttgcccaggctggagtgcagtggaacgatctctagctcagtgcaaacctccacctccacctccaggttcaagcgattcttgtgtctcagcctcctcaggagctgttattacagatgtgtgctgccatgcacagataacttttgtatttttagtagagacaaggttttgccatgttggccaggctagtctcaaactcctggcctcgagtgatccgcctatctcggcctcctaaaatgctgggattacagaagtgagccattgcacctggccttggctgattttcttttctttttttttttttttttgtgacagagtcccactctgtcatccaggatggagtgcagtggcaccaccttggctcactgcaacctccacctcctgggttcaagcaattatctcgcttcagccttccaagtagctgggactacaggcgtctgcgaacgtgccaggctaatttgttttttttttttttttttttttgagacagtttcactcttgttgcccaggctggagtgcaatggtgtgatctcggctcaccacaacctctgcctcctgggttcaagagattctccttcctcagcctcccaagtagctgggattacaggcatgtgccaccatgcccagctaattttgtatttttagtagaaacagggtttctccatgttggccaggctggtctcgaattcccgacctcaggtgatccacctgcctcggcctcccaaagtgctgggattataggcgtgagccactgtgctcggcacccggcgcctgattttctcagaagagttttgtaacaaggcagggtgcgatggcttgcacctgtaatctcggcgctttgggaggccaacataggcagatcagctgggcccaggaatttgagaccagcctgggtaacatggtgaatccctgtttctacaaaaaatacaaaaattagccaggtgtgatggtgtgtacctgtagtcccagccactcaggaggctgagatgaaagaactgattgagccaggaggtggaggttatagtgaactaagatcatgccactgcacaccagcctgggtgagagaacaatgctctatctcaaaaataaacaaaaacaaaataaaacaaaagaaaaacaaagaggagttttagaacaaaactttggaggaaaaacatatcctctctattcaggggagaagatcagatagggagagcatggtaatttgcaaaatgctcccacatgtcctgaaaaccaacctgcaaagccattgttttgattaaccccaatttacagatgagggaaccgaggctcagacaggataagtggccactcagagggatgttgccagtctgcgtgatttccagtcccacgctctctccactacttagtgtagtttggacaatttcaaaacagtgtgcgccacttcaacctcgtgatcactcaggaaaaccaccaggaacaagctcgagtgaaggcaaaggtctggactgggcttgcccagaattaactcgccaaccttgatgtcctagggctcaaatgtttgaacaactgaaggactgtcccttttaggccttcctttgcctcaggcaagggatcttccctaaggaaggtttgtgaaattaccctttctttttctattctccacctcccccataactataggttattacagcttcttcagaccaaccttagtctcaaaagtctcatcagaggtagataagagaccagataggatgatagtaataatgaggataataataactaaattaataataatagcccaagggtgtagattacttgctataagccagatgttgccctgggcaacgtttacatacatttgattctcatgacagttttatgggaaaggtaccattttaccgatgaggaaactgaggctcagagggtgtcagtcacagccttgactggggctaagtggggaaggtgggttagcaatccattgagtgtgagcttttgggccctgaaaccctcatttacaaattgactttagaatcacctcccgtatgatttcttatccagggttgttttttaaaaatcacccccataaatgactgtgttccttgcatatctgatattcccaggaaacgtggcttttctggagaagacaacagtagagacacagcagcttttttctgagtctcactccgtcacccaggctggagtgcagtggcgcgatcttggctcactgcaaccttcgcctcccaggttcaagcaattctcctgccttagcctcctgagtagctgggattacaggtgcctgccaccatgcccagctaattttcttttttttgagacggagtctcgctcttttgcccaggccggactgcagtggcactatctcggctcactgcaagctccacctcccgggttcacgccattctcctgccacagcttcccaagtagctgggactacaggcacccgccaccgcacccagctaatttttttgtatttttaatagagacagggtttcaccgtgttagtcaagatggtctcgatctcctgaccttgtgatctgcccgcctcagcctctcaaagtgctgggattacaggcgtgagccaccgtgcccggccacccagctaatttttatatttgtagtagagacagggtttcaccatgttggccacgctggtctggaactcctggcctcaagtgatcctccctcctcggcctcccaaagtgctgggattacaggcgtgagccaccatgcccggcctcaggcgtgagcctttaatgatactaatggtctgtaaactaccttatactcttgtttttttttttaaactcctgcccctttctttccattaaaaacaactggtgtttgattttcatgatttcttcaaatttcttaacctagaaaaatgtaaatacacacacacacacacaaatatatatatatagagagagcacaaaacagaactggtgggagattgtggtgaggaatcatggtgttttaagtggcatccttgaacattctaccaaagccgaatgggaagatgaggagagtgttgggagtttccgaactgaagtacaactccgtaactggaagttttcaaggttggaaggcattattttgttagtccgttaaggggcacattattcaaagacttggctgggaatgagtgctaggtgatctgtaaataatctacgagtaacgtctaccaggagtcgaacattaacatcgtagaggccaggctttcaaaggggtcattggcctacaaagggaagcattgcctccaccctttaactgtttctctacaactccaacgattgcattaaaaggacagaatggagcaggtagagggtgaattcaaatataaacaccctctgtggatgtggccagtgaggcagttagaaccattaagtgtctccgcagcaacaatacaactgttaggtcaagtgtatgaagggtgaggccccttcggggcagctgtgaaagaaagcccctattaatcccttaactaagcagctgatggatttaatctttttgtgcatacattataactcttcgaacacaagattattgtaaggtttttttttatcagcataagctatcaaagctttttatagatttcttcatctcactaattaacagatgacagaaaacagaactttggagagcttctggttccatcgctgtcattctggcttcaaaaactgtaagaaagcatcattccctgattcattcacaaaaagaataggtctctatttgaagagcgaagagatctcagtctcctgccttacagatctactttcctttgattttgtatccattgttatttaaaataaccacataaaatgattctttagggttattttgcatagtaatatcagaaaagaaaagcattacctggtataatctcccttggcttcctaaaaacaacaaacaaaaacagagttgatcaatatgtatctttgttaagctaaatgagttttatcttgattactttcccctcttaaagttcctgagttttgttttgaagagtgtttctcaggaatgctctccctataggcataagaagaattaggcattgataagaaaaccctgactgtcctgttaggaatattccttattcttaacaaaagaaacatatgtatgtgaaaaagcacagataattatttctcactgtacgtttttaagatcacatgataaatgcttttcattcaagtggcacactttttagactggaggaagaccttttaaaccacaatacaggtaaaccaacacatactatttgttttccctttactttttaaaccagcatggaaacagactaatgcctttaagaactaaagggctcttttactggaccacaagaaaatgtatacaaaagttactaaatttaaatgaaaattacagctgttgtaacaactgctgcctcccaaattcaagtatcccagagctctcttccaggaatatgggtttaattcttctccttcagagcagtctaaatttcatttttctttgagactcacaatatcacattgtagctcatgcaaactattctaaagcagaagacggtggcgcacatttttcatcggcaaacaactaactggcttaaaaatccaacaaacactggcccatgcaaaagtttcagagttgcaggcagttaacaaaaacgaacaaacacaagggagctgctaagaggcagtttgtccaatcttacctgtaaaataaacgctgctaacttgaagatggtttcgctctctacttcgatttgcccctgttgatggaaaaggaaagcatcattgaacatggggctgtcctagattgtagcaaatggctctgaagttgaggaagctgtcacagcttggcacctccagtttacgatcaaatgcagatcataccattgcaggggaaagtggggggtgtggagagactcattgagggttaaggcgaaaccactgtgtgtgcgtgtgtgtgtgtgtgtgtgtgtgtgtgtctattttaaatagctgtggtgacggattatgtgtagagagcagtattcaggaagaaacgggaatgactttgaggctaaacattcagaaaacttctaaatgaaaaatttttatctctgcaagttcatttttaagcactctgcagaatttcctagattcatttgttgagtgttttcctgggataatttttttcccctgtgttacagcatggttatttcagtatacacacaatgtaaatattattaaaaatataaattcacttctgtgtcaatgacacattgttgagttcatatttgtactattacagataaaatgtgaggccttaaaaatcagttacagcaaatgctttgaagactaaaattctgttgatttatattgaagttcgaggaactctaatttatcagttttccttttttttttttttttttatcattcaaaaccccaaagaaaaattggagctctgggccttggtaaagaatgctttttcagggcctggcacagtggctcatgcccataatcccagtactctgggaggctgagggagaaggatcacttgaggccaggagtttgagaccagcttgggcaacatagagagacctcatctctaccaaaaaagaaaaaagctttttcagtagaccagtagggatgcatagatatgtgcagaaagggtatagctctatcaataatattcatatgcacctttatattttttaaattgcgatgatacatgaaatattattactaaaccatattataacaatgaatggtatagaggtatctttattttaaaaaaaggttttagtggtaacgttagcttgtaagttttaacaaatgcaaaaaaattccacgtaactccattattgcctaagtcctgtataattagtacttgaaagggcacagtatttaagaacatggaattcctggaaattgccctgcattctttcttcctcccttccacctcttgaatctgagctggagtgtttcctagttataccaagtgcatcaatggggagattaagtctttttaaagtaaatatacaatagacaggttcacagaggtagttaggctcagtgaggatttctgaaaggattgtgcttttctttcaggtttccacgtgatttgaagagggttctcaaaaaacaaacaataattattttaaaacccataaaataaaatgaacaaataaaaaccccagggtgttacaatgccagcagtgataattattcatgtttcccttatattacaagatgaaaacaagttaatttcatcctctaacacacaggccgcccttctgaaacctgaggagaggatctgcttcaaagtttattgcctcaaaagctgacaggcccagagccttggaattcaaagctcgcccataatctctagaaacagattacaaaatcaaagggaagccaggttgattgcagaaatcaactgccctctgcctttcaggcaggagacgatggttttccaatctggtgaaagatgatgaggcggttcatccaacaggtgaggtgggtgttgataaagattaaattttagaaaggctacattccttagttcaaagaaaaagaaactcacggcaagggaggagggctaacaggagaactcaaaaacatcactgggtttgaaattaggcaggaactcaaagttaaagtcaaatgtgtcttaaaatcttagagaagaaaaaattacttaagatgttaaaaacgctaaagatgaataaagtaaattgaaaattactgccaactcctctgacatcccacgacccacctttgcatcatcagaacctcagacaagtcacctgaaaaatatttcagacaccaacttttcaatttattaaatggaagttcagcagacagaaaaacctacagcagatattcttagggaagcagctaaataactttctactttagaagggttattaagtattaaaaatgctgaaatgaggaactgagcaagacaagtaccaggctcagacagctccagaagagtggggagcaaatatccaactcacctgtggacttttccacctacacaagtggccccaatacagttctggtggaggagggtgacggtgcggtgaaggagtgggctctagcaaaatcttgttccaggaagagaagagaacgcatgctttggcaaaggcccatattcttttaaaaccctcagcccctacctcaccttccattgaacaatcactgttctagaaatcccgggcaacaaattttgagtcctaatactgactgccaaagttctttgactcattcacggagtttactaaacaatacattattcaggtgtaacactatttgcccagttctctgcaatttcatttgatgaaatttaattaagacttaaaaagaactccaggatttcaagcctgaagtgtaaaagctgttttggaagtgccgtctgcccaggacagaacattgcttttactctcaaccatggcaacagaggtaacattataggtaccgggcaagccaacacttgagagaaggatctcctcaaagagagaggtaacgggacacttcagtgagtttccatgactgtcatggataaaaaaagagaaccagagaagtgagtcagatgatgtggctgaatgcacaaaggtaatatgaacagtatcaagtcctggtgccacaccctcatggctaatttaactgggttataaattcaatcaataggtcaccgggttcaggtgccacacaggacatctcatttttgtctttggcttcttggctcagttgaccaagacaccaggctaatgaggtgaattctaggttttgattaccaagtaggagaacagaatcaaagatagttttggggctcgcaagggaaattagtgaaaatatgattcctatttttttttttttttttttttgcagatgatgggaggcaatgaggatcaggaagatgaagtgtaatgtccaatccccttgaacatggcaactctggactccctgtccagtgctctttccactctaccatgcactagttaactttttatgactgcagtgcaaattcttatcaggaatcctccaaaggtatgtttttggtaaaaactggaaacaggtgaggctgtggaaaaatgaatccaaaggctatctccactgttgctgggactgtatgttatcaacatacactctcaaagtagagtgggaaaatatttcttaagactgattctgctcttcccatatggatcagtacttcatggaaacttatctgtgctacagcaatgaatattaatactgtggtcataaatacttaggatttagacatacttgagaaactactgggacacctcagtttgtttccaagcctactgctaattatctattttaagtagaagtctttaaaattaacttgtagaacaccaacaaataaatgtagaagaaatgaaaaagaaagaaaattacccttgcacctctctagtactaattgattcaggcaataatcttcaataaataaaaacagtttattgaagtctggctcaggggctcacacccataatcccagcactttgggaggctgaggtgggggcactgcttgagctcaggagtttgagatcacgcaccatagcgaaaccctgctctacaaaatatcaaaaattagccaggtgtggtggctcatgtctatattcccactactagggaggctgaggtgggaggatggcttgagcctgggatgtcgaagctgcagtgtgccatgatcatgccactgcacttcaacctgggcaacagagcaagaccctgtctcaaaaacaaaaagtaaaaaactcacaccttttttttttcttttttagacggagtctcatactgttgcccaggctggagtgcagtggtatgatcttggctcaccacaacctccgcctcccgagttcaagcgattctcctgcctcagcctcccaagtagctgggattacaggggcccactaccatgcccggctaatttttgtatttttttttagtagagatgaggtttcaccatgttggccaggctggtctcaaactcctgacctcaggtgatccatctacctcagcctcccgaagtgcttagattacaggcgtgagccaccgtacccagccaaaacccacaacttttgagtgaaagtttgatgagaaacaggacaggatattaatgtaatcacaaatacctctccatagattacttattaatcacaaaagggaaaacagtaactcttccaaggggaagctgacacataccatcttaaccctgtgatgagatattgccaataatgggatagatcagcttcatgagcctcctgatcataaggtatgcatggaggattacacaaccccacctatccaagaaatgaaaatgtttcacaactggaaactgggggctgggaaaggtctgatttgtagcattagttgatgtcggcagtgtaaatactcccaccatggctgatttcaggttaccaatataacatcacagaacacagaggtggaaagagatgtgagaattagctctcaagagatggtacaagctagctccagcacaccatggtgtggcattcctgtcaaaaatgcattactagatccagtcatgaggaaccatgagacagatccaatctgagggatattctgtaaaacatctggctcatgctcttccaaaatgccaatatgatgaatatgaaaaaagaggttccaacgtacaggagactgaagaatcgtaacaactaagtgcagcatgctatcccagatcaggaggaaatattacaaggacgttactgggacaactggactgtatattaaataaatagtagaggttcaatgttaaattttctgaatgtgatcattataattaggtcatatatgggatgtccttgattttaggaaatatacaatgaaaatatttagggataaacaggtatgatgtctgtaacttactctcaagtgggtcaaaaaatttacatatgaaaggagaaagtgcaaatggagccaaatgttaaaaactggtaaatttggcttggcagacatactaacagcttttggtactattctttcaactcttctgtaagtttgaaattgtctcataataaaagtttgaagccgggtccagtgagtggtatatgcctgtagtcctagctactcaggaggtggagtggggaggatcgcttgagcccaggaattcaaggctgcagtgagctgtgattgtgccactgcactccagcttgggtgacaaagcaagaccccatctcttaaaaaaaaagtttgcaaaaagaaaaatatagacatatattcctggagtggtggatatctgttttgactggcaagtacccttctctttttttgagcagacaattccattatcttggataattacttctttccctatggctctagtagaaacacatcatcaattttttgggggaggatggaaactgctccaaggacccactccaggattttctgaattagaccaaagggaagaaagttctctctctctttctctgggggcaaagttgggaagatgtgatctagaggaaatcgatgaccacagatggaaaggagctacttgatgttggtagtcaactgtatccactgctgagcagagtcagacttcaaagcttttacagttcaaaaattgacaagaatgatactcaagcagggtgctctggcttgcacctgtagtcccagctactcagaagactgaggtgggaggattgcttgagccaaggagtccgaggctgctgtgagctgtgattgcgccactggactccagcctgggtgacacggtgagacctgtccttaaaaaaaataaaaggttgggggggagggactatttggatgctgtctaggatgctctcactttggtttactgccaagccaacaaacagtgcaaagagcagatgtgataaggacagaaatgagtgagtgcatgcagctgcctggagtttaactcacatctcatttctcctgaggatagatctacatggaggtaggaatatgctgggtcagacaaatccacactgtttttgtttgtttgtttttgagatggagtctcactctgcctcacaggctggagtgcagtggcataatttcagctcactgcaacctctgctgcccgggttcaagtgatcctctcacctcagcctcctgatcaactgggattacaagcacacgctaccacacccagttgattttcgtatttttagtagagatggggtttcaccatgttggccaggctggtctcgaactcctgacttcaagtgattcgcctgccttggcctcccaaagtgctgggattacaggtgtgagccatggcccctggccacccgcactggtttttatgcaattaggctggtggtggaggagccatgccaacactgaagacctctactaccctacaaggcaattattcctaagccatagaaacatattcctctgtgctgatgcctattttccaggagttactctgccccctagaaagccaggccatagctactacatttgcaccccactcctactcacatcctttgggtacatcattttctccctttttgtccaagctagttgttagaggtaatctttatgggggatggtctcagtgatataatgcccattcattcttctagatcagggttttataacctcagcacaactgatattttgagtgagagaattctttattgtgaggctgccctgggcattataaggtggtaggcagcatccctggcctctactcactaggtgccaatagcagcctacccctggctgtgacaactaaaaacatctgtagacaccaccagatgtcctcagaatggcccctacttgagaaccacttctctaggttctctaagttttattcttgggttaggctagaataatcagaaacctatataaagcataagggctcatccaggtaaaattgcctttttggaactgtattctggcattactccactggcttatgttgaaaaacaatataagtaacaaccctcagaactcattattttaatacttccagtgtgttgttgagaacactgtttattacacaatatgatatcccattgggaggacccatggaagaagtttctgatttttcatatcgatattgactgtgccccttctgagcagctcctttctttttaccttaatgaccactctgagttatgtaagtgattgtaactccctctttactgtggctcttaagagaagttgaattataaatttgtgggctaaatgctttatactaaccatgctaaatattttatactaaccttaatcttggcagcatctagttatttctacctttattttcttatttataaataacactaatttcatcacttactatattttaatatgttcaggattggcttttttttttcttgagacagagtctctctctgtcacccaggctggaatgcagtggtgctgtcctggctcactgcagtctcgacttcccaggctcaagcaattctcccacctcagcctcctgagtagccgggactacaggtgtgtatcaccatgcctggctaatttttgttttgtttttgagatggagtctcactctgtcacccaggctggagtgcaatggtgcgatctcagctcactgcagcctctgcctcctgggttcaagcaattatcctgcctcagcctccctaataactgggactacaggtgcgtgccaccacaccaggctatttttttttgtatttttagtagagacagagttttgccatgtggccaggctggtctcaaactcctgacctcaagtgatctgcttgcctcagcctcccaaagtgctgggattacaggtgtgagccaccgtgcctggccataattattgtattttttatagagacagggttttgccatgttgcccaggttggtcttgaactcctgggctcaagcaatcctcctccctcagcttcccaaagtgctggggttacaggcgtgagccactgcgcccagccagtatattcagtatttaattttttttattgaggtacatacaataaaatgcacaagtctcagtgtacagctcaatacattttgacatgtgtttgttactcatgtaatcatcacccagaacaagatagcaaaatcaaacattttcactaatgttttcatcttagggaaacatatatatttctataaactatatcaaatcaatacaattattttgctagttaaaaaagtataaatcctgaaaaacaatttcaatttgcagtttttttttcaatatcacctttactggtttgagcaatttaaaaattactaaccaatttgaatatttcccttgcaaatgcatattatttactattacccatatgtgaaatgagcctttgtttacttgcctatttgagaacctctgtttgatctgagttgcgtatacattactaatattattaactctctgtcttatctactaggtacaaattatgtccttcaatctgttctcctttgacatgcccttctcctagtctgtgaagtctgattggactgggacctatctccccactggaagaacctgtggggccatgagaaagttattttttctgaaactcagctcctcatctgcaaaatagaagataatgttaactttaccaagttgtttggagcagcagtcctcagcctttttggcaccagggaccagttttgtagaagacaattttcccacggaccagggttgggggatggtttcgggataattcaagtacattacatttattgtacaccttatttctattatttttacattaatgaaataatcatacaattcaccataatgtagaatcagtgggagccctgagcttgttttcccgtaactagaccatcccacctgggggtgatgggagacagcgacggatcatctggcactagattctcaaaaggagtaggcaacctagattccgtgcatgtgcagttcacaatagggtttatgcccctacgagaatctaatgctgctgctgatctgacaggaggcagagctcaggcattgatgcgagtgattgggagcggctgtaaatacagatgaagcttctctcgttcacccacccgctgctcatctcctgctgtgtggcccggttcctaacaggccatggactggtagcagcctgtggcctgggggttggggacccctggtataaaagcattcaataaaggatgaatgtaaagcatttgtcacaaagcctagcatccaaagactctcttaatgttattctccacactaatgttcgccatgttgcttcttaaattcatatgtctgtttttagattctctcctttgctctgggtcactgttcaagttttatatagttccataacatttaatcactgttcattacaatatgtgtcaatatctgataggataagtgctttaattttccatatgaatctttgacatcctcttattttcaaagaaattttaaattgatcttgtcaggtttaaaaaagaaataataatttgtcttcctctttgcaaccatagcacatttctattgaaatcactttttaaaatttgttttagaaatggggtcacccaggctaatgtggagtggtgcaatcactacttactgtaacatcaaattcatgtgctcaagagatcctttggccacagcctcctgagtaggtgggactacaggcactggccaccatgcctggctaatgaaatcgctttatagtgatcataaagttttgtgatatacctacaaatatcacactcgtcctatgtgaagattaatattcagtattttacattttgctacacaaatgtatagcaaacgcttttttttcatcctattgagaggtgacaacgtgctagcagccctcgctcgctctcggtgcctccttggcctcggtgtccactctggtctcgcttgaggagcccttaagcccaccgctgcactgtaggagcccctctctgggttggctgaggccagagctggctccctctgcttgcggggaggtgtggagggagaggcgccagcgggaaccagggctgtgcaccgtgttcgcgagttggcgagtcagcacgagttccgggtgggcgtgggctcggcagcctctgcacccggagcggctggtcgtcgccgccagccctgggcagtgaggggcttagcacccagccagcagctgcggagggtgcaccgggtcccccagcactgctggcccacctgcgtcgcgctcgaattctagcccagcctcagccacctccccatggggcagggcttgggacctgcagcccgccatgcctgagcccccccttggtgggcttccacatggcccgaacctccccaatgggcgccgcctggtcccatcgaccgcctaagggctgaggagtgcaggcgcgtggtgcgggactggcgggaaactctgcccgcagccccagcacgggatccactaggcgaagccagatgggcccctgagttaagtaggaacttggagaacttttatgtctagctggaggattgtaaaagcaacaatcagcactctgtgtctaggtaaaggtttgtaaatgcaccagtcagtgctctgtgtctagctaacctagtaggcacttggagaacttttatatctagctagaggattgtaaatacaccaatcagcactctgtgtctagctcagggactgtaatcgcactaatcagtaccctgtcaaaacggaccaatcagctctctgtaaaatggaccaattagctctctgtaaaatgggccaatcagcaggatgtgggtggggtcagataagggaataaaagcaggttgccagagccagatttcgcaacctgcttgggtcacttttcacactgtggaagggttgttctttttggtctttgcaataaatcttgctgctgctcactctttgggtccacaccacctttaagagctgtaacactgctggcgaaggtctgcattttcatttatgaagccagtgagatcatgaatccaccagaagaaagaaactccgaacatcagaaggaatggactttggacacaccatctttaagaactgtaacacttatcacgagggtccacggcttcattctttaagtcagtgagaccaagaactcaccaattctggacacactattatctgattattaacatgcaggattatgactgcttttagtgtatttaacttataaccaatgtctcaccaaagctaataatgttaacttttagctaatttatttccattttctaggcttatagtaaaattgtctccaagtaatatttttgtgtagttctttgcaatgtccgtggtatatctggttgcattacatgaaacagactttatatcttactgcacacttcatacgtggctggtggactctaagttggtattgtttttgttttctttgaaagcagacatttttaaattttcattttatttatttatttgagatggagtctccctctgttgcccaggctggagtgcagtggcacgatctcagctcaccacaacctccacctcccgggatcaagcaattctcctgcctcagcctcctgaatagcttggaatacaggcgtgtgccaccatgcctggctaatttttgtatttttagtagagatggggtttcactatgttggccaggctggtctcaaactcttgaccttgtgatcagccctccttggcctcccaaagtgctgggattacaggctgagccaccgtgcctgccctatttttatttttttaagacagagtctcactctgtcacccaggctggagtgcagtggtgcaatactggctcactgcaaccactgcctcccaggtgcaagcgattctcatgcctcagcctcttgagtagctggaatttcaggctcccgccaccatgcccagctaatttttgtatttttagtagagatggggtttcaccatgttggccaggctagtcttgaactcctggcttcaagtgatccacccacctcagcctcccgaaatgctaggattacaggcacgaaccaccatgccaggcttataagttggtttggatcaatgttttggcagagtctactaaagcataacatacatatacactatggctcagcaattttctcctaagtatacacctagcagacatgtttgcatatgtccactcaaagacaggcactaggatcttcaaagcagtgctatttgtaataatcaaatactgcaaggtacacaaatgacttttttttttttttttttttttttttgagatggagtttcgcttttgtccaggctggagtgcaatggctcgatctccactcatcatcgcctcccaggttcaagtgattctcctgcctcagcctccctagtagctgggattacaggcatgtgccaccgcgcctggctaattttgtatttttagtagagctggggtgtctccatgttggtcaggctgttcttgaactcccagacctcaggtgatccgcccgccttggcctcccaaagtgctgggattacaggcgtgagccaccgcgcccggtccacaaataagtaaatgaagtatattcatactatatactactattcagcagtgaaaatgaacaagctgggcatagctacatacaagaatatggatgaatctcaaaaacataatttgagtaaaaacagccagacaataaaagaatacatactgtatgactcctgtcatacaaagttcaaagtcagcccaaactaagaaatgctgttaaaagcaattgtaggctgggcacggtggctcacgcctgtcatcccagcactttgggaggccaaggtgggcagatcacctgaggtcgggagttcgagaccggcctgaccaatatggtgaaaccccgtctctactaaaaatacaaattagccaggcatggtggcaggcagctgtagtcccagctactcaggaggctgagacaggagaactgcttgaacccgggaggtggaggttgcagtgagccgagtttgtgccactgcactccaacctgggtgacagagcaagactccgtctcaaaaataaataaataaataaataaaaaagcaaatggtagcagacagaataaggactgtaagagaaaatgtgaggggcttcttgggtgccagtaatcttctgtttccttgacgttgatgctagtttgctagttacatgcacttttttttttttttttttttttttgagacagggtcttgctctcttgctctgtcacccaggagtgcagtggtactatcatggcttactgcagcctcgaactcctgggctcaagtgatcttcccacctcagtcttccaaatagctgggactaaaggtgtgtgccaccatgcctggctaattttccatttttatattttgtagagacaggatcttgctatgttgcccaggctggtcttgaactcttgggcttaagcaatccacccaccttggcctcccaaagtgctaggattacagacatgagccatagtacccagcctatatgcactttttaatatgtatattattcttcaatacaaagttaagaaacaactcctgatcttacttgtatccttttccatctgactgaatggcaaccccattcctttttttttttttttttttttttttgagacagagtctcgctctgttgcccaggctggaggtgcagtggtgtgatcttggctcgctgcaacctctgcctcctaggttcaagcaattctcatgtctcagcctcctgagtagctgggattacaggcacacacccccaagccctgctaatttttgtatttttagagactgggttttgccatgttggccaggctggtctcaaactcctggcctcaagtgatccgcccaccttggcctctcaaagtgtcaaccccattcttaattgcttagatccaagacctccattggcattactggacacagagttgggcagtgagcaatctgcacaactgtatttgatgactctgtttacatctcctaatacactatacacattatttattttctttattgtctgatgccctacctgctgtcacccctgcctagtaggtataattcttaagggcaggaattgttatctgtttttgccacagttgtagctccagaagctagaacactccctggcacacagcaggtgttcagtatttgtagaatagcaactgaaagagtaatgaagtaaaaagttggtgggggtatttatatctttctttttaaaaagggaatgcttcttgtgtttcgtgattcactatagatttgatttgccctgattttcagctcagagtaagggatcccaggtttttgaactgtgaggacatagcccaggcttcaccatctataagaactgtaagcatacctagacagcaattctagataagcaaatttacactacacacaaagaggtgttagatgtcaaaatatcatttactcttctggctttactttctacaaaagtagcaggaaaataaataatatctatgtaatacttcatggagttttgaggacaaacaaagatgagacataaagatgctttgaaaaagtaaaagacattacaaaaaaacaaacaaatacaggtatttttgtgggtgtgtatcacagtttcaaagacatgagcattatgaccaaagtatctgggcagaccgcttctcagaaacttgatcacgatgaagataggaataaacggagacagagaaagtttgtcatatgtgaattaatgctcagccgtgggaggataatacaaatatacagatatgaggtcgggcgcggtggctcacgcctgtaatcccaacactttgggaggcagaggcaggcggatcatgaggtcaggagatcgagaccatcctggctaacacggtgaaacccctctctactaaaaatacaaaaaaattagccgggggcagtggtgggcgcctgtagtcccagctactcgggaggctgaggcaggagaattgcttgaacccaggaggtggagcttgcagtgagccgagattgcgccactgcactccagcctgggcaacacagcgagactccatctcaaaaaaaaaaaaaaaatatatatatatatatatatatatatatatatatatatatatatatgcagatatgaaaatgagaaaggagagaaaactagccagaccatactttccccaggtagcagcccaggtatggtttgtgcaatgcacttttatttttagatggctagatggctaggtggcacatttatttgtccttttttttttttttttttgagatgaagtctcgctctgtcacccaggctggagtgcagtggcgcgatctcggctcactgcaagctccgccgcccggttcacgccattctcctgcctcagcctcccgagtagctgggactataggcgcccaccaccaagcccggctaattttttgtatttttagtagtgacggggtttcactgtgttagccaggatggtctcgatctcctgacatcgtgatccacccaccttggcctcctagagtgctgtgattacaggcgtgagccacagcgcctggccacatatttgttcttgagatgaagttccaagtagtttaaatagaaaccagatctttgtttctagataccattctccactaaaaggaaaaatggttgattccaaggctatggcagcaaaagtttagagaaagcctggactgtcttatcatgtcataaaataaagaagtgaggccaggcattgtggttcacgcctgtaatcctagcactttgggaggcctaggcaggaggattgcttgagcacagtagttctagaccagtctgggcaacatagtgagaccctcttgctacaaaaaaaaaaaactttaaattatccagatgtgatggcatgcacctgtagtcccagctacttgggaggctgatgagggagaatcatttgagcctgggaagttgaggctacagtgagctgtgattccatcactgcactccagcctgggtgacagagtgagaccttgtctcaaaaaagaaaaaaaaaagctcaaaagtggtgaggacaagccataagaacacaggatgtgacttaaagaggattctgttgggcaaagtgagaaccattaaagagcatcaaaatgaatgacagaaaggattttttgtgtgtgcgtgtgagatggagcagcctgccgcccaggctggagtgtggtggcacaatcttggctcactgcaacctctgcctcccaggttcatgtgattctcctgcctcagcctcctaagcagctgggattacaggcacctgccaccacgcctggctaatttttgtatttttagtagagatggggttttgccactttggccaggctggtctcgaactcctgacctcaggtgacccacccacctcggcctcccaaagtgctgggattacaggcatgagccaccgtgactggcctgaaaaatagtttttaaaaatgaagatggagaagaaggaaaaattattctttacgtatgaatgctaactaagaaatgttgaaggtgattcaattagaaacttagattttgcaatgaccatagtactaactgacttaggtaagatcaccactggaggccaagatcattgggtcaaagactgttaagaaacaggatagtcaagtagcctcaaagtgtcaattccagaaaacttaattacaaaggaaaaggtgacttcagaataatctggcagataccacctcaactcaaacaagacagactaacattgcatacctccttgtgagatgcaactgaggccatttcatcatctatagagtgttcgtgccatgagaaaattattagactagtgattctaaaactttggtgtattgcagatacctggagaactaataaagaatacagagccccaggctcatcaaagtattaataggatagaaagagataggacagggtgtaggtttctgtgttttcaccatgttcccagatgtttctgattcatgtccaacatgacatgtgtttggaaccagtgagttagagaaatccatatttcacaaattgagagatcttctaaggcagctgccctatactcttcagaaataccagtgtaatacaagccaaaggaagactggcctgctcttgattataaaggagactttagagttatacccactaaatgcaatgtgtgaccctgaattggctctaggaccagaaaagggtgggaaagactagaaacaacattagctatcagagcaatttgaataaagactgtatattaaacacaatttgtgaactatggttattaatttcataaaactgtaacctccacatgggcagagatatctttaactcactactgcacacccagcacctatataggcctagcacatagaaaatatttagtacatatatatatatgtgtgtgtgtgtgtgtgtatatatatatatatatatatatatatatatatatatatatagagagagagagagagagagagagagagagagagagagagagagagagagagagtgtctgtctgtccccccagtctatctctgcctcccgggttcaagtgattcttgtgccttagcctcccaggtagcttgaattacaggcatgcaccaccatgcctggctaatttttgtacttttagtagagatgagatttcatcatgttggccaggctggtctcacactcgtggcctcaagtgatcctcctgccttggcctcccaaagtgctgggattacaggtgtgggccactgtgcctggcctaatacatatttttaagtgaattaatctataccttttaaaaaactaaaccttttgatgacaatgttctaccagaagatgctgcaaaacatatcatcaggactatgaactttcctcccaattcttatttttacttctctcctattctgaagtcttgagtctctacttcattccctctaagcccaggaagaatgaggctgtcacaaggtcaaatatcagagactggctccaccattctgccaatatctgaatcctccttataaacttttgtgccaacatattttcaaagtaagggagtgagtgtttatgagactgccctggaaatgagaggtgtggcgatctatggctaaattgttaggcgatgcaagacaggcaggcagcctaaataggtcaggctctgccaataggcatggaggttccagggcacccacatctgatacatatacagggagacaattggagaacagatgaataaccagtattaaacaaacacttagaaccaagctctcaacttctgtacttacccttccacattataagattacatacacaacagattttaattacagcattctaattgcttaaacgcaccctggcaccaatgtacaatgacaatttgaattagtagcagcagggcgttctgatgcaaaactattttttctctatttagaaaaaagaaaaaatgcaaggtgcttaaaagataatcaaggattttagaggaagaaaggatgaatcaggaggaagaaaattacagtcatgatgttaaaagtaagcctttgactaaagaagccctggtaaagtaggtatcctatctggctgttttgcatgaataaatatgcagagatactttcattttcaggataacatcttccatctaattgaactgctcatttattactatttttgctatagggaataccatgtttaaaatattttcaccaacattcttcttgtataattgtggttatatatgatcaagtacttcttatagatgagaatttttttttttttttttgagatgaaatttcgctcttgttgcccaggatggagtgcaatggggcgatcttggctcactgcaatctctgcctcccaggttcaagcaattctcctgccttagcctcacgagtagctgggattacagacatgcaccaccacacccggctaatttttgtatttttagtagagatgagctttctccatgttggtcaggctggtcttgaactcctaacctcaggtgacccacctgcctcggcctctcagagtgttgggattacaggcgttagccactgtgcctggcagatgagaacattttataaccgtcctcctgggaattttggaataatatcatcaataactacaaaaacaagaaacatttattaagtgcttattatctgttccaagagctttggatatatattaatccatgggtcctgtgaggaggtaatgttatcaccctcccccttcataggtggggagactgaagcttaggaagatagaataggctgttgcttaaagccacccagcctgtaggtgatggagctgagatttaaagctggacagttaggaatcccctacctctgatacccgcttcccccatgtcatgcatcaagccaaactatggacggtctctccaaggggtgtataaacaatcttggctggtgtccaacacccctgaattactgacttcacttcaaccaagagtaaactgtattcttttttgtttgtttgttttgagacagggtcttgctctgtcgcttaggctggagtgcagtggcacgatctcggctcaagcgattctcgtgcctcagcctcccaagtagctgggactacaggcatgcaccatcacacctggctaatttttgtatttttagtagagacagggtttcgccatgttggccagcctggtcttgaactcctgacctaaagcgatctgcccgcctcagcctcccaaagtgctgggattacaggcgtgaaccactgtgcccggcctcatgtcttctttataaatttaaagttgtaaccatttgtggctcatttaacaagtttccctgaaatggatatctttatctatttctttttctcttctttctttcttttttttttagagacgggttcttgctctgtcacccaggctggagtgcagtggcatgatcatagctcactgcagcctcaacctgcaggctcaagcaatcctcctgccttggcctacggcgtagccaggactacaggtgcatgtcaccaaacccagctctctcagtctatttctcaacaaattgaccttgcaaaggttccccaaaatagcattcatcttaggctgacttaatcatgaaatggaagtcttctattcattcaatttcttctttctgaaaaatataaagatagcccttcaaacctcctccttagggctcttaggcatgtgaagcactgcaggaaggaaaatgacatctgcttctactgtgtgtgagaaaaatagatgacagatagatgacagatgtacaggtaaataggtagaaagatggacagaaatagttggtatggataagtttggttttgtaagtttctttgccatatttcttttgaaatacaagatttgtgtctttaaggagatcaaccaagcattttctttttttctttttttctttttttttttttttgagacggagtctcgctctctctccaggctatagtgcagtggcagaatctcggctcactgcaacctccatctcccaggttcaggtgattctcctgcctcagcctcccgagtagctgggactacaggcgcccgccatcatgcccggctaatttttgtatttttagtagagacaggctttcaccatgttggccaggatggtctcgatctcttgacctcgtgatccgcccgcctcggcctctcaaagtgctgggattacaggtgtgagccaccgtgcccagccccaaccaagcattttcaaaagcaggaaacatacaaataaatttgatttattttaaaaaactgaaaaatatatattatgaaacattttcattcactggtgctcaaattcctagtttataaaatgttgtattttcagctgaatggaccatctgcctcctccactttcctttcaagcatttatcgtagtatttttatatgactttttttgagtcacaatttagctgtaatgcaattcttgtagcccatttctgagaccatggtgtaccaaaaatatcagtagtaggcttaaatgttttaggataattcatattaaatcacaccattatgaaatacaagtcttccaactggatttttagtagcttgtcttgacgtattccacaaatatttgagtgtctacttgggctggcgatataccagtgaacaaataattcagcctttgtaaatttaccctggctagtgccaactggagggcattttccttgtcctctgctttatgactatgtccttgtacatctttgggcctcagttttttatctatgaaaaggaggaacaatgatcttctcctttaccctcttagggaggtgacagccaaagatcacagcacgatgaaaaggtcctgaggacatggggttaaagatgacaggtataacgagctattattaggaaaactttgattttcacaaatgcacaaggcagtatatatcttaatgctcatattaaagacaaacataatttgaatgtcagaaaaacatgtggaaaaccagtgaaatagagataggtgaaatattcattataaaactttcaatagtcctttaaaatataataataggccaggcacagtggctcatgcctgtaatcccagcactttgagaggccaaggcaggtggatcaccagaggtcaggagttcaacactagcctggccaacatggtgaaaccccatctctaccaaaagtacaaaaaaattagctgggcatggtggcggacgcctataatcccagctgctcgggaggctgaggcaggagaattgcttgaatctgggaggcggaggttgcagtgagccgagattgtgccactgcactccagcctgggtgacagagtgagactctgtctcaaaaaaataaaaaataaaataaaataaataaaatatagtaatgatttcttcttctttgtggactggctagtcttcaaaccagctctgatgtttagtttagtgactacttgatcaatatcagtcttctgatgattagttatcacaagaaggtacattcacaagtcttttatttatttatttattttgagacagaatttcgctctgttgcccaggctggagtgcagtggtatgatcttggctaactgcaacctctaccacctgggttcaagtgattctcctgtctctcagcctcctgagtattggaactacaggtgtgcaccaccatgctcagttaatttattgtttttagtagagatggttaaattttgtatttctaggttttagcatgttggccaggctggtcttgaactcctggcctcaggtgatccgcctgcctcggcctcccaaagtgctgggattacaggcataagccactgcgcccagcccattcacaagtcttaatacagaatttacagcttacaacattcgatttctgttactaatcctttaaattatttctaaatcttgaaatgagttgaggattaaaacacatacactcgtatgtgtgtacacacacacacacattcacatatgcaaacactctgaaatcccaaatgctaaaactcagccaggttagcagatattctgaatgtattttagttcttggtacgactaaaattgttggttgctgaactacatggaataattccaggacaagaaccataaatgtgatgctaacagtaatggaccagttacagaaagatatgcttcatgttctgttcagttaaattgcactgagactaatcctcttatctcaaggcattataaatatggatagtaatgggtctttccatgaatgtgtactttaaaaaagtctctttgccataaacaggcagctagaactctacaaaagtatgaaaatatctttctaagttttaggagaacccttctcagaaacagtcacattttgattattcagaagctcattattgacttttggggattcatttttccaatttttcttccattctttctttggtgctgcctacatggtaattttagctctaggaaaaagaaagaaggaaagtcaattacattcagggcactttggttgaatggttgggatgggagcctatactggcagacttggctagaatgaggtttcaggattaactgaattccctcaatgtagtatatgctcagtgtccctctctcctggaggcaatcaaaatttgatgacttatttctttggagctctaagaaaaagtgtttgaatctaagagcagagaagtatgtcaacctatcattgcagctgactttacagtgattctcctatgtctccaaaagacacttagagcaaggatggcagcagaggttataacagatatgctgagactcctgtgctttaaaatctgatcatgcaatgctgaaattgtattctgataggttaagcatattaaatttcaaggttataagtaaagtatcaactctggaaaattgaatttagaaacagtagctccaccttagggagagaaaacagagtaagactgaaagctgaaaatgtctaattttatgattgttactcagaattgatttttaatttggcttgatcttttcacaagtctattttgcaaaatttgatcaatttagttaccagtgtaaactacatttattttgctcacttgacaagtatttactaagggcctatagtgcatgccaggttctgtgccagtgtttggggagataaagatgaacctgggtcttaagaggtagtgcagttgcgaggagtgactgatgcataaaggaagaattcaacataataggaagaattagaagaagtatttaaagggtgttttggaggttgaaagaatttaactccctgtaggaaatggtggtggtagacaaggaaaaaaaaaaaaaagaatttcttaaggggcagagactagagctgaattcaaaaggatgagtggaaatttgccaaaggaaagtaaagggagataggaaggcattcagcagaaagacaagtatatcaaaaaggcatggaggcttgagaaagactaggatgcatcatcagggaaggaggagttatttcagtatgaccgcagggtgagtgtgcaaagagcctagagtgataagccagggcttgcatgtcctgtcaaggggcttactatacaatagcagtggtaacaatagcaaaaatataaatagcaaaatggagtctgtcagacactcttttatatagtttgcatatatattaactcatccattgaggtagaaacttcttatttccactttaaagttgatgaaacaaaggcttaaaaatgtaagtacgatgcccagtatagagctaaggccagactccccaccaccccattatgcacctcctccgtagctggcagggggctggctaagatgttaagcaggggagatggctaagtcttgttgatttcacattctaaaatgtttccattttgccatctatttgttgattctttatttttttatttttatttttatttttttgagatggagtctcactctgtcacccaggctggagtgcagtggcaccatctcagctcactgcaacctctgcttccccagttcaagcaattctcgtgcctcaatctcccaagtagctgggactacaggtgcatgccaccaggcctggctaatttttgtatttttagtagagacggggttttaccatgttggccaggctggtctcgtactcctggcctcaagtgatccacttgctttagccttccaaagttcttggattacaggcatgagccactgcacccagcctatttgttgattctttaatcattcactccttcatttacccattcaataacgttttatctaacatctaggtcctagggattcccacataaaggaaacctggtcctagcctcactgtgctagtttatatttaatgaaattaaaatgtgaattttcaaggccttcctatgctctttccccaggctgcatactgattcttaaaacagaagaacatatggcatgaggatgaagagtggacaagaggtcaaagtagctgaaatatataaaatgctaaaagtgtaacaaaactgatttcaaccaagcacttgatctcaaccaaacaaaaatgtatgcacaaaagaaatatgtcaaaataatacaatttatgctctaatattgagattatggatctttttgatttgttgtacttgtatgcattttctaaattttctacaattaataagcattacctttaacaacaggaaaaaaaacgtcgttgtctttagtagcaagcctttgctgttctagataaggcaattagaaattttcaacattcactgagctttatccagtgggaaaaatgcccaagtgtttttgtaatggatgaaaagtgatcagcaaaatgtttttattctctctctctctctctttttttttttttttgagacaagttctcactctgttatccaggctggaatacagtggcacaatcatggctcactgcagccttgacctcatgggttccagtgatcctcctgccttgccattccaagtagctaggaccacaggcatgtacccagctagtttttttaattttttgtagagatagggtctctacattgcccggggtggtctcgaactcctaggctcaagtgatccacctgtctcagcctccccaaatgccaggattacaggtgtcatctaccatgcccagccatttttattatcttgatgcagttttgaagaggtaaattttaatgaatatactgattttttctttatttttctgatttaaaactaattcaagcttcctgttaaaaaattggaaaagtataacttagaaagcaaaagcttttccaatctcactctcagaaataataaatatttatactatgctatatttttatatttcttcctatgagtacatttcatatacataagcacataataaagttagaaacaataatactatattgactgttctgtgccttcttttaacatttaacaacattagactgttttcatgttagctaaggaaggctagcctattcttgtcaatggctgtacaatatcctatcatatgaatgatttgtaatttatataatgaattcctattcaagtatatttgggcagtttccagtttcctactattggaaataatgatgtaaaatatgtttttatagatatcttttcctatttcaataaaatcttccaaagaatagatccctacagttggtagagtcctggatgacaagatgtactctctttttttgagacagacagggtcttactctgtcgcccaggctggagtgcagtggcacagtcatggttcgctgcagcctgaaattcctgggctcaagtgatccgcccacctcagcctcctgagtagctgggactacaggcgtgcaccatcatgcctggctaattttttttatggtttgtaggaacagggtttcaccatgttgcccaggctggtctcaatctcctgggctcaagcaatccacctgtcctcagcctcccaaagtaccatgcccgacctttaggtgtacccttcattttaatggaaatggccaaattgccttcctaaactgcattggctttcaagagaactttgatacctccaggttcacgctcagaaatgtaaatggcattaagattccagggatcgggctggacacagtggctcatgcctgtaattccaacaatttggggggctgaggtgggcagatcacctgaggtcaggagttctagaccagcctggccaatatggtgaaaccccatctctactaaaaatacaaaaattagccgggcatggcggcacgtgcctgtagtcccagctacctgggaggctgaggcaggagaatcgcatgaacctgagaggcagaggttgcagtgagccgagattgtgccactgcactccagcctgggcgacagaacaaaaagattccaagggtattgatacgttaagagcatgttttcagatgataggctgagactgtcacgaagttggctaatgaaagggcacacctaataaggtcttggttaagaaatggggtaagagggaagataaaaataaacatgattgcatagtcttgcaataaccctattttttaataggattactaatgtttggctcacttgtctttccacatttatttaaagtacaaagacatgagtacttactagaacagaaaagggagccccatgaagcctactaaagccttacagagccattttcttctccattttgttatgtttgttatgttatctactcctgataagctggagcaggggaggtcctaactgatttggtactcaggtcagtatctcttgactaattccaaagatgttttatttaaagaatcaaaataaacctaggttttatcgtggggccagatctaatatagagcaacacccaggaggcttatggtcatcttttttggctttattatttaatgatatggtatatgtcttgaacagcattttcttgctttctttctgctttttttttttttttttttttttttttgagatggagtgttgttgtcgccaggctggagtgcagttgcgcaatctcagctcactgcaacctccgcctcccaagttcccaaggcaattctcctgcctcagcctccccgtcccgagtagctgggactacaggcacgcaccaccacgcccagctaatttttgtatttttagtagagaccgggtttcaccatattggccaggatggtatcaatctcctaaccttgtgatccacctgccttggcctcccaaagtgatgggattacaggcgtgagccacagcgcccgtccattgaacagcattttctttttctttctttctttttttttttcttgagacagagtctcgctctgtctcccaggctggagtacagtggcccgatctcggctcactacaacctctgcctcccgggttcaagagattctcctgcctcagcctcccaagtagctgggactacaggtgtctgccaccttgcctggctaatttttgtatttttagtagagatggagtttcaccatattggccaggctggtctcgaactcctgtccttgtgatccgcctgccttggcctcccaaagtgctgggattacaggcttgagccactgtgcctggcctgaacagcattttcaaaagtgtggtaggcagtccattaataagtattgctttaaaaaagaatttcacatacagataagtttggaaagtattaggttaaaccaaatcaaataagttaatttattgcaggacttcttgaagcctttattatttgtttttctttttagaggcaggtctcgctctgtcatccaggtgggagtgcggtggcatgatgattgctcactgcagcctcaaactcctgggctcaagtgatcctcccacctctgcctcctgagcagctaggactacaggcacacactaacttattggctattttaaaaattttctgtaggcacagggtcttgctatgttgcccatgctgatcttgaacacctgccctcaagtgatcctcttactgggcctcccaaagtgttgcgattacaggtgtgagtcaccccagtggccccaaattgctttttttttttttgccctgccgctcaggcaggagtgcagcagcgcaatctcggcttactgcaacctccacctcctgggttcaagcgatcctcccacctcagcctctgaagtagctgggactacaggcatgcgccactgcacctggctaatttttttttattttttgtagagacggggtttcaccacgttgtccaggctggtctggaactcctgggatcaagcgatctgcgcatctcagcctcccaaagtgctgggattagaagcatgagccaccatgccctgctccaaattgctttttatagtactttaggaaacagtaataagtaacatcaagggatttaaggcatgctcagtctctccaaggtccctgacatcttttagaaatattatgtcttacaaagtatcatcagacacattacctttaaattaaacacaacacataccatcacataaaggataagggtaataaataaacaaataaataaacacaacacatactacacacatacaaatgaaaaaatccttaagacttaggacttttaggccacaggaaggtatatttgctaagtattttacgataatgcagcactcatcacagaccctgacccttaataggaatgcaatgatgttttaattgaatgaatgaagacagacaaatacggtttctggggccagactacatagatctgatcactccagtactaataaactattcaagcttggccaaattgtttaacctatttatgccgccagttccttatttgttgaagtagtaataaataactgtgtaagttgctgtgggtgttaaatgagctaataacacacacaaaaatcagtgctttctatgtgttgagttctttattgtttcttttagagacagggtcttgctctgttgtccaggctggggtgcagtgacatgatcatggcttactgtaacctcaaactcctgtgctcaagtgatcttcttgccccagcctcctgagtagctagaaccacaggcacatgccaccatgcccagctaagggtgagctcttaagagttgagttgctatcctcctcctccttctcctcctcctcctcctcctcccctcctccttctcctcttcccctcctcctcccctcctccttctcctcttcccctcctcctcccctcctccttctcctcctcccctcctcctctcctcctcctcctcctcctcctcctcttccttcccacttctgcagaaaagggagctgaggctgtctgtggtctctaccacagagcacctcataagccctacttgcttttccacattttctgtcttttcattattaccatatttatatacacatcaaaagagaaaagatggccaatactattttaatttgccaagcctgtcttcagattgctgatttaaaaaaaagggggtgtggtggtccatgttggctgattactaaaatcacagatatggtcaagggcacctccaagaataataacctggggcaagcctacagtcctgcttcatgcatttaggctttttctagcaggagcaggttgcccaaggtagaccacagccatgttgaatgcttcccgggttccccagtatcagtttcggcatttccacatcaccacacctggcacaggtggttgttttgtgaaggcaaggtgggcccctctgcattctcactgaggaagccaaacaggttcaggggccctcgcttgaacaacaatccagacagcagcatgcactctcctctgaaatgcttgacccacagttcctacctaggggcagttcctacctagttttcttacaggttctcttccagcatgagtgctagtgcactcctgaaatatccctctagaagtgttgctttgtcccgagtccagcccataaaagtcatctggcccctaatgtacagaagcaccttattaactaccatgggctaagagcatcaccatgtacaacaacgttcagaattaaaggaaagagggagtttaaactcaggatgtcatggatatgcctcccccatgaatagacacgtgatgccagagtccatgacgttaaccaccacacttgctgcctgtcattgagcatgtccatgacattaaccactgcaacctctgcctcctgggctcaagcgatcctcccacctcagcctcccaagtagctggaccataggtacatgtcaccaagcctggctaatttttgtattttttgtagagatggagttcactatgttgcccagactggttttgaactcctgagttcaagcaatctgcccaccctggcctcccgaagtgctgggattacaggcatgagacatcacacctggctgaaattttcttcttcttctttttttttgtgagacagagtttcactcttgttgcccatgctggagtgcgatggtgcgatctcagctcaccacaacctctgcctcctgagttcaagcgattctcctgcctcagcctcccaagtagctgggattacagccatgcaccactatgcccggctaatgttttttgtatttttagtagagacggggtttctccatgttggtcaggctggtctcgaacttctgacctcaggggacccgcccacctcagcctcccaaaagtgccgggattacaggtgtgagccactgtgcccggcctgaaattttcctcttaacatataattctcactcattttttgatgaaggttgtaattagtgttgactatagtattgttaagtgttattcagtaatacctggaaaatgaaattaactttgtagatgtttaatttcttagtaaatgtaggtgttttcatgtgtttccccctagtcaaattatacatttttgcttcttgcttgacttcttgggaaacaagtgttatcagcaatactcattcatttgttgtgttagtcaaccacaatttactgaatgcccaatgtgtgccacatttcatacataaaattttgcttgttgggtgcggcagctcacgcctgtaatcccagcactttgggaggctgaggcgggtggatcaccaggtcaggagttcgagaccagcctgaccaacatggtgaaatcccgtctctactaaaaatacaaaaattaactgggtgtggtgatgcgtgcctgtaatcccagctactcaggaggctaaagcaggagaatcgcttgaacccagaaggcggaggttgtagtgagctgagatcgcaccactgcactccagcctgggtgacagagtaagactccgtctcaaaaaaaaaaaaaaaatatatatatatatttttgcttacagtatttttcacaaaagtgaaaaatctttattcctttttcagaccatgctggatacccaaactcagaaacgaggcacaattgtttctttcaacacattgaagtgtcaccaatggcttattctctatgccgtatgggcaatgatatttacagaacccattgagagccacccagtttttcaaatgacatactcatgaggctgaattttataaatccgtatttatgtagctgtgcagagcttcagcaactgtatcaaatcttatcataagtcatatttcttactaaacaagtatgtaagaagacattgtggttttatcagtatttgcaaataagagctctcttttcttgcctgtgtatttctgttctcagtggaaggaaggaagtagctgtaggcgaaagctgtctggcagagaagaaatgtgtgtagggtgtgatcagaggtgtcaaacatctcactggagagaagaatgccctctgtgcagtgtggagggggggcccgttcactttcagatctagctgtgagtcctgagttaacagcagctaccaaccatcagtgactcacttttgccaatcaataaatccacctacgagtgttctacagctgaaactatgttctcataaaacttatttgtctctgtggccatggttcagctgatattccttatgtggaatgttctcaaacaatcatacatcttaagaaattgcttgaaagctgctttatccaaacagctacctgatcctggaacatctcttagaatttgttaccagccatctacattttatatacgtatatttggagatggagtctcattctgttgccaggttggagtgcagtagtgtgatcttggctcactgcaacctctgccttccaggttcaagcgattctcctgcctcagcctccggagtaggtggaattacaggcgcccaccaccacacccagctaattgttgtatttttgtagaaacagggtttcaccatgttggccaggctggtcacgaactcctgacctcaagtgatccacccgccttggcttcccaaagtgttgggattacaggtgtgagctaccacacccagccatctgcataataattagatagaaaatatcccactctaaattcctacaaataaaatttaaaaaattatctcaataacagtcatagtgccttacaatattatgttctgtaaaagttctaaattatttgacaagtcatgaaacactcccatttagaaaggagctcccaggccaggcgctgtggctcacacctgtaatcccagcactttgggaggccgaggtgggtgaatcacttgaggtcaggagtttgagaacagtctggccaacatggtgaaaccccatctctactaaaaatacaaaacattagctggacgtggtgtcaggcgcctgtaatctcagctactcgggaagctgaggcagagaatcgcttgagcccaggaggcaggggttgcagtgagctgagattgcaccattgcactccagcctgggcaacaagagtgaaactccatctcaaaacaacaacaacaacaaacaaaaaacaaaaaagcaacaacaacaaaaaaaaaaaaaaaagaaagaaaggtgctcctagcaactgacattcatgaaatgcagtagcatttaaaggaattctgcttttccttgctttctcaagacaaacagaatttagcatgcagaggtacaagagaaacgtcatgagttgaaaatcttcattctaaccacctttgcattagcaacagagaaaacacttgatcaatgccaactaggcagtgaaaaatattacaaggagcgattgtatgtctccacataggagaggatagccaactgtggtttatgaaacgtgttcctgactcagtaaatgctgtgtttgaaaagctgtgtttgttatataggtgtctactcatcagtcaacccttagagttcttaggaaaacctgaatctcagaaaagagggctgtagtaaagcctttgatgctgggaacattttactttcccgatagactcagccaaaaactctgcttcgaatatttacacttccagccaagatggagtaacagggactgaatttatcctcttaactgaaaaaacaaaacaaaacaaaacaaaaaaaacaaaaaacagacaaaatatataaaacaacagttttcataacactgaatatccagcaacgaagatagtgaaccttgaacaaggcgagccctatgactgcccccagtactgtcaagagagggctccaggctgtggagggagaaacacagcagaacacagtgaactccctgagctaaggagatgcagcaactccttagtctgggagatcaaaatgaatagaatttgcagaacagtctgccagagaaaagagagctgcgaagagagagaacccctgaaaatctatagagggtctcctctgaggattcggtagagcactcatcattccatgcatgaaaagaaactacccaaagttggagaccatctgaaaggataagagggaagagtgcctcatccttacagggctggaggtggtgcctattcccaccagccagaataaaaaactcataattcatggggcattgaatagagtactcaggaagatcagtatgcagaacaattagctatagaatgtgcactgctctgggctagactaacaaatcataaaagcaagacctgaaaaaaaccaaaccatattcaatcaactaaactgcatcccaaaaccaaacatcaagaatatttataggaacacaaaaaatatatagcattcaaaaagatacaattaataatgcctaccatcctaccaaatattgccaggcatgcaaataggcagagaaacatgacccataacaaagacaaaaatcaatcaaaaatacccggaactgacacagacattaggataaacagacaaaggcattaaaacaattattataactatatttaatatgcttaaaaagttaaatagtcacatgcaagatgtaaaaaggatccaaatcaaacctctaaagatagaaactctaaggccgagcatggtggctcatgcctgtaaatcccagcactttgggaggctgaggtgggaggatcacctgaggtcaggaggttgagaccagtctggccaacatggtgaaacaccatctctactaaaaatacaaaaaattagccaggtgtgttggcacatgcctgtaatcccagctactcgggaggctgaggcaggagaatcacttcaatccaggaggtggaggttgtggtgagccaagactgtgccaccgcactccagcctgggcaacaagagtgagactctgtctcaaaaaataaaacaaaacaaaaaaacaaaaacaaaaactctaatatacaaaatgggattaatggcagattagattgcaaaaaacagatgagggaaactgaagacaaagcaagagaaactatacaagatatcatattcccccaaatccccacaaatgcaaagcattactatgtgacaagttcaagtggccaagcgtatgtgtaattgggctttgcaaatgaggcatacatgaggccaaaaaaaaaaaaaaaaaacctgaagaaataacggctaaaatgtttccgaatttgatgacaactataagccaagatgctcaataaatgccaatgacacacacacatacacaaacacatgaagaaagctataccaaggcacctcataataaaaatcctcaaagcaggccaggcacagtggctcatgcctataatcccagcactttgggaggctcgaggcaggtggatcacctgaggtcaggagtttgagaccagcctggccaatatggcgaaaccccattgctacaaaaaatacaaaaattagccgggtgcggtggtgcacacctatagtcccagctactcgggaggctgaggcaggcgaattgcttgaacctggcaggcagaagttgcggtgatctgagatggcaccactgcacttcaccctgggcaacaaagcgagactccatctcaaaaagaaaaaaaaaataattgctcaaagcagaaaaaagaaaaaagagaaaaatttaaaagcagctaaagaaaaagatattccatacagaaacacaaagataaagatgacagcagacttctcatcagaaacaatgcaagcaagaagatagtgaatcagtatttctaaagtacggagagagaaaaactgccaacaagaatcctatatcatgtgaattatcttctaaaaccaaaggcaaataaagatgtcttcaggtacaagctgaaggaattcaccactagtatgcccacactataagaaatgctaaaggaagtcctccaggcagaaagaatcataacagacagaaatattaacctacacaagtgaatgaagagcaacagaaatgctaactccatgggtaaatatgtaagacttttggtactgtttaaatctctttaaagttaattgaatatttacacaaaaataataatgtcatgtgcatctgtaacttatctaaaagtaaattgtatgacatcaatcgcataaaggctgagaggagagaaatggaagtatactactgtaagattcttatgctacatgtgaagtggtataatatcatcttgaaggtagacttgataagttaaaaatgtgtatactataaaccctaaagtaaccatggaaacaacaaagagttatagctaataatccaacaaaagaggtaaaatgaacacataacatgctcaataaccctaaaagaaggcctggaaacaggtatacagtctggatagggaattctgagattcccaggcattgagatcagaacgtacaagggaggagccaggctccactgggcatctcttggcccatggcttcccttcccttcctcaggaagttgcttgagaagaccacagtgaaggcttttaaagctatgctagtctgcaaagagaaaaaacaaaaaactgagagtgtttaaaaactttttttgttttattcttgtttttgagacaaagtctaactctgtcgcccaggctggagtgcagtggcacaatctaggctcactgcaacctctgcctccagggtccaagtgattctcctgcctcagcctcccgagtagctgggattacaggggcacaccaccacgcctagctaatttttgtatttttagtagagatggggtttcactgtgttggccaggctggtctcgaactactgacctcgtgatccacctgtcttggcctccaaaagtgctgggattacaagcatgagctgccatgctcggccgtaaaaacgtttatagcaatttgacatggctgtaacatcccagcatgggattatttttctagcaatgcatgtttattgaattttataaaagtgatctgtccttgattcattagatagaaataaaaaacaataaaagaaaaaccctgtcccttaccacagataactgagatactgcttgaaaatatgtggctgtgagcagctttccttgcctagatttaaggtggcacatgtgtgcagggatcagaaggcagaaattgaaccgaaataataaggctggttttgaattactgtaagtgtagggcataccttatttaaaaagatttctggcctagacgttttgattatgatctgattgatccatctttctgtctttctgggtcactctgtgtcgattatttgctggatttaaagtagtagtgattgtgcatatgcaggattcccgtgcagatggttgtctttcccactcagaatttgagaaaagataccatttgtgtatgtgtgtagttggggggtaggacatattcatggaaaagattgtggcctttttttttttcttagtttgaatgcaagaagagaggcaaaaccatttcttcctgtcatcccagtcgctctggaggcatccagtgaacatgacaaacggggcacctaccttgtgcacacaggcctttgcattcaggaaaaacagctccacggtggttttatcctttaaaaacgatatgctctcaatgtaaaacctgaaaaacagcagaggagtttgttccttcagatttattttcacctctcagcattcctcattcagtgttccccaaaagcagggcaagaattttgagaaacctgaggaaggttgtgctttcttttccgttttaaaagaaatatgcaccgcacgtatttatgtgatggatgtatgtgtatgtatacctaaaatctctttcaggatgtttttgtgtcttggaaggtgagttaaagagaaaccccaaatggtattcaaccaaaaacaaacaaaaacaaacgtttatctgtgttgcttattctttgaaacatgttctgggagttcataatacctcagacagcttcaaaacaaagcgcagatgaactaggagttgaaagctgaagtcggctgagcaagcactacctaaccgaaccccaaagcctgcttgaggctcgggggtttttagacggaggggcctgagggccccatgcctacctgacccccattcactgggtgagtttccatcacacttttcaatcactcctttcttccttcccatccttccaggccctgggttttcctttggctcaaagccaggctctcagcagccatcaatcttggtcttttctcatgcaaatcagggtattctgggcctcactgccccactccctttctaggattttgcttgttcaatctgtgaaaccacaggttgcaggcaggcccctctcaggagcgctctgacagctcccgggtggggaggaggctgagtctttaacaactctgttttcataatcctgtactgatgaggccggcttgcaaaggctggcactctgtggtgtgcgagtgggcaagctggggccccgaagttttcctcaagttctggagcattgcttgattaataatcatgaagagccatcaagccccaagacagctcactgctttgagtccgaaagggaatttactctcagatcagtgagagtgaaggtaaaccagggctaggaagtggccaggtgaacctatccttagctctgcggaatcctgagtgcttgagcctttgcttctctttttctccctttccacagtgatgatacctttgataaataaatgcagctgaaagggctgtgaaagattttatcactgagatggtaaaatcattcgaaacattccaccctttaatgttgagtcatcaacggaagttccagaaagagaacaaatcctttgtatttttacttacaagcttttatctcacttgtaagtgaggttaatgaagatggaggagtgtcagatttatgagaagagaaagttaagtacaaaggtggtgaaggaaatgaggagttgggggaaaaataggttttggaatccaaaagatcaagatgtagtgtttcatgtccaccatttattcgctgtatggccttgggcaaattatttagtttctttgtgtcttttttaaattgaatgtcgtgactgtacttatctctgaggaaagaacagaacttttatctgaggaattccagttctttcaatttatcaggtctagagaggcattaaaatagacaacaatcaagtcttacttccctccttgagctatgtatttttctccggaaactgcttgctactgccaaaactagctgcactgggcacattagtgtccactgccccggacactgtaacccacaacctgtagctcaacaatggatagccaggccagacgcagtggctcacgcctgtaatcccagcactttgggaggccgaggcgggcagatcacttgaagtcaggagttccagaccatcctggccaccatggtgaaactgtctcttactaaaaatacaaaaattagctgggcgtggtggcgggcgggcacctgtaatctcagctactccggaggctgggggaggagaatcacttgagcctggaaggtggaggctgcagtgagccaagattatgccactacaactgcagcctgggcaacagagggagactctgtctcaaaaataaaacaaaacaaaaaaaacccaaaaaacaacgtatagccaatcactgatcaatgttatttctgtaaaccaaggagaattaattcctgacgaacaacttttgtaactgtcccctttcttgatttgtcctttttttctttaaacacttggacctctccttacttctccagagcacttcctaaggcaacttggaagtgtgtcctaggctgcagtcctcaaccttgtcccaaataagctttttatattaattttgtctcagcttttccttttgggtagacagtattctcctctcccatcagtctagtgtcttctaccctgagccctgctgcgtggactaggcgagtcacctgactcaaaggcagccaagatgtcaggcggtgaggtggcctggaaaggagcaagtgccactcaacagatgctttttatactgcatgatgaatgagtcaaccaattgcacatggtctcttagagacttgaggggcgggtgaggagggattcagtggaggcagagaaaggcactaagcagaaattacgaggcagcagaagccatgaagtagagagggacaagagtccacagcaggagttgatggactgaagcagggtagccgagtcacttgtgatggcagacaccaaagtgaggcagaccagaggttggctgctgctacagggctgagatgacccatgttatacaagtttctgtgcatttccaagaaccttccagttcagctacttggtggtggctgtttcctgctttcttggctttcccatgcatttgtatccctatcaatgaagataatatgagcaggcttccagtgggcagcctaattaagggcggcagcaggatcccagctaacatttccctgagctcttactgaggtgcctgcaatgtgctaagtgcttcccgattgttctctcatttaattatcacaactgccttggggagggacctatgatgaccctgatttcacagacgcagactctgagttttagagatctgcctacctggtggggctaggtcttggtctgggacaatgactttgactctgtggacagtgctcttaaccaacatctcctcctgggctgccgctcccagttcactcaactagcactcagcaggaagctgaacccttagtaattgtgggcgtctcaaccatgtaaaaaatagcagaaaaataagacaagtgtgacgttttcaccaaaatgttaacatatatagaagtacgtgtgttctctattgcttcaataagcaaaaccatggcaaaagacttacgttgaaggattttgattaacctatgaaacacctttttaaaagttagagtagtctcagaaggggaagccctttccagaggaagagatctccctgccctaaaaaaatcctaggtcagattagtagaactcaacatctgccttctacttgaaatttctaagattatttttttccttcacttttaattacttcaatagacttctctaacagggactgtattaaaaacacggggtcaatgaattttcacacacaacaaagctcataagaatttcttaatattatttaaaatttagtcttcacttgtattttcccattgcctccaaaacttataaaaaaaagagttctgtgattgtgacatttaataagtaaagctgcactggcctatggcaacagtcacatatgcaaaagtcgtaaggatcactggctggatataaatgagtgatgctgaccagatgggtgagacctgcttgggggacactgggacacattttttctgctctactaaaactccttcatcatggtgtgggtaggtgacccaagctaggccagtcagcttctcaccctggagaataaacttgattagaatgacctaaagatcaaagatggttggagcctatttattctgctaacagcactctgatgaaattgtcccttggtttctgctccctagatccctgcagaagccctcatccctgtgttttctgagtctttgtcaattcagttttccttccgttttgtttgttagccacaggtagttctgttgctggcaactaaagaacccaagttaatagagggcttcttccatgctagggataatacaaagtgctctacaggaatctctttttttttttttttttttttttccatctttggtaccaccagatgcagtaggcaacaaattatgagcccattttacagatgagaaagcttagatacagagatgtcaagtcttcttctttaggccatacagctagcaagtagtggagccatgactcaaactgaggtctgttagacttctaagttcatattccaagtcaatatgatataatgctttcctacaataacaatcaaaatgaaatataacatgtacagaatgctgtgggggcccaccagcctgaggcaattaactcagcttatgaattaaggggagaatgctgccaaactgaaatccatagaactaagcaccacaggagaggggacagttgagctgagtcttaaagaatgcatgagttcaccaggtaacaaaggtaggaagggcactcaggcggatagcatattagccaaactaatcctcctgctagtctttgagccctgaagaaaccgcatacaggttgctgggtagcttggcaccaaatcaatttgtagcgcatccaactttgaacagatacctttgtattagaaactgggttcaccttgtttttggagtccaggcccctgactacatcctagtcccagtaaacaggtccctatcttatttcccactactttctggcgaccagccctggtgcctcctgcctaggcatcagattaccagctttctgaatccacaattccatctctccctcaagggggccattgtaatggcttcatatttatggagtgtatgaaaaatacatatgggctttggggaaaatggctcttcaggcacacctatcaacacaaaccatgaactgaaaacaaaatctagggcttcttaatgacatgaaatggactatcccagattcataaagacctttttttcagcctttttttttttttttttgcaaaaggatactgtttcctttttgcatgcttactgtgagcgatttcactaaggttttcttaagttgaagcccatggttaatttttcagcttcggaaagaacccaggctttttgaataggcacacattttggagacaaacctcggcttcacaagtgtaatttcttgagaagagaatttgctcaggaaggttttgtcactgttatttgggctcctcccattagcatttctttttcctttcttggttggcttaaccactcattagtgatgacagaacattacaccactgtgacatgacaaagacggctggaagggacacagccctgccagccagatggcaacacatggatgtcaaagagcacaacacccagttgtttggaagtggctgtcctttgaagagtcgcttaaatttatgtggccaatattttcgtcttgtggtatttatttctagtggtcacaagtcaacactagggagtgggagagacattagtttgaatcctagctccagtgctgatcagtcttgaggtcttggggtagctgctccgctctcagtgcctcttacctctcttgcctcacacactggagaaatgagagggtttgaaatgtgcttaacatagcaggtggcatgtagtttagcagccaatgagtggcggtgactattagaatattattatctctctaccgatgtgactgtaataaaaggcactgacttagttgggaacatctttaaagctttaactgtaacaaccagaataaaaattccaagtatctggccaggcgcggctcatgccagtaatcccaacattttgggaggccaaggcaggcagatcacttgaggccaggagttcgagaccagcctggccatcatggtaaaaactcatttctactaaaaatacaaaaattagctgggtttggtggcacatgcctttagtcctagctactcaggaggctgaggcaggagaatcgcttgaacctgggaggaggaggttgcagtgagttgagatcctgccactgcactctagcctgggtgacagagctagattctgcctcaaaaaaaaaaaaaaaaaaaaaaaaaaaatccaagtatctttcctaagttctttctctcaaagaaacaaatgctacaaaaatgtctgttttaacataaaatgagaaaatagtgtgaaaccaatgcttttctaatcagtttcaacttttctccctcaactgagcatggtttctttgtttcccagggcctttgcgaggtcccagtggtatcttcaaagaaggtgaattgggcaagaactgctcaattattttgcattctgaacaatgctgagtttgtgactggcgtccagtgagggctaaatcaaaacacctcattctgggtttcttttagtcaccatgagtaattttaggcatttaactgcagccacacgcctaggtagatttctatcagatcctcatccacattctgagcggggagatctctgtttattgcttgtaatgaccctgcaaggtagtcatatctcactttataatgctgaaggctgaagtgtaatttaagtgtatttcactttctccaaacacatcactttctgcaagatattatgcagtgcttatgggagtccaatatgttccctttcatctgtgggaggggaacagtcttggagaattcccaggggaagcactgtttgcttctacaatgtgcttctctgccaggaatgctcttcctcatttctgaatttccagacatggctagaaccagagagggcctcctggtaagcctgtagaaacctgccctcttgctcctttcccacagcatgactctttctgagttatctagaagagctggaggcccaaaagagtcagggccttgctgtgacctgccaggaaggggagagagtcttctcccctaggcaacctgaagtgtcaggggcatgtgaattccaagtgcttgcctctcctctgctttaaaacagcctgctctagtcctccacaggaaagcagggacagatgctttgagagggagtggggaggggaggcagcggagaaaagtggggaagtaacatctgggcacggtgaataatgaagataaatgataagatctttcacccagtgcaaaggggaatgggtcagacccaagccagacaatcccaaatctttcatattcaaaggctgtgacagaaacttgatagaatgtttcgcccactgaacatgtggttgaggcagcctgttatttaggacatacaaaatagttaacatttatatagggtctacattagctgttagcacttgtaatcctccaacaacccccaaagtaggtgggggctaccaccagcttcatttcataggtgatgaaacaggcccaagagggtgccagaagctacatagtgagtaagtggaagagctggaatatgaacctaagaatgatgctaaagctctgttctcaatgtttgggtgggggtgtttaccaatgctgaagacattatttgactgtcagcacttggggagtgttattgtttattttgagacagggtcttgctctgctgcccgggctagagtgcagtggcctgatcaccgctcactgcagcctcaatgtcctgggctgaagcaatcctcctgcctcagcctcctgagtagctgtgactgcaggcacgcactaccatgcaaggctaattattgtattttttgtagagacagagtttcgccatgatgcccaggctggacttgaactggactcaagtgctccacctgccttggcctccccaagtgctgggattacaggtgtgagccacggtggctggcctgggagcatcattgacgtcagtaagtggagaccagggatgctgctaaagatcctacagcacagcttagctccctactacaaagaatggcctggtcctcagtgtcaatagtgctgctgcagtgaaaccttgcactgaaaactgagcttctaatttccgtgttctctagcttctttcccccttcacaatatggtttctttctttctttttttcttttggagacagggtcttgctctgttgcccaggctgcagtgcaatggcgtgatcttggctcactacaacctctgcctcccagattcaagtgattctcctgcctcagcctcccgcgtagctgggactacaggtgtgcaccaccacacctggctaatttttgtacttttagtagagatggggttttgtcatgttggccaggctgttctcgaactcctgaccttgtgatccacccatcttggcctcccaaagtgctgagattacaagcatgagtcactgctcgtgagtggcacccagccccacaatacgatttctttacttttgatgttgcctcttcattgtcctgagacacacacacacagacagacaaacgcacacatcctttaagcattcatggcccatctgttttttaaaactgtggaaacacaggcacacccaccaaaagacaggactgaaaggtttgcaaggggagtgagcagatttctaaaaataatttctgatacttgcccagggaatacaccgagaaatagaatcctgtaagaaactaatatcatgatcgagcatgtgcttctgaggattccgtgtctttcttgagctcttgtgtgaattaggatgttggatcctcaaagaggaaggccattaaacgcctgcctggaagttcagaataggctgggccagttaggggtcatgggtgatactgaggcaactggcctttgtattacccatggtctggggtattgtgcattcagatgcgagtgtgacagatgggcaaagacctctggctaacttgcacacctccctcaagtaacctcagctcagcctaagtaggagaatcagttgtttctcagggcctttaaatcacattcctccatgaaaagatgaatttccagtcctctcattattgtaaatcacctaccatctgatggctttaaacaaatgcatggttatctggtcacaaacattttatcctttcttcctcttatcgcttttcacaactgcattaaaaaaatttgctcaagtaatatgttcattgtaagaaaaaatacagatgaccaaaaaagaagaaaatgaaaatcatccctacaatcattctacctagagattaactgttgttaacattttaaacttagtttccatctgtacagacgtttttgtaaaatattttacaaagagtgttatcatattgcatggactttttgtggtctacttctttcacctagaatatattgggagcatctttctatatcaataagtctcaccctttactacagtctgtctttatgtgtcacgtgtatttggctctctttaaaaaaattctggtggaatgacgaggactcacgggttgtagtcatgatgcttcctcgagttaagctctttctaaagatctaatgttccaaagaccaggccaggagcgatgagaaggcagtcagcagtcttgacttcaagggctccatgtttgcagcaattttcacccagaggtagcagtctgcctccgggtttcctactacagtaggaaagtgagttcttctcagccctgagtgtggcagacaatgctttagggtaccactgagtggacacatgcagtcctaggacccagcaaaagtgacttggaaagaggaggaggaaaagaagggagaagagggaagaccaaatgaaatgaaaaacaacaacaacaaaaaataataaaggggatgaaagatgccaagattctggctttgactggaacagggtggtaccagcctgaggcacctcaggttgccctcctctgagggaatatgagcatttccagtgaggtcacgccaaggccctgcactcctatttaaatgcttgcttgctcctcactgtcaagcctttcaaatgttcacatctgggctgcattaccaagaggctcatatgtttgtggaatataatttatggcagccagataacaacccccagcctggggaagtcccccagaaacctgggggagtttggactcccatggaaatagagaactggttaaataaattatggtacctaaataaattatggtgcgtctatacacacagaggtcacacacatatttagcacacctctttgagattttataactggaaaaaagaagacaaaggtttaatcttgaagtcataaagggaacactacatgcctttgctttaaatattttcttttctctgtgcagaagcagcatatgtttctgagctgctccctctatcctgggggatataaaccagatatttattaacccttcaaatctgtaggacctcagggtttagctcaggagtaaatgagacaatacttttcaaatagcctagggcctgctgcagagtttatgctacatttcagtagagagaaaacttcttgagagcaagttctcgtggaatttttctttttcataaatgctacaataaataaaatattttcttacatttgcataatgttttgcaaaatcattttgtatcccctgctctctcctcaattctcataaccaacttgcaccatctccagtgaatgtgtagtgagtgagactcagtctggttcaccccactcatctctggcctgggccattgcaacagcttactaactggtcttgctgtgccctcctgccctgttccgatctgtcctcaacccagcagccagagtgagtctgtttaaaatggaaattggttatgctctcaagctcaaaacccacaggccccaatgctctacaggccaaccccatgccaactcctactcacctcccttttataggttctctccagatacatgacttccttccaggggctggtacacaccaggcatgctcttgccaacctttctgtgcacctgctgttcccctggcctggaagaaacttcctcagaaatgggcctgggtcctgggtccttgtctcatctcctgcatgcctttgctcaatgccaccttctttgagaggccttccctgaccactgtttttagaaatgcagccccggctttgctaatattcccttttcctcctccctaatggagttttctccataacccctcacataagatactttgcaggtttactttacttagtgtcagtctctttccattaggctgtgtgctttatggctgcaggattttgtcattttcttctaccactgctatattcccagcatctagtatagggccagacacatagcaggaaatcagcaactatttatcagatgaatggacaaactgttattatataatgaatgcatttgtttatgtgtatgctgactatgatggtagagatttttgccttcttcactatcgggtcctcagacctagaatggggcagaacacaacgtagcaaaactccaatacataatgaatgaaggaaggaagaaatgtttcttcatagcttggtgtagctccttccaggaattttctcagcatttacagatctatataggtttataaaacataccaacttcaaaaaacctcaatgtgatcacctgaactttccatggcataaacagtaatctctgttttacagaaggacactcattccctatctttttcagatataatgtatcttatctcctaagatgcatgagcgatgagatacatgacaacatccctggtaacagtgacttattaaagtaatgatttatgagaggaggggtggagagagggctcaacaatgcacccctccctccatggcattatatcagaatctgggccaggaacgtggagttggaggggaataattgtgtagtttgaaaaatgtcccaagatgattcagatatgccctgcctctccttctggagaagctctgaattgcaatgtactttttcatctaatctcttttgttaaagtgattcattgtttactataaaagtgccaccataacctactgaacctatcttcattgttggcattaggatatttctaattgtttgcaccgaaaataacagcggtacacatgctttaatgtgctatcactgaagggaattctttttcattgtgcattaactatttggtgactacacatctcggtgtccatgaatgaggggcttctgtgctccatgttccagtgcatgcagcagtactgtgctgacacaagaggtgaggtacccaatctcaaaagaggtcccctgcacttccagaggctcctaaaatgagcgaacatcaagacagaaccaaatgctatctttggctctctattcttcagtcaaacaggcaacctggagatttgttgatggtgtctactgggatagaaatcttaccaatagttctgttttctccaaataggaggctagagaccctctgaggagcaactcacttcactggagcacaagacaaccccatttgcaagacctccatagaaccagctacattccacagtgacctcggtcagttcacaaaattctttggcgtgtgcttttcctttatcatttccttaattaaattggagtaaaaacaactacttaattggaataataacaaagactattatgattctcactatactgttgggaggaagaactaagtgaataattaaaaacttgataagggtttaaacatgcaagtagttaggggaaagtaatgcgaagtgattaggggacactcttgagataacactccaagtaagtgctgaaactcatgaacaagcagcaggccactctggaatttcaggaacctgcttggagaagatagagtgccttatgaatgactgtacagaaagggagatagggtttactcctttggtattctgtgacccaaaacagaccagatattagctgtcaaataatctgcacaaatctggttactacctagatggtacttgttagatgttctgaagacataacgctttcattgagtagggaacactacataaacactacaccacatgcacaaaagatgaaagtgcaaggatgttaggtgcaacctattggttttttttgtttttgtttttgttttttggcgatggagtctcactctgttctccatgctggagtgcaatagtgtgatcttggctcactgcagcctccgcctccagggttcaagctattctgcctcagcctctggagtagctgggattacagatgcccaccaccaagcctggctaatttttgtatttttagtagagatggggtttccccatgttggccaggctggtctcatactcctgacctcaagtgatctgcctacctcggcctcccaaagtgctgggattacaggcgtgagccaccgcgcctggctagctgcaacccaaattttaataacaactagaaatagcctaaatgcttaaataaatagatttttacacacccaaggaaagatctccacccaggttgcaaagaaaaaaaatttaattcatcaaacaacttaccctatttttctaagaaggggagcaaagtttatcataaaatttttcatcaaacttaggaaagtggggagagggggtcagtacataaggagggctttcagctcaatcagtaatgatttcacctcaagctaggtagagaaatataggtattacttcttgttttttttgttttgttttgtttatgagatggagtctcactattgtccaggctggagtgcagtggtacgatcttggctcactgcaacctctgcctctgggttcaagcgatccttatgcctcagcctcatgagtagctggcattacaggcacacaccaccaagttcagctaattttttttgtgtatttttagtagagatgaggttttgccatgttggccaggctgttctcaaactcctaacctcaagtgatccacctgcctcagcctcccaaggtgctggaattacagtcatgagccactgtgcctggccggtattacatcttataacattttatttatcttagaatgtgaactaaaaaaaatagttctatcatgagatggatttgagaaattactgatttagctgaatgcatccatttcaggatacagttaagtgacttgcccaagcaaacctcagagaacaagtcaaggactctgcattattttcagcagtctgtctgcatgtgaatgcaactcagatccctgtactgttaattctttccatgagcatttgtttgcattttatcctctattcaaattaaggcatcaaattgtacagaattcaattatttttaagtctgtagaaaacattattgccacgtaaaatgtaatagcaaatgtttgtcacatttcaaagaatgagaatcttaagaatctgatgagtgagaaacagtcttatgtattaaaatatattacccatgtttttcagctttaaattgatttctaagaggctttgaggaataaaggaaggcaactctatccttcatcttcaaagaaaacagctctacggtatctatggtaacttggtcctcagaccaagacagtagagaatctccttcacatgataatgttttgataggtctcttctctttttatttgctatctctaatcaccagaaatgtaaaaaatagcaaagaaaacacacaaaaacccaaaaataacagcaaaaaaagagggatgctaactgggtctgtggatacatacctcacagcaaagtgcaaaatggttgggcctggtttcttgggcaaatcgtggtcaagaactcggtgatctaactgcagccagttctgctgacctctgtgagagcaaagcaaagaaaaaggattcaacagaaagtcagaaaagttcaacaacgtacagtgttggcaaagctgtggcgaaatagttgctctcatacaccgatggtaggagcacaacctgttacaactggtaatgagaccaactcagcaatttctttcaaaactatgaaagcacttgcttctgaaccagcatttccatttccaggagtacatcaaggtaaacttgcacatgtgagaaataatttgtatatgaaatcactcactgtagcaacatttgaaatagcaaaaggggtggaaataacttcgatgtccaagaggatattgtttaaaaaaattatttaaaactatagagtgggcaggcacagtggctcatgcctgtaatcccagcactttgggaggccgaggcgggcagatcacctgaggtcaggagtttgagaccagcctggctaacatggtaaaaccctgtctctactaaaataaaaaaaaattagccaggcatggtggcacgtgcctgtaatcccagctacctgggaggctgaggcaggagaatcgcttgaacccgggaggcggaggttgcagtgagccgagattgcaccattgcactccagcctgggcaacatcccctgttagagtgaaactctgtctaaaaaataaacaaacaaaaccccccaaaacaaacaaacaaaaaaaactatagagtgaaatacaatgcagccataaaataggctgaagaacacgggtgtggcggcagacacatgtagtcccagttattcgggaaactgacgcaggatgatcgctcgagcccaggtgtttgaggctgcagtgtgctatgatcacggctgtgaacagccactgtactccagcctgggcaacataaccagaccccatcttaaaaaaaaaaaaaagccagggagcctctttataaacttattttgaacaatttccaagagacgatattaaatgaaaaagcaagatgcataacagcaagtatatggcgattttaaaaattaaacaaagaacaaacatacatatgtgcatgtatatattacaaatatctgagagaaaaaacaaaaaactgataacactagttgacttttgaggtaaaaaactaggccatatgttaatattaaatttttatgaaatatgaaatattttagataatcaagaaggagaaaacttctggttcaatgaaataaaacacacaggctgggtgtggtggctcacatctagcacttgtaatcctagcacttgggaggccaaggcaggcagattgcttgagcccaggaatttgagactagcctgggcaacatggtgaaacccgatttctacaaagaatacagaaaaaaattagcctagtgtggtggtgcatgcctgttgtcccagctactatggaggctgaagtgggaggatcacttgggcccagggaagtcaaggctgcagtgagccgtgatcatgccactgcattccagcctaggcaacagaatgagaccctgtctcaaaacaaaagcaaaaacaaaaacaaaaaaccagacacataacaataccacagcttttaaaaaaagtacagggtcggtgctaggcacagtggctcatgcctctaatcccagcactttaggaggctgagttgggaggattggctaaagtgggaggattgcttgagcccaggagtttgaggctgcagtgagctatgattgtgctactgcaccctagtctggacaacagagggataacttgtctcaaaaaaaaaaaaaaaaaaggccgggcacagtggctcatgcctgtaatcccagcactttggcactttgggaggccgaggtgggcagatcccttgaggtcaggagtttaagatcagcctggccaacatggtgaaaccctgtctctactaaacatacaaaaattcactgggcatggtggcgggtgcctctaatcccagctacttgggaggctgaggcaggagaatcacttgaagccagaaggcggaggttgcagtgagccgaggtcatgccactacactccagcttgcacgacagagcaagattctatctcaaaaaaaaaaaaaaaaaaaaaacagtacagggctgaatactctctgagtgccacttctgtatatatattatgggcttactgagatttaagcacgtacttgtttattttatttactcaagagcctcaccaagttcataaacagttctctctagattttgaccactgagggatcaaaaggattgatgacactggggctcagaactgtttacgtgccttttccgagcttgtccaactagtccatccattttaggctgtaaattcccagagggcatagaccctcttttacttgcttacataaaattcaatctaagaacatgctgatggtggtgggatagcgtgtcaaaatgtaataaaatatataatgggccagaagacattttcaaacctattttggtccttgagtaaaaaattaaaaaacaaaatcagaaaattcaaagctgtattcattataagtagacaggaaaaatgagcataaataataatatgagtagtagtaataataacaatagctagtctctatcgagtaatgactctgtgccaaccaagctggaactctttatacattaaagctatattttacaataagccagtgaggaaagtgctagagctgggatttgaatccagggcttcctttcttcttccctccacccaccaccctacccagtggacttgtatataaaagtacccgggactttcagtactggagaaaatgagactagagggttgaatcagcttttataatgacttctgactcagtctctgatactcagcaggttaaatgccggaaagagtgtgtctttgtttccatagttacaagacaaggcttctgatacctgtttccagctttccttgcaagaatattataaagataaataagctgattaagtaacacaagggaaggtccttagaactactgcttttgtgtgtaaaacaaaataagataggagactgacgttaagagagtcttacactctatttcatcaagtttaggatgccactgatataaagacacatcccaatttcacagacgtttaaatgtgtgtcttaaaatacataacatatttgatagtatcagatctcaaaagttttcttaggaaagatgcatcattttaaaagcaaaataggctagacatggtggctcacacctgtaatctcagcatttcaggaggttgaggcaggaggatcactggagcccaggagttcaaggctacagtgagctatgatcatgccactgcactccagcctgggaaacagagagagaccctgtctctgaaaataaattgaaagcataatgtatatttgtatgaacttgcatggaatggtgtctatgaatgaatgaagcaagttgtacaatagcatatacagcataaaccaattatgttaaccacagatgcacattcaaaacactattaaatattgatgaacatttttagatatatttctggagagtcacacagcagcttgctagtactggttacctctgtggaagaaactacagttgcagtgggaaagtaatcaaaagggactggactcaaccatgacattaaagaagatattcatgcatatattataagaaatagttttttaaaaggataaattacaaattagattttaaaaaatccacccacaatctcatcaataggaaaaagtctagaagaattttttaaaaaatgcccataattctaccactgaaatataaaggttacttattgcttataacttgcttttgtcaaattttcccatcagcaaatataatagatctaaccaatatcttaaaaagacaatcatatctacccctctcaggagtgcagaccaaccacaaagcaagttttatttttggctagaattgcatcaacagaaggcccattgtcacagtcccattggaagggacagtgatcaaaagtcacagttgtgttgtaaagtctatctgttatttcttggtaaacaaagcttatttagcaaagcctttcaaaacatgagaaggcaaaacaaaaagtgaaatgggtgaagagatggaaccactacggtgacctgaaggactggtgcctcaggagggccgtgactgccctctaggggtgaaagactaactttgcacacagagctgcgcaaggccctaacaagcgtaatctcagaaatgctatccctctcccagtaacgtgaccttgaatctgtggttgttggtcatcatcactgcttttattgcgtaattgccatctatttttccgtttctcctcttggcctgtggatgagttgtagacagtagctactttcattgacaaaatgttcctttcagctttaccaaagacaaaagacgcatgtggcatctaggctggaaaataaactcagacggcatcctgggagggccctcactcagtggttttacgggggcgaagggaggcaggaggaaagtgctgaaagaaaatactttccaaaaatatttaccaaagaaaaagaactaggcttgtgaccaagacattccaaggagacacccttagacataagcaatattccaggcccgctccccagaaaggtagaaatggccaatttccaccccctcaacagccccgctcatacttcttctgaaaataaacacgactagagccaggagacacctccccaaactggtcataattcaaaaagagactctgccgtcacttgccggggagtgcacagaggacattgtggagccggggttcttggaaagaccatgactatagttacctcctttggttgaaccaaaggaggtaactgggaaaaaggctgtgtgaaccattcttctcccagcgtagttttgagaaagaaatctcagggcagacaacaagaagggtggcccaaataactgaaggaagtcattcccattattccttttcttttcctttttggacagtgtctcgctttgtcacccaggctggagtggcacaatctcggttcactgcaacctccacctcctgggtttaagtgatcctcatgcctcaggtgcctgagtagctgggattacaggcgcccaccaccacgcccagctaatttttgtatttttagtaagacggggttttgccgtgttgcccaggctggtcacaaactcctgacctcaggtgatccaccctcctcagcctccaaagtgttgagattacaggcgtgagccaccacacccggcctactatttcttttctttccgaagagaaggtcttacagtctgaaccccttacttacgcactgtctggtttatattcaactgagcttggagcttttcctgaagcctcccatgtggccaggaccctcttttccagtctgccacaaaccttgcagtctgagggacctctgacactgcaagtcaaagccgcattcctcctccctataacatccttccatggactgggtgtgcctcctccatctgtgtgactaacaaggctcacctatgatcttgtccccacgatcaggccaacgtcttcacccttgggcaaatgtaccttgttcgttgccatgttcatgcatttgcccacaaaataactcttgcctaggatgtcacctctcatctcccctcccatctatttaaagtctaccttacctgcaagatccaattttagttactcgtctgtgtgacgcctgctccagtcctccttcagtttccttcttaacactcccttactgcagtacattgggatgacagctcccttttattgtgggccggtgctatatgctctgcctaccttacctgatttaatagtattgaatactagtaccctattacaggtgccttatgtagtacatactatataaggcactgttattatgtccagcgtacagatgagaaaacttgagtgtcagagatgttaagtaactgttctaaggtcacacagctagctatcaagattctctgatacctgctcctacctccctctcaaccctcctcctgtaccactttccctcttaatctctgtactctcatcacactggctttttttttttttgtttgggacaggatctcactctgtcacttgggctggagtgcagtggtgagatcatggctcactgcaacctccactttctgggctcatgcaatcctcccacctaagcctcccgaggagctgggactacaggtgtgcaccatcatgcccccttaatgtttttgcatttttagtagagatggggtttcaccatgttgcccaggctggtctggaattcctaggctcaagtgatctgactgcctcagcctcccaaagtgctgggattagaggtgtgagccactgtgcccggccttgttttttttctcgcaaaaaacaaatcacaaaagtcatgcttagccccacctcaggacttttgcactggtttttgtttgtaatgtctccccaaatttttgcagaactggctcttgcttttcattacatgtcacctcctagatcctgtcctagcccaccctgtctaaaactgaacccaagttttcttggtcatggccttttatgttcttcaatgcacttataattgctgatattcctttgatttatctgtttgtttacttgttatgctagactatagcattgcaatatgagctccataaaagcaggggccttgtctgtgttactcctagctgaatcctcgtgatatagaacaacacctggcattgagtgggcattcaaaaaatattttattttctatttttagagatgggttcttgctctattgcctaggctggtgtgcagtggcatgatcataaactcactgtagccttgaactcctaggctcatgcaatcctcccacctcagcctcagcctcctgagtggctaggactggagttgcacatcaccacacctggctgatttttaattttttttttttttttcgtagagatggggtctcactatgttgcctaggctggtcttgaactcctggcctcatgcaatactccctcccttggtctccaaaagtgttaggatcacaggtgtgagccactcttaatgtaaatatatatatatacttgagacaaggtctcactctgtcgcccaggctggatggcagtagtgccatcatcatagctcacggcagcctcaacctcctgggctcaagttgtcctcccacctcagcctcccgagtagctgggactacagatgtgtcaccatacctggctgattttttttttttttttttttgtagatatggggtctccctatgttacctaggtggctctgaaactcctgtactcaagggatctgcccatctcggccctccaaagtgcggggattacaagtgtgaactatcacacccggccaatattttttcaatgaataaattactccaatattcatgttgttaacccctattctatgtgacctctgcctaaattatagtgcttatagcagttacagtttataccatataacctagccattgtatatttatggctttatgtcttatactgtttgctatgatttcatccacatttggattcagcctatgtgtgtgcgtgttcaatcactgattcgcaggagctggtgctggctatgcatgtcggcatttcccatttcatccagtagaggacaggtcatacagagcctctcaaatggtagctgttgagtgattcagagtgaggtgagagatgtctagtgtactttcttctgccttgttgagccctctttgggaaacatcctcagtccagaatcaagttttcaggtttttctattcctcctgataattcagctgcttggtttttgcccagtgcaagtcctgagcctgctggcatattctggaggtcctaggctcacagcccacccaggctgggaataatcagaagccacaaggtgttaaaagcaaattaactccttcttgagatgattttccacctgattaaactaaagaactgaaaaatatttaaattggcagcattatgaaaagaatgctggatggttggccaacatattttatgtctggaacacatcttcttgcattttaacatttaaggagctctttggaaattatctgcagaaagtggaaggattcctctgataatgtatcgggctgcataaaatgtaggcaaattgggctgccataaaaaagacagacagatacacacagacaaacacacacacacacacacacacacacacagagagagagagagagagagagagagagagaaaagagctagtaaatccaaacacatttgcttagagtgttaaattctcatgaatttatttttatttacctgccttgttttggggagcatatatattgttgacaaatatatacaacattcaacaacttagcataaaaggcaaaagtgaaaaaaaaaagaaaaagatagttgagaaggcaacataaaatggacctaagtggtagtttaaaagttcattccatattaaactatatacatgttttttagtgggccacaaatttgcctttaagctctcttgccaccaacaccaacacatccactcagtttcaagatgtgagtaaatatctaatatttctaccatataagctaaattagcaagcacaatcacattcaaagacatgagaagatacactgtaatcgggaataacaaactcattactacacatttctaaaacatttagaacaatattttgagttcctaaaatggtcagtatcccttttcttctccctttgccataatcctaggagaaaaatcgcatattaaaaaacctttagctaagcaggacatgttctgaatgctggaggacttatttccttttttgttaattatggaagacagcaagtaggtagcccaggcaaaaggtaaagaaactaaaactattaaaggacttacgtgtcatctatgaatgttattccaaaatactccttttctttcaggttgaaatgtgaagccactaggtccagcaactctcttgctagaagtttgggctgtcaaaataaaaatctggttagaagcaatttggttgcctctctcttactgctaccaccttcctctgccctaaataatttaaagtagcttttgtttatttgtttgtttctttattacttgcccttgtttgtggattaggttgatgtactatagacaattctttaagaattgtgggaaggagaagagatgggaataggaatatcaatgagactatcattttcatgtatttgcaattcactcaagtaccttacattttccctctaaggtgcacttactaagatgttttggaaaaaatactcttttatatgtaacgtggtgctaatgcccaagacaaggaatattaaacaccttgctgcttggttatctgtgatatataaaagattgcaggaaacattttgcttgttggtggccagttgaagaaacccaagactcaaagctgtggggctactgatgaaaatattaataataataataataatagttactatttattatgctgaacttatatcccattgtcatttaatccttataatgagctatgaggcagggctttttatttccattttataaatgagtcaaccaaggcccagagtagttaagcaccttgcttgatgttacattgttagtaagggcagggatttgaacctagtctgtctccttctaaagcctaagcttttccttcctgagatagagaaattgtacccattccacacatcatcatcaacagtaatgagcacctagttagaagaaggatgtaatctataagcttttgggaagctctggatctgctgagaagaagcatgggcttggaaccagccagaatgcctggagtgataattgatgctggatttggagggactggggaagaaaaggggaatccttgcaggagggcactctggatggattctttctgaactttgagcaaaacagcttagggtatattacgatggctgttggggataaaaatggacatgatttaaagaaaaaaagaaaagaaacaggcagacatctagactaaaggtctacttgggcaaagctactgttgactgtactatttcactctaattgaagcctaagcatagtgggctagggacaggcctcagaagagaaaagaatttaggtttggttagaggagaaaattctaggctagctgtaggtgtggcccgtccgcagggactttcacaatttttaaagattcttggtccagagtgttgggtgaatagaaagagaagcatcaacaataaaaatatcatcgcttggctgggcgcagaggctcacgcctgtaatcccagcattttgggaggctgaggagggtggatcacttgaggtcaggagttcgaggccagcctggccaacatggtgaaaccctgtctctactaaaaatacaaaaattaccccggcaaggtggtggtggcctgtactcaagaggttgagtcaggagaatcacttgaacccgggaggcagaggttgcagtgagctgagattatgctactgcattccagcctgggcaacagagcaagactccgtctgaaaaaaaaaaatatatctatctatatcatcacttatatagtgccatatattttacaaagagatttcactcacatatataatctagcttgatttttaaccataattcttctgagaagcctaggcagttcacagctaatgaaactgggtatttcacttgcacaatgccatgtagctggacagtggcagacagattctcacctcacagtaatcctttcaggaagtactacggttcccaatttaccggcaagagactcagagaagtaaagtcaatttcccagggtcacagagctattaagtgtcaagctgagactggaactcaagtgtctctgaatccatgtcaccaggctataattactctaacatatggaccaagttttctgacttcgaagatgtttttttccccttgatcaattctgagtcattggctttgaggcaaagataacagagaagcctgaatacagactatgaggctcagagagggaaccaggatgagctgtccccgtgagggtaaaacctacctgggcaagacttatctgggcaacacacatgtgggccacacctacctgaaccagcagctccagtctcctatcatccaggaggtgcacctggcagtgcctgccttctgtcatctgcaggaacaagacagcaagagtggtgtcagggccacggctggcaagcaaacctttggactcgttgtatcatttattttatatgagatgggctcagcctaaaaatggctttagttgagttaataaacaggcttggccaaaaacagatttattatatgggagtaactggatttaaaagaagaacaaagagcacaggctagtcaatatattgcaaaaataatgtccatacagtccaccaatttcaaacaatgcacacaaaattattctatgaaaagtaggtctccatcccaaaggaaactactatatttttcctggaattaatgttttatttaaaaaaaaaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaagcctctccatcccagaggaaactactatatttttcctggaattaatgttttattaaaaaaaaaaaaaaagccagccaggcacagtggctcactcctgtaatcctagcactttgggaggcagaggcaggcagatcacttgaggccaggagtttgagaccagcctggacaacatagtgaaaccccgtctctactaaaactacaaaaaatagccaggcatgtggtgcacacttgtaatcccagctattcaggaggctaaggcatgagaatttgcttgaacctgggcagtggtgtttgcagtgagttgagatcacaccactacactacagtttgagtgacacagcgagactctgtctcaaaaaaaaaaaaaagcctttattcagctgggtacagtggctcacgcctgtaatcccaacactttgggggggccaatcagggtagatcacttgaggccaggagtttgagaccagcctggtcaacatggtgaaaccccctttctacaaaaaatacaaaaattagcctggcatggtggtatgtgcctgtagttccagctactctggaggctgagttgggagaaaccctttggcctgggaggttgaggttgcagtaagctgagattgtaccactgcactccagcctgggtgacacagagagacacttttccaaaaaaaagaaaaaaaaagtatttattcattggtgtgtttaacgtctctctgggcatggtggcatgcacctatagtcccagctactcaagaggctgaggtgggaggatcagttgaggccaggagttcaagacggtagtgagccaggatcatgcctgtgaatagccactgcacccaagcctgtgggcaacatagacctcatctcttaaaataaaaatgaaaagtcttcattttggaaactctccccctacttttagtccaccaacatagtttactatcaccaccatagttaagaacagttaagatatatagttaagaacagtttgatacatacattttcaattatatttagttttttattattcagaattgcaatactaaaaaaactttgtaaaatacttaaacaatgcatagaatgccaagatactccttgattaactcatgttccaaaccattttatctgcagaaatcaccatcctattagtttaagaatcctcatagaccacttttatatgtattttcagatatatatttacatattaaaatatttcatattattttactttagtacatattatattgaatgtattgttttgcaaatgaagtactcttaatatttctgtgtgagtgtaaccatccagaaatttgatatatatgtgtgtatatgtgtttatccgtgtatgtgtgtgtatacatattttttgttgttgtttctttctttttcaatttcagtaggactatgcttcacttgctgttttgccttttgctttttaaattcaatgattcttgttgatctttccaatgtcagcacatatagatggacctcattctttttaaagactctatagtatcaattattgtgtggatacacgataattgaataagagaaacaggttgtttccaatcttttgctatcacaagcaatgtcaccatgaactttgcacatctagctttgtccatggatgtggaattgctaggtcacttttgaaaagcaggggcaacattttggctctaagccgttgtacaaaactataagttttaggaactcagatacatataaacctaattgaaaaagaaaatagcctccattactgagtaccaacaacctattcagcattgcatgaagtgttttatatacattatttctgagcggcacagttaccttctgggattagtattactatccccatttaacagctaaattgaggctcagactgggataagtaacctgttttcaatgtgaaaaatactaattattgaatttatagttttgatcgaactctgctttaagagtctgaaaactagctcagctggttagatcatggtattatgaagatgtggcccacaggaaccactgaggtagtgctaagaggtaagtgagtaagctttactttgtctcatggcctaagcctatgtccttaattcggcaaagccaaggtcaaatatacaccttgggtggcaaggggaaacagagcaagtctttattagctctaggcactgagctgggctttttacatgtattatctcagtaaagctctgcaaaagtttacaacatggcaacatccccattttacagacaggaaattgaggtacagagtttatggtaatttactcaaagttacataggcaagaaaacagccaagtcaagatttgaattaatgtctaactaaaaaaaaaaaaaagtcatcttttttttctgcttttctataccagaggaggaaataattaagagagaaataaaatgtgtcagtatttctataccagaggaggatataattaagagagaaataaataaatgtgtcagtttaaatcactttacttcttttgtaaaacaaccttcaaaagctaatcctaggtgtaggccctacagaaagatataaaaaaataatgctcaaaagatcacacagtattaatccattaaggaatatgtcataattgagaaaatatttaaagctactctgttgtcccataatccaaataagtttatttcctgactttaaaaaatcaggctgggtgtgttggctcacacctgtaatctcagcactttgagaggccaaggctggtggatgacctgaggtcaggagttcaaggccagcctggccaacatggtgaaacgctgtctctactaaaagtacaaaaaattagccaggcgtggtggcagttgcctgtaatcccagctacttgggaggctgaggtgagattgcataactgcactccagcctgggcaacaagagcgaaactccgcctcaaaaaaaaaatcatctttttttgcctttccattttgctttggaactccctcatattagtcaatattccttttagcaacagataattttattctagactattcaactgtagatatctttttgatgtgcctaaccatttcatgacaaacttaggcattggtggctaggttttacttggtcctgcccctttgtcctcagttgattgggcaagggatagatacttgactcaagctgggccaatcagaacctcagtccagggaatctggaattgggtctgagaggataaaaacttggttgtttatgggcagccattttgtgtgtgtggagaaaaggaaagccacctgcagaaagaatgagggagacaagtagctagaaggaggcaaaagacctgggtgcagtggctagcgcctgtaatcccagcactttgggaggccgaggcaggaggatcacttgaggtcagaagttctaaaccagcctggccaacatggtaatggtaaaagcttgtctctactaaaaaaatacaaaaattagctgggtgtggtggtgtgcatctgtaatcccagctacttgggaggctgaggcaggagaattgcttgaacccaggaggcggagattgcagtgagccaagatcgtgccactgcactccagcctaggtgacagagcaagacaccaactcaaaaaaaaaaaaaaaaaaaaaaaaggaggcaagagaaatcatgcggcctaagaagacaagcttaacagatttgttgtcagggttcctaatgttttccagtcacttatagtccttttcactgatccgggtgaatttttgtccttgagtttcatgaaacaccctgtattcctttaacaaatccatttttttccctctcttaagctaagagggaggattctgctttatttatttatttttgagatagtctcactctgtcacccaggctggaatgcagaggcacaaaggtggctcactgtagcttcgacctcctgggctcaagtgatcctcctgcctccacctcctgagtagctgggactatgggtacatgccatcatgcctggctaatttttatatatttttttgcagagacaggatcttactatcttgcgtatgctggtacggatctcctgggctcaagcaacctgcccgccttggacttccaaagtattgggattatagatgtgagcgatagtacccagccggattctgcttcttgcaactaaaagcatctttataagactccacaaatttccatgccaaaaccaaagcaaaagagttccaaagcatagactctccaaatgatgtcattaatacgagaaagtcatctactcataatcactgaggcgcccatcgatgacaatacaacaaccaagagaggctgacatctggggagggggcatgaacaaacacctgagggtttggtggaacaccacacagggcaggctggagagggtagcacagatgaactagagagaaaaacaccagggttacatgtccgcgcagcacacatggtgttcagcatgtggaaagatggctctgctgataggtcagggggctgatttgatgctcgctagcaacagaaaggcctgcccttgtcacttatttaaattggaggtggaaaagtgatggatgtattttgttcaccacaacagtgcttatgaataaatattagttgataatattagaaatcaggtaatgccacataattaaaaaatccagattgacagcttcttttgacaaatggtaagacctggaaattctgggcttgatttcttccatggcaatatttggcaagggcagggcagagtagttctctattccgatgagctttgtggtctctggttcacccaaatgtatgtatgacctgccaggctcctgggaggtgtgatgagttctgtcatctgagtgagcaaaccctgattgaagtggtgccagcgaagagacacaaccaaaacaaacacaaaccctgctgtggaccgggcaaagtgcttgacatttaacactcattaatgtatagaatttcaacctctacacaaacctatcaagggggcatcctcattttaaccaccaggaaattaaggcctgacaagtgatgtaacttgcacaggagttctaatgcagttatactctggatcgaaagcatagtttatctcttactagctgtgctaccttagagaaattacttgacctttctgagccttataagaaatgtcctgacagcatttaatctgaaactcagaataaaatcagccacttctgaggcccacaattattgtagtccccatttgtttgaaaactgacagctacgcttttctgtaatctatatattttcctatttaaaaaaacacatttttaatgggaggaatattactgacccattttaaagaagataaataacaggtaaagttaacaagtcacttaacaagcatatggcagaaaaattctccagagctgctgtaggggaaataaagaaagagaaggaaccactggtttctgagtgtcttctgtgtgcctggcacccagcgaggcactttaattatatcaataatatcactcctaggcactttctatattccaggtattgcactaagcactttacataatcaattctcatgatgcttacatgaggtgggtactcttagcactccaactgatgttagagagatgataaataacaaaattcataagtggcagaaccagatccaaattcaaagcccaaagcacttaaccacttagcaatacagatggtactacacacactgtaaagtgacaaatggtgagaaaacttcccacgcagcccattttcgatggatcagatgagtgggtagaaaaacaaaaacaaagaatcatgaagcaggcatgaaaactcatttcacttccagaaaaacataatttgaatagaagtagttagaactgcggaatttataaatagaaagcatcttagacggtatctattaaccactgcttatttgaaacatggggaaactaaggaatggatgtgcccaaagccacacagctagttaatgccagacctgggcttaaaagtcaggactctgactcccaggctacagcgtaagtgacctgaacaaggttactcatgtaataaataccatattattcaaatgaactttttccccaacgtgtcaattaaaaaattttttttaaaaattataacaacaaacagaaaaaaataaaaccccaactgggaattttaaatttaccttaaaacctgacctgggccaggtgtgttggctcactcttgtaatctcaacaccttgggaggctgaggcaggagcattgtttgagcccaggagtttgagacccacctgggcgacatagtgagaaaccatctctacaaaaaattaagaaattagccgggcattgtggtgtgtgcctgtagtcccagctactcgggaagctgaggcaggaggatcgctggagcccagcagcagttcaagaccagcctgggcaatacagcaagaccctgtctctaaaagcaaaaaccaaaaaacaaaaaaacaggagttatatttgaaaagagctgtatgtggagcacaatgattatatttacaaatataggatcatttctgaacccccagagaccatcagaatagtttcagaattgacccctacctagtggcagctaatagcagcaatgcttcagatgaaataaaaaacatatttaaaaaacgatctctttggaaagcttctcttcacatctactctgacttgatccccttcccgctaccttctcccctcatggaaccccaggaattcgaaggcaaaaattacatgtgttggattaaaactcccacctcggtctccagctggcctgtttgctccccagctggtaagagtcagtcctcagagtgcaagtgctgattactggtggaaagactttgtccatctggtcagtggttaaatgaggaagatcagaagggaagtaagaattggctataagccagacctctggtttcaaagagggccctgatgcggcagcccatagtggggttcaagtctttatgagaacacactcccccaccctggcccccaatcccactgcctggtttaggagatgagagaggagagtgggttggtaagaaaccaaaaggcaattcaagacagggcagtatggaaccactcataacaacggggtcgtcttacaaggcaacaggaaatagctacaaaaaaagaccaaaatcgtagcctacttcggctttgctttagttgttctttggaacagaaacatatgaaattggtaaggaagcagcaagcctttttaaaaatttttcttctctctctctcccttattccttttgaccttttcgaaagcctagtgagaaagggcctgcttcataaaaatgcctcctcaggattttctgtgcggtcaccttctagagtgaaatctgccatctggaagggtgaaaacccagctatctaggcaggttccataattccaattgagccctacagtggtccaaaactgtctaagagctttattgctttgttcaccactgtctccgcagggcctagaacagtgcctggcacacggtgagaccgtggtatataaatatctgctgagttaagaaatgtcttaactgttcagaacccagacacagctaacactgaaatacattcacaaatgattttttttttttctacacagggtctcactctgtcacccaggctggagtacagtggcacaaccatgactcactgcagtcttgacttccccaacttgagtgattcttccacgtcagcctcccgaatagctgggactataggcaagtgccaccacacctggctaattttttgtacagatggagatctcactatgttgcccaggcttgtcttcaacccccaggctcaagtagtcctcctgccttggcttcccaaagtgctgggattacagctgtgagccattgcgtctggctcacaaatgatttaaacagacagagcacaatccaaagcgaggattttccaggcaactcccaagccctggcccagaaaaactcacacataaaaaacactctttccacccagagaacaaggtgtgttattaaactcctcatcagatgagatattctggaggaactggagagcgggagaaggatgtatctaggacgttcttactttgggatctattgagtggatggagttttatatttcaccctaatgatgtcaaccctagctgaacagggcccctttatatcatctctgggtgttgactgaatatgagctattgacactcccgttcagagaatggcctagactgacacagatgtctccaaatggagtcagctgtgattttccctcaagttctttcaagacagtgcctaccctcccaatgtgcaatcactggagacttcttttttaagtgtcaataaatgattctcctagcttctagcaaacacttactacatgtcacacgagtatggagtgcttcacatgtgtagtgacttctttcatgttgctaacaaccctaccagggagagtcattgtttagatttttctctctctcttttttttttttttttttttgagacagggtcttgctctgttgcccaggctggagtacagtggcatgaacatgactcactgcagcctcgacctgctgggctcaagcagtcctcccacctcagcctcctgaatagctgggaccacaggcatgtgccaccacacctggctaactttttctatttttttgtagagatggggtcttgctgtatcgcccaggctggtctcgaactcctggactcaagcaattttttcccacgttggcctcttgaagtgatggggttatgggcatgagatttctgtttagatttcatagatgaccaaactgaagtgcacagaggttaagtggtgcctggtcatacagtgataaagttgggtagaatctcaggttccatcagtcgtaccaaagtaggactcctgtacatctcttgcaggttcactggaagtggagaaggaaaaagacaatgagggagggagaaaagcaggcagtgtaaaagaagcaaaggaggaaaggaaaatgaaatgagggaagaggggaggaatgacaaagaagaggagaattcagtttgccaaagctgaaattgagtaattgagtaacatgccttaagagaaatgctaacaaagataacagctgctgactgtgtgcctgataactatcccaaatcctttcatttatatacaaagggccttttatggccgggcgtggtggctcatgcctgtaatcccagcactttgggaggctgaggtgggcagatcacctgaggtcaggaatttgagaccagcctggccaatatggtgaaaccccctctctactaaaaatacaaaaaaattagctcggcatggtagcgcatgctgtaatcccagctacttgggaggctgaggcagaattgcttgaacccagtgggtggaggttgcagtgagctgaggtcgcaccactgcactccagcctgggcgacacagcgagactctgtctcaaaaaaacaaaacaaaaacccaactctctctctctctctctgtgtatatatatatatatatatatatatatatatatatatatatatatgcgttttaaatgaattttcataagaactctgtaaggtggattccattactagcttcattttatggatgagaaaattgaggctcagaaaaggtacatggctgacccaccttacaaggtcatagggccaggaagaggcagagtaggatgtaaacctaggtgttctgactccagaatccatgctcttaagggctatattacttcagtacaaagtatttcctatctcatacatcctatatattaaatcacatgtagtttaggcacttaatgtatcaccttgattgcgaagcctaacactgctctgaaaagcttgatccagactcaccaaaccagagttggctggttcaggccactgtctcgaagcaaggccagaagaagagaaaggttttacaatcaccatcccttggctacttcctggccccacactgatgaaatatgggcagctgctaaaaatggtgtctatgtttgctattgatcttccttgggcagtcaggatggaattaatctccacctgttgggatgcttccatggctgtgtcatgcatatgtgaacactcagggtacaggatgatatttgtcagttatgtggcctcctggacctgactccatattactctgggcttaagatgtagcctagcacacatgtaattaattcagtgtggaaaagctctggattatgtgttcattcattcacttaaccaatatgtgctgagcactctctaagtgcaagcactgttcttggcactattatataccagccaataagactgaaagggcattatctctggagcttgtcctacagttctcaacttcattggtatttgcagccagataactcattattgcggagcatagtcctgggcactatagggtgctaaacagcatccctgacctctacccactagatgtcagtagatcctcccccatatgtctccagaccttgccaaatgtcccctgggacgcaaaatcacctcttttgagaacaactgctttagaggtgaggagaaaaaaagaaactagtaacaattaaacaaatatgatattttcagataataagggctctgaagtagataaactggcaatggaattgagttctaagcatgtgcaaaactcacttctctttacccaggaagcacgagaaatgaggaaattgatggagaaggccggatgtggtggttccctcctgtaaccctaatgttttggaaggctgaggcggggggggattgcttgagcccaggagtctgagatcagcctgagcaacagggtaagaccctgtctctacaaaaaattagccaggcgtgtacctgtagtcctatgtacttgagaggctgaggcaggaagatcacttgagcccaggtgtttcgagttgcagtgagccataactgtgccactgtactccagcctgggcaacagtgagatactgtctaaaaaaaaaaaaagaaagaaagaaagaaagaaagaaagaaagaaagaaagaaaagaaattaattgatggagagaacttatattggaccactgctcttggtcaagtggctcccagtagagactggagggctgatggtgttttctaaacatttaactgcatgctcctttctgccttacagaggttgggagaaagtaaacaagaaaggctggccagtcaatggacggccattgctgcagctctaatgccaacctggcaggcaattccagccagcttcgggcagacattccctggggagggcattctcataaatgacaatcccttatcagattctagcctgatctgataagtctggtgaaaagaaaagccaggttttaaaggaagaaagaaaaataaagaagcaaagcaacttattaagcctggagctgaaggccatcaggagacaccagcctagtgtcaatgagaagcacacaggatttagagtcacgaggtttgagtttgtgtcccagccctgctatttacctaagagaatatcatggtatctctctaaatctcagtttctgcccctatgaaatggaaaggataaaaaatcagtctcatttgggtttgcctcttgtattaaggcaggttgaactgattataaactctaccttaaagcacagatgataattgtatcatcagtaatacaccatttattgagtataggttaggtgttagagtctgtgctaagtgcttgacatgtattaccagtttatccttaccctagtgccgtgagtactattattagtggaaataatgtctaagctattgagtactatcctgttctccagaaatggttattttaatttgcttaagtgcgtacttctctcaagaaaaaagttttcctagattattattatttgagacaaggtctctctctctatcacccaggctggagtggaccatagctcactgtagcttcagcctcctgggctcacgcaatcctcccaccacagcctcccaagtaaatggaactacaggtgcacaccatcatgcctggctaatcaattttttttttttttttttgtagagataaggtctcactatgttgcctaggctagtcttgaactcctgggctcaagtgatcctcccgcctcggcctcccatagtgctgggattataggcataagccaccatgcccagcctcttctacattattaagacactaagctgtcatgtttaagttgacaatcaacccgccagttaaaccctggagagacccaaaaacctaatagctggggattcattcaatctgattttttctagtgataatcaacagactaacttacaaccaccatttttagctgtccatatgtccaaatctggggaaggaaggtggtaaactctaacaccttatctgattgtgaccagatcattcctttgttctcatctccataaaatgcaagttaatatgtgttcatggctttgcctatgccatctgcttttacatacattttccccattgagctctcaaacctacctgtgaagcagatagtttccataatctgagattccacgaagttgagaatgacttgtctgaggtcccacagtttataaggggctaggccaagctcaaaaaggtgctcaacaaacaacatgagagggaaaaatcagggtatatatctacatggaagaaacttcagtgaaaagcaagattctctttatattctgactgtgcttttccaattagaaactcatgttaggcaccaagaagagactgtcaaatgtttattttcagaaaaacatgcaggatatttctgctgttcctctccagaaagaaacagcctcgttgcttaaaaccagttgttaggctgtatttttagacgtcatggtacagtatcaatgagtcaaaaataaaaaaacaaaaaaatgggagggcacagatactgtaaacaggaaaagtcacaaaaatggaactaagaaaagctgagagcacagcctgtgggttgggggtggggggattttcattttcatctgcagttcaggttaaccagaaatgaaagttctccagttgccttgtagaaaatggaaattttggcttcagtgagtatgcaagcagcagacaccctgtggtttggaaactttttgctttgccaactgtcagttttctcttttcccgtgaaaaacaacctgtaggaaggagtaaaaaagtactgcgtctttcaaagacttaaaagtctcaagtgtaacttgtgtgaagagatattgaaaataaactgcagtacttgtaatttaaagatattctaggtattgcctattcacggtataatacatttggaaatcctgggctcaatggaagccactcacaaagcaaacaaatcacatacatcgtcctgagaacctaagaattagcaaaaattaattagaaaatcagaatcaactttacattaattatggagtacatgcttactctcagggttttcatgtttcaatttttcgtcaaccctgttagaatgtctctgatttatgcttttccaagtctctttattttttgtgactcatgtataggtagaggctgaaataagtcctccttagggagtttataattaaaacaaacggattgtattaggtccagagtcctagcctatctctgatttgttggtagaaacatcatatttgggtaagggttttagaaaagcatcaccaaattgtaaaaacagaaaagtcaaactcatttgggacatatagaaaaattcttaatcttaacatccaggacttgtttcactgtcacagaagaaatatttcctctcaacttacaggcttatattatttagtcatgaagcttccttgtcacctaatgcaggctgtgtttttaaatgggattcagactctttttgaagccaatgtgggattcaacgattaaaacaaaacaacaaaactggaagccacaggtcaggagaacatagaaatatgaaaaaggagttaagaaaaaaaagatttattggcaagcaccagggaacataactgggaggaaagatcttttgagagacagaatggtggtggagagctggctcttggccactcacgaaagcccactgtcccattttcaagctggttgttaggtacaactaatatgaacttacaatgaaataaatcgcattaaaagcaaaggtaataaaactcttcactttccaattgttttactacatttactatgacctttgctcttgtggttattgaatctgcatggaagtaacaccatttaatgatatgctactgctcgtctcttcccagatcagtaagtcagtcaaggtgagagtatttacaccacagaaaatggcaagtgttgcaaatcagtgtccctttttccccagagctggttgtgtcagaggtgtttgcactggagtgactccatcttgaataggacctgggtaaaataaggctgagacctactgggctgcattcacaggaggtcaggcattcttagtcacaggatgagataggaggtcagcagggctggtatcacaagatacaggtcataaagactcagctgataaaacaggacacagcaaagaagccagccaaaacccaccaaaaccaagatggtgatgaaaaaagacctctggtagtcctcactgctcattatacactaattataatgcaattgcatgctttaagacactctcaccagcaccatgacagtttacaaatgccatggcaacatccagaagttaccctatattgtctaaaaagggaaggaaccctcacttctgggaactgcctgcctgtttcctggaaaattcatgaataacccaccccttgtttagcatatgatcaagaaataatcataaaaatagccatctagcagctctcggtgctgctctgcctatggagtggccattcttttgtttctttacttctctaataaacttgctttcactttactctatggactcatcctaaattctttcctgctcgagatctaagaactcttgggctctggatcaggaccactttccagtaacagctgagaaacatttaccagcataccagtggagaaagtgatggtcagaacactcaggatgtggaggccgttgagagaccacgtgataaagatgaacaaacagaggcttcaggtttacagagaattctgtttgaagcccagcttacttaactttagtaggacttactattttaaatctctaaaatagatttactaataccttccagggttgttgtgcatagaacttggcgaacagaggccaacataaaggtgactattataatttatttctttatttttatttttatgttttgagacagagtctcattccgtcacccaggctggagtgcagtagcgcaatctctgctcactgcaacttctccctcccgggttcaagcaattctcctacctcagcctcccaagtagctgggactacaggcatgcaccaccatgcccagctaatttttttttttttttttttttttttttttgagatggagtctcacactgttacctgggctggagtgcaatggtgtgatcttggctcactgcagcctctgcctcctgggttcaagcaattctcctgcctcagcctcccgagtagctgggattacaggcgcccgccaccaggcctggctaatttttttttgtatttttagtagagacggggtttcactatgttgaccaggctggtctcaaactcctgacctcaggtgatctgcctgcctcagcctcccaaagtgccgggatttgttataatttattattgggtactgggctttatacctgggtgatgaaataatctgtacaataaacccctatgacacgagtttacctgtgtaacaaaccttcacatgaacctcccaaacctaaaagttaaaaataaatttattattatacttcaagaaatccacagtgcatagctcactgatgaaggtctcctgaccttggatggcaactctcatatcagatcctctgtgtcatttgcctttccagctcttttgccactggaatgtaagttccacaaatgcagagatttgtttcatttcctggtgttttcctagcccctaagacagtgcttagctcatcctggggctcgacaaatatttgtggaatgaacaaatgagttgattttccttcatttccatctcctgctctccttctgaattttctacccatttctactttgaaggtcccattggcagctgagtgactcctttgtctttttttttttttaatattatatatattcaaggtatacaacattatattttgattcttttgccttttttttttttttttttttttttgagacggagtcttactctgtcacccaggcgggagtgcaatggggtgatctcggcttactgcaacctctgcctcctgggttcaagtgattctcctgccttagcctcctgagtagctgggattacaggtgtgcggaaatatacctggctaatttttgtatttttagtagagacagggtttcatcatgttggtcaggctggtctcgaactcctgacctcgtgatctgcccgcctcagcctcccaaagttctgggattacagacgtgagccactgtgcctggccgccttttttttttccttatctatgtattttataatagagacagggtctcactatgttgcccaggctggttttgaactcctgggcttaagtgatcctcctgtctcagcctcccaaagtgctgggattacaggcgtgtgccaccacgcccggcctcttttgccgctgaattgctagatgcctcccagttgtgttgctgctatctttctggaatcttttccctgctgaaggaggctgccatgaccttaaagcaccggtggaagatgtttccaactttttcattcacaagcagatttgagcacatgtcattatgctctgtcggcaagtttctcccacttctgttcctgctctattctaatctcagttccgttctgcctccatcagaaggaacgaacgtgtcttgtgagaggaaatctcaaccaacacttgaggctgtatccagggaaccaaatattttcccccgtgtccctatctcaaagctgtttcttagacttcctcttaaacagtatttctgaagggtggggagggtagagtaggatcactcaaaaaagcgttggtgcttctggtaagagtggcctggacaggggattatgcaaactcattgaggagtccttaaattccagaatttgaaattttggtcactcttgctttaggcagagggataatactgggtgcagctggccactcagcccctcggcgtagggcggtggttgggagcagcccctggggagtcagacaggtatgatatctgatgctggcctgccctctaactagctggtgactttaggcaagtcatgtatcctctctgagtagctgctgtaaaatggagataattttgcctagtgcactgttagcattccatattattactttttaaagtacagtgtattatttaagaagtgtcagggtcaagagcacagacttggacttaaatcccagctctgctctatactactgtgtgaccttgtataggttacctcacttctcttgacccttggttttcttgtctgaaaatggagatactaaaagcacactcacttcccagggctgggtggctcacatgagataagatgtataaaatgcttggcagaggacacactctataaatggtaatattaataattattaataatattatacttttcactaacaaacaacaagtaattggctgggcatggtggctcacgcctataatcccagcactttgggaggccgaggtgggtggatcaagaggtcaggagttcaagaccagcctggccaagatggtgaaaccctgtctctactaaaaatacaaaaattagcctagcgcagtggctggtgcctgtaatcccagccactcgggatgctgaggcagataattgcttgaacccaggagagggaggttaaagtcagctgagatcacgccactgcattccagcctgggcgacacagcaagactccatctcagaaaaaaacaaacaaacaaaaaaacaccaagcaattgatacagactccttcaggatgaaagctcccacaggccatgttcaggtgccgggcaggtggtgagcaggttccactctgtccctggaccttgcagaagagaagggagcaggcaggtctggccacataaaacctagtctgaatgttccatcatcacctcacctgtctggagtgcctcaaatttttgaagtgctttcacctctatttcctcttttgaactttacaaggagtctcaatgtgccagaaatgtcataccctcattttacagatgaggtcactgaggcccaaagaagcagctactcagagagggcacatgccttgcctgaagtcaccggcctcaggtgaggatggccaagatcaggtatcatacctgtctgactccccagggacttcttcctcccttgtggtcacaaaggtaaatgagacaagactcctgatgggagttcctttcttttctttttctttatttattttgagacagggtctcactccattgcccaggctggagtgcagtggcgtgatcatgactcactgcagccttgaacgcctgagctcaaatgatcttcctacttcagcttcccgagtagctaggactacaggtgtgcaccaccacacctggctattttttttttttttttttttttttttgtagagatggggtcttgcaattttgcccaggctgttctcaaactcctgggctccaacaatcctcccgccttaagcgctgggattacaggcattatccactgtgcccagccaggagctccttttttctatcgcttcaaaccatctcctcgtccttaacaagagcattcaccaaaaagcagagttaaaaaatatcaagctaaaatataagccagttcctgtatgcaatgcttcatcttgtgccttttacagtgggaagcctttccatcacattaaactagaattgtaagctgaatgcagctctctcaactcagggatgcttttgggaatctgcagtgctccatcgttatggtcttggctgcctcgatggctcagcctgccagtccctgaagccttttattagactgcagtcaatgaaaaaaatacacattttaaaaaaaattggagaattctgcaactgtcctggagataaaaatctctggtttttttggcttgtgaactattccaactactgtcagagtcctgaaggctttagtgcactggagcaaggaagagtttcatcaaagagaaatgatttgcttaaacaagaaaagggaatcccgtggtgcagacggggatgaaacgtggagaaaaaagatatgaacctggaaaagtcaaatgagccagatcacccccagatttccatgaatattttggttgagaattagaaatccttgtagaactttcagttttgttccattacaatgtctctgtgtgacagccaatttgaattctgccttagttgctacagaaattcataggtacctcttcttctgcaacacaggagtaagttattaattaaactttaataacaggggacaattgggactgttttttccctataattggcaattagtctattttatcatttctttcttctgattacataataaaatacccaatttccatcaaattgtgaacgtggtccattttgctggcttcatccattgtcttgtttgctttccagtgaatgactattttttgagcacctactctgtgccaggctcttgaggataaagtagtgactacacatttttgttggggagagggtgagggtaggtgtcagataaccaaaacttatgccataattgaagtggccagaaattatttttcttttatttacagatcacgagacacgtcatttaaagcaaccttcccacttccccaagacagcagaggcaaggctgaaaaagggtaaatctcttgcatccatctctaacaggtctctctacaataacagaagtgtctagagtgtgctggccactggatatggctaacactcttaagataatggggctatgatcaggtgtgtcagcctcaaggagaggctccagaagaagacaaagcagactggcttcacatcctctttaattgctgcctcagtggccttagacatttaattaagctttttgagccccagtttcttcatttgtaaaatggggggatggtgttatccataatccttagcataaaatcaccactgaggtccccctccctctcttattcctggttgtgatagccacgggagaaaataaaatggtggggaggccaggtgcggtggttcatgcctataaatcccaggactttgggaggcggaggtgggcagattgcttgaagccaggagttcaagtccagtctggacaacatggtgagaccttatctctacaaaaaaaaaaaaaaaaattaaaaaaatacaatagtgggactgggattaaatgatctggggaatttaggggaaacattttgcttctttgctgtgccttttggataactcagaggttgagcactgtcatctatagacccagttaactgtgacagcattcttcctactgggtaccttccactcaatgacccctgggtttcagtagttgctaaataggtgatttgaagtctgagcacctgaatccaaatcttagctccactgctttatccactgtgtgactagcatccattcacatattcacaaatattcatcaagctcttattgtgttccagactttataataggctctggggactcaacagtgacacaagccagagagtcaagtgctcctctctcaaagacttgccagcgaagaagaaagccagaaaacaagcaaatcaagcaacacacagggtgatttcaggtcgtgttaagtaccatgaaaatgagaatacagactaatgtgatggggagagttgttactttagacagagcaggctgggccagtggttcatacctgtaatcccagcactttgggaggctgatgcagaaggatcgcttgagcccaggagtttgaggctgcagtgagctatgagttatgccctgagctatgagctatggtcacgccactgcacttcagcttgggtgacagagtgagacactctctaaaatgctataaataaagcagctaggaaacggctatttgaggaggcaacatttagccagaaatagcaatgatgaggattcagccttggcagatctgagaaaagcatattccagacagaggccaacaagtgcaaaggccctgaggcagaacatgcttgggttaagacattgttgcataacttttttttttcattattgcattttttttttttttttccgagacagagtcttgatctgttgcccaggctggagtgcagtggcacgatcttggctcactgcaacctccacctcccggttcaagcaattctcctgcttcagcctcccgagtagctgggattacaggcacgcaccaccatgcctggctaatttttgcatccttgtgatctgcccacctcggcttcccaaagtgttgggattatgggcatgagccgctgcagccggccccataattgcactcttaaggagcctctctagacaatttttcccccaataccctcctcccccatgaaatgttaataacacagatatactttatatcttatctgctgggcaggactgagttttttttttttttttcttttgagacagagtctcactctgtcacccacactgcgatctcagctcacttcagtctctacctcctaagttcaggtgattctcctgcctcagcctcctgagtagctgggattacaggtgcgtgccaccatgttcggctaatttttgtatttttagtagagacacgctttcaccatgttggccaggctggttttgaactcctgacctcaagtgatctgcccacctcagcatcccaaagtgctaggattacaggtgtgaaccaccacacctggctaagaactgagttttgaagggctgaaaactattgtaatacctaagattttctttacccctcaagaaccaattataacttcccttggggggtgaagtcaccctatggagaatgcacagtttaagaaaaaaaaggcaacaaatgtggttggaggttggtcaccaagagggagagaacaagagacaagcttagagttaatgaggggctcatcagtggttcttgaagtgtggtcttaggactcacagcagcatcaactggagcctgttaggaatagagagtggcacccggcaatctgtgtgttcacaaccttccaggtcactctcatgcctgctaaagtctgaaactactgggctagaatcattcactgcattgtaggccatagtaagaagtatggagtttgtttcagatgcagcaaaaagccaatggaggcttttaggcatggagaagataatctggggctatatataaaggataagtctgcttactgtgaggagaccaaactggagtgggtgaggcaaaagtggaagaatgagaaataatccaaaaggcttttgcactggtacttatctgtaaaatgggcatgcaaagatgaccaaattcataaggttgttgtgaggatcaaatgagtgaatacccacaatggcttggctgggtgtggtggctcacgcctgtaatcccagcactttgggaggctgaagcgggtggatcacatgaggtcaggagttcgagaccagcctggggagagaaaccctatctctactaaaaatataaaaaattagctgggcatggtggcgcatgcctgtaatcccagctactttggaggctgaggcaggagaattgcttgaacctgggaggcagaggttgcagtgagccaagatcatgccactacactccagcctgggcatcagagtgagactctgtctcaaaaaacaaaaacaaacaaacacagtggcaaagacatgaaatcaacctaaatgtccattaatggtagaacagataaagaaaatgtggcaccacgctacctgacttcaaactatactacaaggctacagtaaccaaaacagcatggtactggtatcaaaacagagatatagacaaatggaacagaacagagctctcagaaataatgccacatatctacaactatctgatctttgacaaacctgacaaaaacaagcaatggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaactctagaagaaaacctagacaataccattcaggacataggcatgggcaaggacttcatgtctaaaacaccaaaagcaatggcaacaaaagccaaaattgacaaatggggtctaattaaactaaagaccttcttcacagcaaaagaaactaccatcagagtgaacaggcaacctacagaatgggagaaaatttttgcatcctactcatctgacaaagggctaatatccagagtctacaatgaactccaacaaatttacaagaaaaaaacaaacaaccccatcaaaaagtgggcaaaggatatgaacagacacttctcaaaagaagtcacttatgcagccaaaagacccatgaaagaatgctcatcatcactggacatcagagaaatgcaaatcaaaaccacagtgagataccatctcacaccagttaaaatggcaatcattaaaaagtcaggaaacaacaggtgctggagaggatgtggagaaataggaacactttgacactgttggtgggaccgtaaactagttcaaccattgtggaagacagtgtggcgattcctcagggatctagcagtagaaataccatttgacccagccatcccattactgggtatatacccaaaggattataaaacatgctgctttaaagacacatgcacacgtatgtttattgcagcactattcactatagcaaagacttggaaccaacccaaatgtccaacaatgatagactggattaagaaaatgtggcacatatacaccatggaatactctgcagccatacaaaaggatgagttcaggtcctttgtagggacagggataaagctggaaaccatcattctgagcaaactatcgcaaggacaaaaaaccaaactccacgtgttctcattcataggtgggaattgaacaatgacaactcatggatgcagaacggggaacatcacactctggggactgttgtgagtggggagaggggggagggatagcattaggagatatacctaatgttaaatgacgagttaatgggtgcagcacaccaacatggcacatgtatatatatgtaacaaacctgcacgttgtgcacatgtaccctaaaacttaaagtataataaaaaaagaaaatgtgtcacatatacaccatggaatattatgcagccataaaaaagtgagaaaatgtcctttgcaacaacatgaatggagctggaggtcattatcataagcaaactaataaaggcacagaaacccaaacactgcatgttttcacctgtaagtgggagctaaacattgagtacacatggacacaaagaagggaacaacagacaccgaggcctacttgagggtagagggtaggaggagggtgaggatcaaaaatctacctgttgagtactactatgcttattacctgagtaacaaaataatatgtacaccaaacacctatgacaccaaatttatctacagaaccaacctgcacacatacccctgaaactgaaataaaagttaaaaaacaaacaaaaaaaccccaataaaatcaaattagtgaatagctataaataacttagtatagtgcttggcacatagtaagcacccaatacctattaaaactattcttctctgccccttagttctcccagaatcctcatgggttaatatccaagcacagatctttacgcatcccccgccatttgctttatattcctctatttatgccaatgtgactgactcagctggtctgtgggctggtaaaactgtaacatgtttgcaagcctgcttcaggtcatggtgaaggtccatggtgttctactcagtttcctttcatttcctttatttttttttcctatgagatttaactattggcctagaaaatgaaacttaatgttaaacccgagttttataatcagttctatcattaactttggacatttttgcatccataaaataagaagttccacatgtggggaggcgacacagtggagagtcaagcatggactttggaatcaggcaaacctgtgtgcgagacctaactctgacactagccggtgggactttgggcaagtcatttaatcccttttagtctgtttctttatctgaaaaatatggataatgacagtatctgccccacagaactgagaaggcaacaggagaattcgtggaaagcacccagcacagtgcgtggcactcagcgttagccatgatgactattaattaccaaacctgtcacaggaatgatgcagctacatgaaccattaagaaaaataaatgtatcccagaacttaaagtacaataaaaaaaatgaaaacaaaaaaggcaaatatagttctgcaggcctcgaaaaaaaggcagaaaacatttcgacttgggagagacatccatgggacaattcagcaaaacagatgaaacatccccaggcaggctgctctccatatccacaatattaaattgatgtgaaataatccagccagctcaggagaacacccctcagtgtcttcatctcacaggcatgcaaagtcccctgagaggggattcttgacagggcagtttagcttcagagccaaccaattaggttctgattgaacctaattcaatcagaaaaaaactcccatccctgaggcggcctaccaagccctgcactgcctcattcctgcccactcttcccctggtcttgtgttaacttcctcttactccctgggccccagccacattgccttcctctgtaagatctcctttccagctcaaggcatgaggggttggggaaagtgcctgactaacccaactcatctctaaaaacatagattaaaagccattatttcttttcttttctttttttttaaacttttaggctcaggggtacatgtacaggtttgttgtaaaggtaaactcatgtcatgggggtttggtgtacagatgattttgtcacacaggtgctaagcatagtacagtacctgatggttattttttctgatactctccctcctcccaccctctatccttgccttggtgtctgttgttcctctctttgtgtccatgtgttctcattatttagctcccacttacaagtgagaacatatgatatttggttttctgcgttaatttgctaaggataatggccaccagctccattgatgtttttgcgaaggatgtgatcttgttctaaaagtcatgttttcataggagacatcgtgcagtggttatgggtgaagatcctgcagtcagaacacccagggttcaaatcatggcttagatgctttgctagtgtcaccaccatgggcagacgacttcagctccttgatacctggtttcctgatctgcatcatggaggtaatactggtgctacactatgaggtttagatgagctgatgtacatagagtgtttcgaatagctttgggttccatagctcttattatgagtgttatcgtcttttagttctctatacttctttgttgcatcacttttcactattgtgattaaatactgatgtactttgttatttaatgtctgcctctaggtactttgtcttgctaaccactctatgctcagcttatagcatgcactttgcaaaagaggctacgcaataaaaaaataattaaaatggagttgtgtaataaaaaaaggagttgcaaaaaataataaaaaaaggagttgcatataaaatataaaaatacaaaaaaggagttgcatattcattttataaaaattgggaagacaccatagcactctttttcatatataatagttaaaagtgtcactgattgatcaatggtttcttttaaaaagaaggaaaaaagaatactgtaaagcaagatgagtgaggctccttggacctcagtgcttgttctaatgaagagggctgtttgcatctcaaggtgggcacttggagatgtacagttaccacgaacaacctcctattctttcaactcaaatgcagtggttactgaaaaaaatctctgcagatttacagatgaatcccctaaagccagatgactgttctactggtgaacagaacaattactttcaggtcccactagagtgaccttactctcaactcaacacaaggccaaataccaagagggaacctgcctcctctgcacctggttgttgctaaaggtatgattcctgctcccagagaaacagtataaatggctgcaggagtggaggtggcaaggcttgctcttacattctaaataccttccacagagcccatgttaattatgggacaccacacttctggcaggctcaaatacagttaggtgctaaagagttccagaaaaccttgtttcttgggcattgctatggtttgtggtccctccaaaattcaggtgttgccaatgtctgtagtattaagaggcaaggcctttaggaggtggttaaaccttgaagcctgctctgtctctttaacggattaaagcccttataaaataggcttcatgcagcatttggcaagcttgcctttttgccttttgccatgagaggatatagcaagatggcccttaccaaattgagtgccagccccttgatcttagatgtcccagcctcacactgtgaaaaataaatttctgctctttataaattactgagttgcagttactctgttgtagcagcacaaaatggactaagacaggcaacacacacaaaggcctaatagtttctcaccatttctctgaaagaaacacacagctcacttagggctgtagttcttaagctgtgacctctcacaggtctactaatgacattagagaagcttgcaaacacttccccccacaaatataggcaaaatgtgttaatgagaatctttccaggaaggctttttataacttcctggatctagatttgtattgggtccatgtccttaaagtggttgagaaacaggtccttaaaaagatgaacacttgacctgaaggcaagaccagagtctgcaatggacatactgtgattacttatttgtgaacttttgccaagtgaaatccagacaaagtgcagagtcaagtgatctcatgtgtccaaatgacagaatgctgatgggatatccagacactatcaagatgcagagagattcaaatgtgggctaatgaataactggtttctatttatatcattatgaacattacaggccctgaaaaaagattacccattcattactttgtacactcaatcttctgatggtgtctaaatatttttatgagactactgccatcatttgccatatttgggatagttgtataataatattattaaacaaaagtaactgccacttattaggtacttcagtgccagatgctagctctaaccccctcaataacattaaaatgtagttttatttctaaattgataatagtgatgtttcaatacatatcatctacagtgattagatcagagtaattagtatatccatcatttcaaacatttatcatttctttatgttgggaacattcaatatcctcctatttgaaactatatattactgctaactacagtcaccctatagtgctatacaacactagaacttattcctcctgtctagctgtaattttgcatcctttaacaaacactagaggctaggaagggtgggggaaggagggatagggagaaatttgttaaaaggtagttttaaaatattttatttttagagacagggtctcgctctgtcacccaggctggaatgcagtagtagcacaatccatagctcgctgcagcctcggactcctgggctcaagcaatcttcctgcttcaacctcccaagtggctgggactgcagaggcacaccaccacatctgcctaatttttaaaatttttgtagaggtagggtcttgctatgttgtccaggctggtcttgacctcctggcctcaagtgatcttcctgtcccaacctccaaagtgctggaattgaaggcacgagccactgcattaggctgaaaaggtagttttaattacccccatcagaagcccagaggggaggtcactcagtttgtcaatgacaaagtaggatttacatgcaaagcctcatgctaacactccactctcgacacttcctctctttgtccgttaggtgtggataaagcctatcaaaaacagaacctttaaccacggactcctgaatgctttagggtcactgtttgtcttagttgacattattcaattcctacctggatatacccctgtcaatttaatctcttgacctaaaaatcatattaattaaactccactacttacagccattttgtcttaacagttttttgtttttttttttttttttttttagacggggtctcgctctgtcacccaggctgaagtgcagtggtgtgatcccggctcactgcaacctccacctcccgggttcaagtgattcccctgcctcagcctcccaagtagctgggattacaggtgtgtgccaccatacctggctaatttttgtagttttagtagagatggggtctcaccacattagccaggctggtatcgaactcctggcctcaagtgatctgcccacctcagcctcccaaagtgctgggattacaggcgtgaaccaccacacccggcccgtcttaacagtttctatactccccaagagtgagttgcaaatgaactaaaagtcaagcttgtaagagctatttatattccccaactggtaatggacccataagtatagtggctgcatcttattcacctctgtaagccgaagcctgacacattgctggtgcagtacatacccagggaatatgtgctgacttttaaagaatttggaatccaagggccagtgtcaaatttcaatctaagagctgcatccattgccaaagatcctgatttcttcatggacagcatctcaatgtctgactccaattagtggcatcagtaatttctccatttccaaccttgccgtacttagtttgtccctatccatatactgccagtggctctacaggcatctgggccattttaatctgtgccccaaatttctttctttgtgaaaaggagaatatcagtggaaaggaagaaagaagggggagaaaaaggacagaaggagggaggaaaggaagggaaagagggagagagatggaggttaaacacagtgacagatagagctgtaatatatttgggtaatagggaagtaactacaaataattaagagttacagagcatttctaagctgaaaaatagcctcagcattagtctaatcccttcactcatcaatgtggattctgaagactgaatatgaaaaattagcttccaagaccacatagcttgtcagtaagtggcagagttagacctggagtccagctctctctctctcttgtctactgggcttttcagccacaccatactgttgtataggataaagtttctcctttatagacgaccagtttctggactactgtccctcctgactggaaaacctgaatctagaaacatctaatagaaatgatagtataaaagcatgttcctgaaagaataagtacaacgtctgcagaattgttcaactgaacttacaagaaaaaaagaaaaaacaaccacaggggcagttccaagatggctgaacaagaacagctccagtctatagctcccagcttgagcgatgcagaagatgggtgatttctgcatttccaactgagatactgggttcatctcactggggcttgtaggacagtgggtgcaggacagtgggtgcagcccaccgagagtgagctgaagcagggtgaggcatcgcctcacctgggaagcacaaggggtcagggaattccctttcctagcaaagtgaagctgtgacagatggcacctggaaaatcaggtcactcccaccctaatactgcacttttccaatggtcttagcaaatggcacaccaggagattatatcctgcacctgactcggagggtcccatgcccacggagcctcgctcatggctagcacagcagtctgagatcgaactgcaaggaggcagtgaggctggggtaggggtacccgccattgctgaggcttgagtaggtaagcaaagcagcctggaagctcgaactgggtggagcccactgcagctcaaggaggcctgcctgcctctgtagactccatctctgggggcagggcatagccaaacaaaaggcagcagaaacctctacagacttaaatgtccctgtctgacagctttgaagagagtagttgttctcccagcaggagtttgagatctgagaacggacagactgcctcctcaagtgggtccctgacccccgaatagcctaacagggtggcacccctcagtaggatcagactgacacctcacacagccgggtagtcctctgagacaaagccaaagaaacgatcaggcagcaacatttgctgttgagcaatattcgctgttctgcagcctctgctgctgatactcaggcaaacagcatctggagtggacctctggcacactccaacagacctgcagctgagggtcctgactgttagaaggaaaactaacaaacagaaaggacatccacaccaaaaccccatctgtacgtcaccatcatcaaagaccaaaggtagacaaaaccacaaagatggggaaaaaacagagcagaaaagctgaaaattctaaaaagcagagcgcctccccacctccaaaggaacgcagctacttgccagcaatgcaacaaagctggacagagaatgactttgatgagttgagagaagaaggcttcagatgaccaaacttctccaagctaaaggaggaagtttgaacccatcgcaaagaagctaaaatccctgaaaaaagattagacaaatggctaactagaataaccagtgtagagatgtccttaaatgacctgatggagctgaaaaccatggcacaagaaatacatgatgaatgcacaagctccagtagcgattcgatcaagcggaagaaagggtatgagtgattgaagattaaatgaatgaaatgaagcgagaagagaagtttagagaaaaaagagtaaaaagaaatgaacaaagcctccaagaaatatgggactatgtgaaaagaccaaatctaggtctgattggtatacctgaaagtgacggggagaatggaaccaagttggaaaacactctgcaagatattatccaggagaacttccccaacctagcagggcaggccaaccttcaaattcaggaaatacagagaatgccacaaagatactcctcgagaagagcaactccaagacacataattgtcagattcaccaaagttgaaatgaaggaaaaaatgttaagggcagccagagagaaaggttgggttacccacaaagggaagcccatcagactaataggggatctctcggcagaaactctacaagccagaagagagtgggggccaatattcaacattcttaaagaaaagaatttccaacccagaatttcatatccagccaaactaagcttcataagtgaaggagaaataaaatcctttacagacaagcaaatgctgagaggttttgtcaccaccaggcctgccctaaaagagctcctgaaggaagcactaaacatggaaaggaaaaacccataccagccactgcaaaatcaagccaaattgtaaagaccatcgaggctaggaagaaactgcatcaactaacgagcaaaataaccagctaacatcataatgacaggatcaaattcactcataacaatattaaccttaaatgtaaatgggctaattgctccaattaaaagatgtagactggcaaattggataaagagtcaagacccatcagtgtgctgtattcaggagacccatctcacatgcagagacacacataggctcaaaataaagagatgaatgaaggtctacgaagcaaatggaaaacaaaaaaaggcaagggttgcaatcctagtctctgataaaacagactttaaaccaacaaagatcaaaagagacaaagaaggccattacataatggtaaagggatcaattcaaccagaagagctaactatcctaaatatatatgcacccaatacaggagcacccagattcatgaagcaagtccttagagacctagaaagagacttagactcccacacaataataatgggagattttaacactccactgtcaacatcagacagatcaatgagacagaaagttaaaaaggatatccaggaattgaattcagctctgcaccaagtggacctaatagacatctacagaactccccagcacaaatcaacagaatatacattcttctcagcaccacattgcacttattccaaaattgaccacatagttggaagtaaagcattcctcagcaaatgtaaaagaacagaaattataacaaacggtctctcagaccacaatgcaatcaaactagaactcaggattaagaaactcactcaaaaccgctcaactatatggaaactgaacaacctgctcctgaaagactactgggtacataatgaaatgaaggcagaaataaagatgttctctgaaaccaatgagaacaaagacacaacataccagaatctctgggacacatttaaagcagtgtgtagagggaaatttatagcactaaatgcccacaaaagaaagcaggagagatctaaatttgacaccctaacatcacaattaaaagaactagagaagcaagagcaaacacattcaaaagctagcagaaggcaagaaataactaagatcagagcagaactgaaggagatagagacactaaaaacccttcaaaaaatcaatgaatccaggagctggttttttgaaaagatcaacaaaattgatagactgctagcaagactaataaagaagaaaagagagaagaatcaaatagatgcaataaaaaatgataaaggggatatcaccatcgatcccacagaaatacaaactaccatcagagaatactataaacacttctacgcaaataaactagaaaatctagaagaaatggataagttcctcgacacatacaccctcccaagaataaacctggaagaagttgaatccctgaaaaagaccaataagaggctctgaaattgaggcaataattaatagcctaccaaccaaaaaaagtccaggaccagatggattcacagccaaattctaccagaggtacaaggaggaactggtaccattccttctgaaactattccaatcaatagaaaaagagggaatcctccctaactcattttatgaggccagcaacatcctgataccaaaggctggcagagacacaacaaaaaaagagaattttagaccaatatccctgatgaacatcgatgcaaagatcctcagtaaaacactggcaaactgaatccagcagcacatcaaagatcttatccaccatgatcaagtgggcttcatccccgggatgcaaggctggtacaacatatgcaaatcaataaatgtaatccagcatataaacagaaccaaagacaaaaaccacatgcttatctcaatagatgcagaaaacgcctttgacaaaattcaacagccctttatgctaaaaactctcaataaattaggtattgatgggatgtatctcaaaataataagagctatttaggacaaacccacagtcaatatcatactgaatgggcaaaaactggaagcattccccttgacaactgggatgccctctctcaccactcctattcaacatagtgttggaagttctggccagggcaatcaggcaggagaaagaaataaaggtattcatttaggaaaagaggaagtcaaattgtccctgtttgcatatgacatgattgtatatttagaaaacctcattgtctcagcctaaaatctccttaagctgataagcaacttcagcaaagtctcaggatacaaaatcaatgtgctaaaatcacaagcatttttatacaccaataacagacaaacagagagccaaatcatgagtgaactcccattcacaattgcttcaaagggaataaaatacctaggaatccaacttacaagggatgtgaaagacctcttcaaggagaactacaaaccactgctcaatgaaataaaagaggacacaaacaaatggaagaacattccatgctcatggataggaagaatcaatatcgtgaaaatggccatactgcccaaggtaatttatagattcaaagccattcccatcaagctaccaatgactttcttcacagaattggaaaaaaatactttaaagttcatatagaaccaaaaaagagcccgcattgccaagtcaatcctaagccaaaagaacgaaactggaggcatcaagctacctgacttcaaactatactacaaggctacagtaaccaaaaaagcatggtactggtaccaaaacagagatatagaccaatggaacagaacagagccctcagaaataatatcacacatctacaaccatctgatctttgacaaacctgagaaaaacaagcaatggggaaaggattccctatttaataaatggtgctgggaaaactggctaaccatatgtagaaagctgaaattggatcccttccttacaccttacacaaaaattaattcaaggtggattaaagacctaaatgttagacctaaaaccataaaaaccctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaaaaactatcatcagagtgaacaggcaacctatagaatgggagaaaattttcacaacctactcatctgacaaagggctaatatccagaatctacaatgaactccaacaaatttacaagaaaaaaacaaacaaccccatgaaaaagtgggcaaaggatatgaacagacgcttctcaaaagaagacatttatgcaaccaatagacacatgaaaaaatgctcatcatcactggccatcagagaaatgcaaatcaaaatcacaatgagataccatctcacaccagttagaatggcgatcattaaaaagtcaggaaacaacaggtgctggagaggatgtggagaaataggaacactttgacactgttggtgggactgtaaactagttcaaccattgtggaagacagtgtggcgattcctcagggatctagcagtagaaataccatttgacccagccatcccattactgcgtatatacccaaaggattataaatcatgctgctttaaagacacatgaacatgtatgtttactgtgacactattcacaatagcaaagacttggaaccaatccaaatgtccaacagtgatagactggattaagaaaatgtggcacatatacaccatggaatactgtgcagccataaagaagaatgagttcatgtcctttgtagggacatggatggtgctggaaactatcattctcagcaaactatcgcaaggacaaataaccaaacactgcatgttctcactcacaggtgggaattgaacaatgagaacacttggacacaggaaggggaacagcacacgctggggcctgccttggggtgtggggaggggggaggggggagggatagcattaggagatatacctaatgtaaatgatgagttaatgggtgcagcacagcaacatggcacatgtatacatatgtaacaaacctgcacattgtgcacatgtactctagaacttaaagtataataataataaaaaaagaaaaccaaatgagaaaataaaccaatacaagacaacagaagtgtgcatacctttacagcctgatctacaaaagcttcctttaaggaaaaaaaaagcaactgaagtatacagcaagcccaataccttcctttcttagattgctgttattggaataataaattgattgtttaaccttgccaaatcacataaacatatattaatgtatagtttacctgtactcaggcttacttttccagtttaggaaaatattgcatttaaaattttttctagttttccaacattaagcaagaaaaaagtcttaattggagcttcacagaatctacctcagggacaaacgtaagtctcatacttgaattatgatcccgagacaggcctctgctgagagctcactagtattttcaggttgccaaaatatttttgaaacaaagagaaagtgttttagtatggttttacctagcactatagctttttgtgataagagacaagacatgtagttcttttcctggggtcttttgcacacctgtgcacaggcttctgctagcaattggaaaccatgcagaacagaaagcagaatctcatttggatgcagctcccacttttctattccaagatgcacgcacccatgtaaagaaactcttgcttcatgaaattcagagatgctggaaattaggcaaaatcatcctctggcccagaaaaggcaaagggtggacagagcatagattcggaactcaggagatccagaatccaggctgtgccctgcccctaacgggataggaagtcttagaaaaattcctcctcttctctggattttaatctcttcagtaacagaatgaggagattggacaaagtgacttacaaggtttcttctggtttaaatgttccatggcataaatatatctaacaattctgctcagccaataatatttgtccaccacccatcaccctgcctcctgatagttactgggaattctctccatgggtgagacatagtacctgtctgcagcaacctccattctagtagtaacaacttccctgcatacttcaaatgtaggatcaaacacagtggaacacacagagtatgctctggagtgggacttggtatatctgggaatatattaggccctctgctaagagctgtagtttctgacccctgaaagagctgcataacaagatagtcttacttctcaggatgttctatggcctgaatcttcagaacaggatcatttataatgaggccttaggtcaccataatgtcactctgagaatccaggtcacaggactgcatttggataagattatattccttttcactccttcggacattagatacctttagataggaccgatttagagacaatggactcatttctaaggctacactattatgttgttacattatagcaaaagggtactattccagttcctattgtgatatatttaatttctttgatgtttctcttctctacccaatcctgcccacttcctctacagacttccttctatccccaggagttttgcagtctactggatgagataatttcctttgttttttacccagatattcctcccctccaccatcaacatctacccatcaaggaagaaaaatggccacatggagttggacttaatgagtttgccataaccacattacaaggcagcaaagaaaaaaaaccttccctttaataaggatgtaggacttcctctgacaaatcataaaagttttattaattaattggaagccgtccccaaaaatggcatttccgaggtttctatcttgaactgctgaattctgatcacatagaatcctcaccacaaactagactggaggacaaaattcaattttccttcttctttctggaggcaaagcagggacccacatcaaaggatcctttcagatgggctgctaatgagctctaggacaccacggaatttttgttgccaagtgttcacaaaaacagggaaggccccaaacacatcttgctgatgaaacgatgaacaattataaatcaaaaagcatttctgtgttgcttactgacacagttcctgccctctctctgtcttttctacatccataaagaaactccagtatttaaaatttaaaaaaaaaaagaagaagaaaaaaggagagtggtgggagcaggggaaagggtgatgaagtggaattacatacttcatatttgccaaagttctaaagcaaaataagaaatcagcctttcacgacctttaaaggagcaaagatagcattaaaacaatgacaggaaaaccctccagacgatgggcgtctttaaggaccatcttcacttggtatcaaacagagcacatccaactccgttttggaaaaagtaattccttcacaagagtgaagataaacatttcttgtaatttccttttctgcaagttgggttctgcaatattagttcttagattagtccacccccagtacaatattaaaatctgcccaagattttgctatgaaatgccagtcaaagctgaagaagcaccgttacacagtctgcaactggaagatcataaaaaaaaatcattcttacctccgaaccaccatgacctcggctcatttaaaggaactgaagagagtgcttaagacaaaagacacacgtattaagcacttgtgcggtgtgtgtgtgtgtgcgcgcgcgtgtgtgtgcgcgcatgtgcttgcattttctccaactacaagccagtggaagtaggaacttaaaaactcccgacgccttccgctgccatataatctcaaggaaatgaccatactgtttgtttctttgattagaaacaaaagcctttcaatatgagtcacgggagaaatgggaaaataaaaacaactaaaaaacttctgctatttcttttggccactcaaacgctttctttacaacacatttaaaacatatgatgaaatgtcatctactgttttctaaacttccttgataatgcaagctttaggttgggtaattattcagagataggcgatgccatgtatgaatctaaacttctatgcatgttctggatgaggctgggaatttaatgaatataaataaaaacaatatttaactcaactttgctactcacagccagttgatgttaacagcttttccactcagaaagaaacttagaattccatggaacaaccttagtaaaatcaatcagagatgccagccacaacagaaaatcttggcagaatgacgtggtctcagaaaagattcatttcactatttgcatttaatgaaatcattactattgaagtcattcagtgaataggaaataatcaaaatacattatgcttgaaggcagagagaaaaacatatagaatactggaaaaataataaatttactttttttaaaaaaagagaatgactaagtaaaagtttgtgacagggtatcatgcttctccctcctgaaaaaaagaacagtctggaattttgctcaggagtatggtatggttaagaatataaccataagattaaatctctaagactctctagagtcagagaaacctcgtgttttacagttgtatatatccttgggaaagttacttgatctttctgagaattggttccctcctttgtaaaatggagataaaaatcctgatctccttcaggagtgctggggaaattaaaagagatagttcatgcaaagctcaaagaatttgcctgggagataccacaggtatctaaatatagggtggggtacctccctttacccccacaaaatgttaatccctcagaaaccggggagtggctttatcttcagatccttctaaagactctaattactatgaccacaatatactgtctggggaagacatggcagcctgtaacaacttcagtcaatgctaagtttggatgcaaatagaagtcacttgatgatatcagtagaaaaggtggcaaaaagtttaatacatatttagtaattatttgtgagcacgtgacctcccaattggacgggttggatgttagaagaaacaagttacttaaacattatttcatgcacatatacttgtaggataaatggaaaaaggaaaaaaaaaaaagctgggcaatgatattcccagaaaagcatcatatatggagattgaaaaagtgctatatagctcaaacaacttgggcagaagtggagatgctgcgctgtgataaaaggatgactcaaagaggacttttgttccagtgccagcacacacatgcacatgaagaagctgaataaaattatcctatcaagagggagagcacaaggcagaaatcactccagttattaatctgcataacaagtgttatgagcactcctaatattaggagtaaattttctaatatttcatatacatttctaaaattttatataggttgacccaaaacatttgcctgagtcttcttgtttggaaggtggggaattattgtattactttatttgacagaaccttctatttgttaatatataacagtaaaaactcaatacatggtaccttttcttactgggttggagagtcgactgagagaactagtgggacatttctgattgtatggtaaaaatgttttcactgttgaaggacaatcggaatgttgatagccagtttcagcagcaagttgggctagattaggcaaggctaaaaccaggaggccagggcagcttgagggccagatgaaggttgacagaccaaattaggggggaggctgggtaagctcaggttatggtgtgagaacacatagagatggagtctaccaggagtattaaaattaggaggccgggcacagtgtctcacacctgtaatctcagcactttgggaggctgaggttggcagatcacctgaggtaaggggtttgagaccagcctggccaacatggcgtaaccccatctctactacaaatacaaaaattagccaggtgtggtggccggcacctgtattcccagctactcgggaggctgaagcaggagaattgcttcaacctgggagccggaggttgcagtgagctgagatcacaccactgcactccagcctgggtgacagagcaagcaagattccatctcaaaaaagaaaaaaaattaggaaacaggatccccgcttttctttggggacaccatccaaataactgggggtaggggggaaccccatatccccatataaagaagatgaatatgtgattcaagactgaccaataaaatcactctacccccatgtgatggttaatacttagtgtcaacttgattggattgaaggatgccaagtattgatcctgggtgtgcctctgagggtattgccaaaggagattaacatttaagtcagtgggctgggaaaggcagacccacccgtgatgtgggtgggcaccatctgatcagctgccgctgtggccagaatataaagcaggcagaaaaatgtgaaaagacaagactggcctagcctcccagcctacatctttctctcgtgctggatgcttcctgacctggaatatcagactccaagttcttcagtttggggactcggactggctctccttgctcctcagcctgcagacggcctattgtgggaccttgttatcatgtgagttaatacttaataaactcccctttatatatagatatatatatacacacacacatacatatatacacacacgtatatatacatatatataatatatatacatatatatataatatcctattaactctgtccctttagagaacccttactaatacaccccatacccattagtcatagggatcagagaagaagtatctttgtttttgtttgttctggagttacaaagttgcttggatgaaaatctggggctaccaggaaacctcatgccagacagaagagttggagagagacatactccaatgtcactgtctgaattatgaaatgccattgaacctgaagtcattccctggccttttcagttactgagtctataatttccgtttctgctcaagctggttctgatttttaaacaaaactttatttgcaaacaaaaatatcctatctaatatgtcagtttgtgtgagaaaggataattggaatctgacaccattagtccactgaccaacactgttcaagaatgtgggtgcttataaacacaggattggagagtttggtggggctctaggtgcaaagacgggacaagggcataggtgccagggattcagtcgtgaggaaatggataattcctgcagtagtagggtatcagataggagttttgtaatcagtaaatcagaaggggtcccagataactggcattcaaaggccagaatgggacagtggcaaagctgatgctatatccaacttgaaacaaatgttcttccaaatgccttctgccgtgcagccagatacaaggcagggcttaacctgggattcaggaatgtagacttggggagccctgtttaggagtcccgttgaaaatgaaactatatcctggaataggtccaaatgaaatatgagcttatatgtgaaactgtgcctataaaatacaaattgtgacacagttggatgatcacctaactggtgagcttgtacatatgtattggtgactttgtggagggttttattgactgtgagggtggaataaaggaaatatgtccaccaatttaaggaaaaatttgtggaagcaggatcccaatttttgtctttaggagaagctttgcgttttatctcaaaactatcactttcatcacagaacatttcacatactgaatgaatgccagacgcaccataaaatcacaacagaggcaatgtattgcagttttccaaaattctgacagctgggcatagcactaaaccatttgtcataaagtaagaggacaaacttgaagaccagctcatctcctcctaaatttagtgaggtttgcactaaagaaaaaatatttcctcataacttctcatccttctctaattcagcctctagaaacaattcagtttcagttcaaatatttcttgagcatcaaatacatgcagaggccttacaaggaagtcaaatatgaaaacaccatggttctgaccttcgaaaaatttgcagcctggacctggcatctctcaaaaagagaagagtaatcactttatttgtcacctcatagtcaactctgcaattgaggaattacacatttctttcacacacatgctggtttctgtttttaatcttttatcaatctgtatgtcagagctccttggatacctgatgatttttcttaaatttgcattcactgcagtaattattttttgaatgtctatcaggtattggatgtcagagctgggtgtgtggcctatgtaggcccacaggattcagtgctcagaagggcctcatgcttggtttagtgttctgctgtctcacaattcttaatcatttttgaacaaggaatcccacattttcattttgcattgtgctatggtttgaatgtccccactaaaactcatgttaaaatttgattgccattttcacagtattaagaggtgggactggccagatccggggggcacatgcctgtaatcccagcagtttgggaagccaaaaaaaacagattgcttgagttcaggagtttgagaccagcctgggcaatatagtgaaactccatctctacaaaatacacaaaaattagccaagtgtggtggcatgcgcctatagtcccagatactcaggaggctgaggtaggagaatcacttgagcctgggaggttgaggctgcagtgagccaagactctgccactacacttcagcctgggtgacacagtgagaccctgcctcaaaaacaaacaaataaacaaacaaaaaaagaagtgggaccttcaagacatgataatggattattaattcattgtcacagaagtagatgagttatcatggaggtgggcttctaataaaagataagttcagcccacatttttcctgtttcttcctgtgaacctgtgcacccttctgccttcagccatgggatgaccctgccagatgccagtgccatgttgttggacttcccagcctccagaaccatgagccaaataaatctgttttctttataaattacccagtctgtggtatttggctatagacacagaaaagatatgtagagtctggtaaattatgtagctagctctgctgggcatggtgctaagtggtgggggaacagcagtgagcaggagaggtatccagagggtggcatgaaacaaaaaataatttaattcataaatgaggtaatttcagacaagagtaagacttaggaggaaaataaagcaggaggacatgataaagaggggtggagaacgctgtatggggagagtgagctcctggattaagactggaggtcaggaaagagccagccacaggttagttggtttcaggaccatttctgccttgttcagggctataacacgtggaacctggaaagttctcaactaatattttgaatgaatagaacttctgtttaaaaaggaaaagtaccaaatacagaaaattaattcataatttagtacaaactgggactgaccgataaggaacatttaagtttatttaaggtctccttcaggatcacatgttttagcagctggagggggtgcactatgtccaggaaaaacaaccctgatggaaaagttcattactcatattcccctctagacagaaaaagagggaaaacttttgtgctcggcgaattttcttgttttcttaaccataaatggaaaaacagagatgaaaagaggtagggagagaagcaggcatgataggggtttcctttctgtctgtttcacaggttgaaggccatgacttttgacttggttttaccataaggcacgtgcagttttttaggtgacgcacataaactttgtaaaattgagtctcatctctgtgtttggaaaaatgaagagaaaagggtattcaaagttcattcttgaaatccattttacaaatgggaaactgaagcacggagatgtctggtagcataagtctccccagttgggggtagaagaacaggatttgaacccagggcccatgctcttacaaatggcctttccatttggccattgtagacaaggtggaatgcatccaggggttaacactcaggcattctgttagatttccttcctgtctttctgcagaacctggagttttgttttcccctttctctctccctttgtattcctttaaaaccaaaacaaaaaagtttttgtagtggaaaatttcaagtacacacaaaaagtcaaagaccagtgtcataaccacctcccatttttccacctagtttcaagttatcaacacctggctaatattgtttcatttatattcttgcctactttctgtcctcctatatgtattattttgaagcaaaaccaagacttaagtaatttcatctgtaaataattcaatataaaagataaggactcttttttaaacataaccctaaatacttaaaaaagttaacagtaattccttaatatcatcagatctctagtcttcaaatatccaattatctgattaatgtcttttttccccaagtttgtttgaatcaaaataaaaaaaagctccacattttgcaactggttgatattttccttaggtctctgttaacctacaggttcctgttccatccatctctctctttttctctcctctctctctcattgcaattcatttgttgaagaaactaggctgtttatcctgtaaattctcctagcacctaagttttgctgattgcattcccttggtgtcacttaaatgttcctctgtttaccatggttcctgtaggttggttgagtcccaaggctttatcagatttcagttagatcttttttggcaatactatctcataggtcgccacttgtgttttttcattagaagagccatttctttttgtgacattagcagctgctaatgctcaacagctatatcatttaattaattagaagtggcagtatgatggcattctaattctattatcccttacttactagtgagaatatttctataatgagagatttttttccttatctattaattggttacccagtagtataattcatacaagaaaggcagagaaaatgtttgactctttatctttatttgccagtttccaaaataacgagttgggtactttcaagggtggtcaaagtgcattttgtcattatgaacatatgcatttaaatataatttatgtgtttcaatccattaaagttattttctttttttaaaattttctttactgatattcagattgggccattttggtgagtgagagcctcttcaagccagtttccaagtccttgtgacatggttttagtagtatttgtcagcttccttgctaccagtagtatttgtcagcttccttgctacctgggataaaaagatgctcatcttgtgcatttactactcaaaacctgggcagtgtctgttactgctttttgtttcatttagaaaattacactataaatgatgcataataaaaatacatattttaggtattacagccatgttatccacatcccccccaagatataaaacttttccagaaagctacctctgccaatctttccctacctcccataacaaccactattcagatttctatcacaatagattagtttttcctgttgtagaacttcatacaaattgaattatggagtatgtattttttaatacctggcttcttttactgagcaaaatgtttttgatattcattcatggtgttgcatgtattagcaattcattcattttctgatcgctgagtagtatccattgcatgaatatagtatagtttatttatctcctctcttgttaatggaaatcagttgttctcagtttgggggtattagaagttataagctatgaatattcttttacaagctgtgtgtgtatgcatgtgtgtgcacatgcatatgttttcatttctcttgaataaatgtgcatgaatagagctaacagatcataggatgaatgtacgtttaactgccaaataatttcctaaaaggtcataccattttacactgccaatatatgagagatctggttatcccacatctttgccaaaatgtggtattataggtcttcttaattttagttattttagtgactgtgaagtagtagaagcatttgtgtttaagtgactttttgtttgcacaggtataggtttaggtgataattgtagattaataataacaagcacttatatagtacttcatatgtgccatactctgttcctgtttattataaatataaactccacaataactttgaggtcgggactattattattatctccattttacagatgagaacactgaggcatagagaggttaaataacttacatgaaatcacagccaggaagtagcagatgaaggctttgaacctacacagtttggctccaaatttcaggctcttgacttgtgtgctcttctgcctctcacaattgttaattggaatcctttccagttctctagcatttcactgagacactggtaaatatttctggttaagacaactatcacgaagtcaggagctcgagaccagcctgaccaacatggtaacaccccatctctactaaaagtacaaaattagctgggcacggtggcgcatgcctgtaattccagctactcaggaagctgaggcaggagaatcgcttgaaactggaaggcggaggttgcagtgagccgggatcgtgccactgcactccagcctgggtgacagagtgagactccatctcaaaacaacaacaacaaaaagccaaccccccccccaaaaaaacaaacaaaaaacaaaaacaaactatcatgttaatttaaaaatcccatactttttaaaataaagaactgtgaattttaaacaatttctttctattcctgcccatcttattctgaacttaaacattttccttatatcagcacatctccaatttttattatatgtttcctaaaaagtttttcattttgaatacttttgttgttgttgttggacaattcttctataagtcctgaccttcaagtcctgagcttatattgtatcagaatgctttttacagtaaaaaaaaaaaaaacaaacaaaaagtgaaaataactttaataatatggatctatattctcagtatctccaggtagggcagtgccaaggttggtgaggtcaacagattagcaatatcgtaaaagtcccaggcttcttctatttttccacccggcccattcttcttacgtaacattccctcatggttgcaatatagctgccatccttgaagctctcacatctccactccaaaaaaaaggatcacttctttttaccatgttttttttttttttttaaatagagatgggtcttgccatgttgcccgggctggtcttgaactcctgagctcaagtgatcctcccatcttgacctcccaaagtgttgggatcataggtatgagcctctgcacctggcctccatgcctttttttttttttttgagacggagtcttgctctgttgcccaggctggggtgcagtggcacaatctcagctcactgcaagctccgcctcctgggttcacgccattctcctgcctcagcctcccgagtagctgggactacaggcgcctgccaccacgcctggctaattttttgtatttttagtagagacggaatttcaccatgttagccaggatggtctcaatctcctgacctcgtgatccgcctgccttggcctcccaaagtgctaggattacaggcgtgagccactgcacctggcccagccatgcctattttcaagaacagacagctttttaagaaatggctccccattgaccagagctgggtcctatgtttacccttaaccaatccctggcagaggaataaggtcatcatgactagcttcaaccacagcttcaaaaccagtgtactgaggcaacaggtgtactgagctattggtcttttcaggactggaggcagccagagacaatttggtgatcacctccagcctgagcagcttcttccatttactccaggtgccacacaaacactatcattttctgtgtattctatgacatcagagaaagtagggaagcactgggttagagaccaatcaatcagtatttacccaagttatatgggcaagggggtgatattgatccctgaaccaaatcaggcctctcaggatgaaagaagcaaagaatggatgtttaaatcaggcttagaaaatgaacacaaaacaagagaacccacagggagcaaagtaacaagttatgtcacgcgactatcttgcctgtcccactcacctcagttactgccttgatgattctgacttccaaacatcctgtccttttagctcaaactcagaagacaggaacatgcaagtttagccaagctgaaccaggggacagacagaggacaagctggccccttggtggccacggcaggaagcatgcgctgggacctgccattttgccatctgcctggtgggcacctccagaagggagactgggtgctaatggtatgccagtggtgagtgagcagctaaaaaatatgacaaaaacattcattgggaaacttcctgcagcaattccagtttgcctctgagtcagcctggctctggttaaagtctatatacaaacaaatctgtgggtcaacccatcttcaccctcagggcactatctccagaataaccatggcattaatgggatcagcagtttcaatcatctcctgagtaatcagttctggtgcctccccaaatgagacaaatgacagtttcatggtcgctcgtggctatgaaatctcatcgagacaattcgactctggttaaattatatttaagttaataaatatgaatttagatggccaaagaagctcaaaaacccctgggcatctaagacaaaaaagaaaaaataaatggtgcagcattctgttctcctaccccaagctttctcacttgtttttttaaaaaaataaataaaggccttggtgattccttctcagttcatctaaatgaagtttaggccatttacagaagagataaaacaaaattgctgaaattcactaaacagtaaaggaggaaaccacaatatgaaaccgaatagtatagtgattataaaaagcaataactattctcagccatttctaaagcttaagattttagtgcataacagagaggctgtgtgaacatctatctttatggcacttgggttttaaccagcaatgctctatataaacctattttaactatacaaggaaattccatatcactctgagatgacaaatattctctaggagactaaaacctgctctcaagtctggctctaaaattgttctcaaaccaatttatactgtgacaaaacacagtatgtgtttcccccaatgttatcgggcaagaacaactccagtattccaagtatcatggtccttaagaaagttatggaaattggacatctctactaataaatgaagtaaaataaaaacaaataaaatgtacatttttggccagcagactggtataaatcaaagttgctagctagaatgtggacaagaatgattcttattcacttggtagtagcataaatagatacaacctttgttttttttcttttttttgagatggagtcttgctctgttgcccaggctggggtgcagtgaagcaatctcgactcaccacaaactgcctcccgaatcaagcaattctcctgccttagcctctgaatagctgggattacatgcgcacttcaccacgcctggctaattttagtattattacagacggggcttcaccatgttggccaggctcatcttgaactcttgacttcaagtgatacacccgcctcggcctcccaaagtgctgggattacaggtgtgagccaccgcactcagctgtggaattttcggaaaaccaaattccttccaaattccagcaatatcatttcaaagtattcacttcacagaaatgctcccacaaatgttttatgtataagaatggttactgtagcattgtcttagtaaaaattagaaacaggtcaagcatggtggcttatgcccgtaatcccagcactttgagaggctgaggagggggcagatcatttgaggccaggagtttgagatcaatctggccaacatggaaaaaccccacctctacaaaacacacacacacacacacacacacacacacacacacacacacacacaaaattagctggtcatggtggcacaggcttgtaatcccggctacttgggaggctaaggcaggagaattgtttgaacccaggaggcggaggttgcagtgggccgagattgcatcactgcactccaacctaggcaacagagcaaggctctgtctcaaaaaacaaaaacaaaaacaaaaacaaaaaaaattgacaacaacttaatgtccatcaataggagactgatgtaattattaaaaattaattatggttcattcataccattgaatatacaacacttattaaaaataatgacatatatcagtatgtaagacatgtaagtaaatacattttagaataaattatgtggggtgatctcacctcgtgatcatggtatctcccctgccaggtaagtatagggtgatctcacctctgtaaaaatttatattataatgatatgatatgtatgtcactataggtttagaaaatatctggcaaatatatgccctgttaataaccattaaagaaccttcatgttctaagccatgcatatctctaacaattaaatttattaacatatgttgctttaatgataaaaactctatagttcttaaaagagcacaaacacgaccttttttttcaatagtattcatatcaataataattaatagtctttgtatttttcttgttgttttgttttgtttttagacagggtctcactctgttgcccaggctggagtgcagtgggatgatcacagcacactgcagcctcaacctcctgggctcaagtgatcctcccacctcagcctcctgagtagctagaactacaggtgttgccactatgcccgactaatttgtattttttgtagagatgaaattttgccatgttgcccaggctggtcgtgaactcctggactcaagtgatccacccatctcaacctcccaaagtgttgggtttacaggtatgagccaccgtgccaagtgaacaatcatttttaaatggacatactagacaaacacttggagacactactaccttctggcactgtgtgaatggacacaaagttaaattaaacagatctttattctccagaaatggtctacacaagagcctggatcaaatgttttgaataggacattttacaaaattgtaaaaatattatagatattcttgctataaaatatttgatttcagaataatatgaaagtaagagaagcagaaacttctccttcatccacttacacttcccagaggtaaaaattatttattaataatttgggctatacatgtccagccccatccctccacacatacatgaacacatacatacacacattgcttgcatatatccataacaatacacatacatacatatatacatacacatgtacacatcccatatattgtcttgtactttgtttttgtttttacccaaaaaatatatcattgacaattatctgggccaatatttttgtttttacccaaaaaatatatcattgacaattatctgggccaatatttttgtttttacccaaaaaatatatcattgacaattatctgagccaattttcaactccattctctctcctgatctcatagaatcccatagtaccgaggtactgtcatttaatgaactattctgtttattctcactgctttgctatttgaaatatgaaaatatgaaaatccttgcacgtgcgccattacatgagaatgtccttaggaggatttcctgaaatggaaatgcttggtcatagagaacaaatatcttacattttgactggaaacaactagactgtgctataaaaaggttgcaacaatttatcagatcaatcataatttaatgcttctgctttaaaatatccatttcctctcattcttattttaggtaatttcacctatatgacatatatcagtatgtaaaacatgttatagtcccatttctgggatgcttttccttctctctttttttattttacctcttttcgtggccaaggcctttttctaaactataatttattgagttcttttcatgttctaggcatctgtttaagcagtcacatggcactctcccatttaaacccgacaacatcacgagatatcatgttcccattttacagatgaggaaactgaggctcaaatgggttgagaaacatgctctgagttacccagccagtaaaggacgtgggccagcattggaactcataccacctgactccaatatccttagctcccacaggatatgtgcaaatcacacaaaggaaacagataaagctgttcatcccattacaacatctattagaacagactgatgacattagacagcagtaaataatgaatgcagctgctgtggctgaggaaggcactgtggtttcccaggccacatcctctgtcttttttctcacagatccctcaagcctgtgcctaccccccttgtcgttcttggacaggtgctttgcatacttcttgaacaaatgcaattgccacattttgagtatgtctcactcttctgccttacacttgatactcagtcctccccagtgaagtagcccatggcatactcccacttcacagacaagccaggcaagccaataatgtgggagcttcagcacataactctctggagtgcagtggtgcaatcacggctcactgcaacctcaacctcctgggctcaagcaatcctcctgcctcagcctcttgagtagctgggactacaggtacacaccaccatatctggctaattttttgggtattttttgtagagatgaggtttgaccatgttgcccaggctggtcttgaactcttgggctcaagcaattctctcacctcggcctcccaaagtgccgggattaaaggcatgagccacagggcccagcttgttttcttctttttaatcaaaggaaacagatgaagttgtttatcaaattttcatttgctaaacttcatcaaaattaatagtaattttctaaagaatacacctattatggagtctaaccatattatttgcactgatgatttcagagtcatactataagtttaaaagtaatgctgaaggttggtggaaaaaaagcgaaagctatctttagtgaatatgttggctcatggttttactttctggaaaaacttcagatacacagtcctatctatacataaatacatacatgtatttgtacatttttcatatgtcatacattaagtatgcacacatatttatttcttcatagatttaagcatgacctatttagctcagagaaaaaacaaagaaaaggccaggagaaaagaaaaaagggtagaaagaacataattaaatttgatttacttaaaacacaatgcacagataaaagtgtggtgaatttttgtaacctaatttagtatataagcctgaaaaaattaaactgatgcaactgtgtgctgaataaaggagactgttcagattctggcactaacatctcaagaaaaaaaagatttttgaaactcagagttggtttctgaagtttattgaaggaaaaacacattcactaaaaaataaaaaaatctcattcccaaaaagaatttgagagcaaaatcttatgagctcggctggaactatatctggcatcaatacctagaaagttcaaaatataaaaatcctaaggaagaaatagcttcataaatttaagtatgatttgacagttaagattctttgtatcctgaccaaaattgtttctaacttaaacactgaattcatttaaaaattggtagtagcctatttattaaaagaaaaggtactttctcctgagaaacatttgggaaatacctggtatgacttttttctttagcaatgatgatggcagattccgtcattatttgatggtgctaattagacataataagcagctcttgtaacttaaagagtcaaattctctctatattgtctgtgcttgcagaattttgaaaagcttgaacacagccaaagagttggggaaagcaagcttttaattaaacactaataaaggccagaaataaattttgcttttgcttttgttcctgtttttttttttttcttttgctcctaagaatccaggaaaatccaatcagaagggccgttcatcctttaactccagtggatgggaaagacctgagacagggtcagaatgattaaaaaacgtacatagaaatgccaaaaaaaagagagcaaacggtctgaaatgtctgtcaggaaaaacagggcaccttccagagcccaaccacagggccgggtgcaggaaatagcgatcgcttgacactcagggctgacaagaactgcagaagctgccaaggtccccgccctgggctgggcacgggtgggtacttgcagctggcagtacacacaagctggtgtccttgagggagcccactggcaccagggttagaggaaataagctactctgctatctaaagcaatgcttttctgatgaaatggtcgttagagaagccaaacgaatgtattctcaatcagcttacactggcgtgggctattttcaataatgaaaaagaataaacccacacatacaaatgtatttcaacatacatggctttttccccacatgaggtttctaaagcttcacggaatgcaaacgttgccttcgggcagagttctgctaatgctgctttctcctcctccaaatgcttggtgtcttctcatatcatgtgctgcctctacccttgcccgggtccccatcgtctctcagctggagatctgaaatggcctcctgaccgctcttatgccttttaagtcattctccctagagtggctggagcaggcttcttaaagtgtaaagtagattcatttgttcatttaatcaacaagtatttctgaagcacatttttggttccaggtgctgttccaggcactgaggattctaacagtgaagtcccctgcatgccttcagctatgaataacgttctggcaggggaaatgagcatatgaacaaatatattcatagagtcaggtggtgtggtgaaaaggattacagtgaaaaataaagcaggctaagacatggttgggagtcacctccctggttggggtgacatttgaagagacctacaggaagtgatggggtaagcatcatgtagacttctcaggaatgagattccaggcagacaacattctgtgggctacaactctgaggctggaatgtgcttggcaggtttgagggacagcaaggaggccagggttgctggagaagcgttaaagaggggaagggtgctgggagttaagaccagagtttgggtgtgtttgctggaactgaggcaggagttgggaggagcctaggtagaaggaatactgatcacacagacacacaggggccttgtagagatagtaaggccaggttgtttctcagagttgggaagtcattgaagggatctgaacagaaaaatgacacgatctgacttactttgaacaaaatcgcactggaggtggggttgagaaaacactgcaggggcggttggcatttgcagagagaccagttaggaagctattgcaacaaaccagctaagaaatgagggtggcttggccccaggatcatggtgatgaagatgataagtggatatatagtttgaaggtagagccaaagggatttgctgatgggttagaagtagaatgtaagtgttgaaaactagccaaggttttcacttcagcacccggaagaatggagttgccatttactgacaaatagctgactacaaagtacgctctgagagggcagagcttcttgttggtttcttgctgtatctccactgcctcgaccaggcctagaatgtaataggccctcagtatatatttgttgaaatgaatgcacaagttatttccacatttgaaacatcttcaatggcttcccaccacacttactgcaaactctagaacaccagggcaccgtgtgatctaatctctgctgccttgccaaacccacctctcatgaccttaacatttcttgcaacactttggccactccactgtgctctccattcctacaacatcctaaggtctttcctgcctcagtgtctttgcgtctgccattaactccacttggaatgctgttctccttggtctgcacgtgccaagctccttctcatcctttgagtcttgacattaataaaacctcggaaagaagccttttgtcacatttctcccttgccagcttcatccccagtggactctgagctccacaagggcagggcctacctctgtctgttatgctgttgtatcccaagtgcccagaaaagtgcctggaaggtaataaatattgctcaataaaaagtgctttaataaacaatgaggctgggtgtgatggctcatgcctgtaatcccaacactttgggaggctgaagtgggcggatcacccgaggttaggagatcgagaccagcctggccaacatggagaaagcccgtctctgctaaaaatacaaaaattagctgggcgtggtggcacgcacctgtaatcccagctacttgggaggctgaggcaggagaatcaccggaacctgggaggtggaggttgcagtgagctgagatcatgccactgctctccagcctgggtaacagagcaggactccgtctcaaaaacaaataaataaataaacaaacaaacaataaatgatgatatctgatagaatggtagtttaaatgatgatatccagtgtgtattatggtccactctttttaagcattatatatgtgtgtatatgtgtgtacatacctacatgtatacatacataaatattcatttatttttcaccattaccttagaaggcaggtataatattaatatctccaatttaaaaatgaggcacagacatggagtaacttgcccagggttatacacgtaatgggtagcaaagctgggatttgaactcaggcagtgtggttctagtgtctgtgcacttaaacccctaagatttacaaggattcccttgtgctgatgcaaacacctccatgatttgactttagggataactggggtgagaggaggagagagaactctcagccaggtgtttgtagatgcttgcatgtttgcaattagaaattaacaacttcaccaaagactttttcttcttttgaagtggaaaggctacttaaagaatagatgtggcagttttaccgaccctttttactttagtttaaatgagtttatcaaatccagctatgtttacagagtttggtagagggagagattagagactaggagagtgctagaaagaaatgtaggtaaatgtagaaaaggaagaggctgactttaggtaagtggcaaactaagttcatctcattcaatgactcaagtggatgagattaggatttagacacatctaagctccaatctttgctcatgaacaaattaattaacaactgtgaacaatttctatatttgccaaatgagtttaattatacctatttaacatcattagaagaattaaataaaatggtgaatacaaaatgctcagcactgtgtctgacatatagagaaatgtttattaaataaatataactggccaggcatggtggctcatgcctgtaatcccagcactttgagaggctgaggtgggaggattgcttgagggcaggatttcaagaccagcctgggcaacaacaagatcccatctaaaaaataaaaaaatacaaaaaattgctgggtgtggtggcgcgcctggagtcttagctacttgagaggctaaggcgagaggatcacttgaacccagaagcttaacactgcagtgagctatgattgcaccaatgcactctagcctgagacacaaaataagaccctgtctcaatcaatcaatcaatcgattaataaatgcttaagatgagccaggcagcctagtgaaatcttcatttagataatcttgttttgtcccctcaccaaccctggtaggtaggcactattatttcctcatcttacagaagataaaatgaggcaccaagaagtcaagtaacttgtccatgtcacacacctattaagtagggtgtttgggcttaaatcctggtcagagtttgcactctagcatgataacttttggcttaggatcaagtctttgcaaggggtccaaatttttacatttgaagagctactatttctccatcaatgttatctttaacctttataccaaacttaaaagatcttattttatctttttataggtaaataaacaggcttagaaagggtaagcagcttggctcaaggtcgtatagccgataagtgatggagattttatttttatcccaggttcagctggctctagcccattctatttccctattttatcaaggaccttttctctcttaggtaataagcatctaatcgaattttaatgagacaaactaattcctgtaaaaatatttgctggctacactacccaagggtagcatgatgcttataataaccaggtcttcttagcagttgcaaatctcagggtcagatcagaggacagcttatacagatgggaaagatagcagacatggggtcctagagcttttgtgcatgaggatatcgagttcttagtactatggagtaagggtcagagttaggaggaagaaaatttaacaatttcctgtcagagagacagaaataaagcaactaaaagttgtaagcatgtttgcttttctagtataaaccagacagtagcattaagaggctagtgctgcctcataaaatcctgtgccataaaaccatgtgcccacagtgtgtctacacagtggtcagtgggcccctttcctggtggccatccagtctacaattcttcatctgggtggtgagaggaatgagtcaaggcttctgcaaactttagaagcttcaaaggttaagaaattacgtgcataagaaattatgaacaatgcatacgtgaagataatttgccagacatccatccaaccattcatctattcatccaattgcctacccaccaacccacccacccatccaatcatccatccacccacccacccacttacccatccacccatccaagcatccatccaaccaaacacctacctatctatcctacctaccattcatccatccaacatccatccatctaacaatccacccatctatccattcatccacccacccacccacttacctgtccacccatccatccattcatccatccaccccatcccatccatccatccaccccatcccatccatccatccaccccatcccatccatccatccatccatccatccatccatccatccatccatccttccttccatccatccaatcatctatttaaccaagcacccatctattggtccatccatataacatctaacagtgtttttagtgcttttaaatattaatacatttaacttttataaccatcccaagaaaataactctttgatgtaggcactataattgtccacattttacagcagaaaaaaatagagctttagagaactcacataaccagtaaaaggtgagttacgatttgaattcaggcggtttgagttcatagacttcatctttaagcagtagactatgtttccatccaatattttttgagtgaatgaacaaatgaacaaatgaaaaaattgtatctttatgtgtcatttctcttaaaataaagcagcaaatttgtggccagaggctgagtgttagagtcagctagcatgctattcaaattccaacactgtgacttattacctattataataagtacataaaatcaataaaatggggttcataatatcatactgaagaggataaaggcacaacatctaataaagtgtgtaaaatctaggaactctccttttcagtatacaccatacagaaagtcttgctcatatgcacaaagagacaagtacaaaaattttcactgtactgttatttggaaataacttatgtctatcaacaagagattgatatattcatgcaatgggatatagggattgaaaatgaatttagagataaatcccaaaaacttactgaaagaaaaataaaagcagcagaatgatgcatacatatataaattttacagacacacaaagaattatatatattgtttatagatacaaacagatgtgacataattataaaaacatgcctgggaataaaaaacttcagggcaggattttctagggagtgggaagaggtacaaaggaggtttcaactgattcaatataattttattatattacaaaaaagtaaccaaaacaaacatggcagattatttgtaagatgccttaaacagtgctgggagcatagatttttccctatattaccttttatatttctgtatattgaaataagtcctaaagttttttattcttaaaggtagcacatgcaaagtgccaagcataaggcctagcatatagaaaggcctagcatatagcagctgcttaatatctagtagctgttactcaagtcaagacagcaaggttacataaaagtaccagttaaaggaaaaacagctatttaagcaaaaagctttacctaaacacacacacaaaatttaagagacaaaaaaatgactaaaaaggacattaggggaaaatgggactatttaatttaccatatttgctagcattttttatagcaaaagtttatttcaaggatgccaggatgtatatctgttatgtatgtacatatatacacaatatatctattacatatgggtgttaattttaatttttttcatgagagcttaatttctgtctgctttccatgttgtaagtcatatggtcttgtttataaaatttagaactgcagatctgattcctcatttgagtcattcagacttttccacaacaaccaactgggacaacaaaaatataatgttcagaataaacataagtaggggatgaatgagaaagttattttatgctacaagctccaccaagaaaagatggaatgtgaaaaacaaacactcatttgaagagtccggagagtccgttcttgatgcttttcaagctgtgcaacaaaggttcaaaaatgcttttcaaagaacctgggactaattttgttgagtttaggtgacatgtttcttttagaaatttctgtcaggtgatgagctaaaaaattaagataaaaaattaaaaattagtttttgggtaccttagcatcttagttccctgccataaaatctttggttaccagaaaaagtagaagattaattttctcagtgataaatggactcatttcatttatcacccaaattttctctcctttctgtatgtgttaatcactactataatggtaagtagctgagtctgttgtggtccaatcccttgaaaaaagtgtagcaagcagtcaggagacctctctgaaggctggctgtgttttaaagctagattctacatcctcacatcaaggcaatctcactcttcactttcttcctgctgcccttgcttcagtgcaggctttggtcctagcacctgttggggaggcacccgtagaaggtgcttgatgtgttgcccaaacttatttccccagctgttgggagtgttgtgagcagacagatctcaaacccgtctggaaatcgcagtcccttaaagagagctgcctcctccaaggtcatcccatcccccttttcaagggtagcccatctccaataatgggttaatgaaggtggggagaagacctacccctctcgtaacaacctgggacaactctcagcttcagagctacctgggaggtcagctgcagtttttgttgagcctgaattctagttcaacttttccctctgcttaatcctacttcttcttcttcttttttttttttgaaacagagtctcactctgttgcccaggctggagtgcaatgacgtgatctctgctcaccgcaacctctgcctcccgggtttaagccattctcctgcctcagcctcccgagtagctgggactacaggtgtgtgccaccacacttggctaatttttttttttttttgtatttttagtagagatggggttttgccatattggccagctggtctcgaactcctggcctcaagtgatctgcccaccttggcctcccaaagagctgggattacaggcttcagtcaccaatcctacttcttttttattcccttctccaggtgtaggtcctcagagggctctctaataaacttcctgcttgttaatctccatttcagagtctgctacctaaggaaccaaatctgtgtcagcattcacgctgttctgtggcaaggcagaattggtttgcctggcccctttggttgggtgggtatgtgaccagttctgccaatgactgagaagtgacatgagccacttagaggccaagcatttaactgctaggaccagactctgaagagctcttcaccttctatcagggcacctggcaatgtttaggaacattctgtgggcctgaatgacagtaatcaaccaagcttccagccaaccagtgattgaatagatagtatgagcaaaagtagagaaaattattgctttaagccaccaggatcctggggctgtttgttgccatggctaaccccatttatgctgactgatacactgacatcactacaacagcctctgagcttcccttgccttactgcttccctatgcaatacttcccaagtctatccgcctcacggctgccagtggtatttctaaatcaactccttccttccccacaaagatctccccataaacatcaaaattctaaagtacagggtcattcaagttcaggcattattctcaatcaaaatctctctgtctttgtctctctactcatcaaggttaaaaaaaaaaaaccaaaaaaccctcttataatccccaacaaaagtcatgttccatgcctgaaatacccttctaccttcctcctacttgtccttcaaagaaaggcataagagtcactccctccaggaagcttccttggtccttcccttttgcattattcctgtctggtttagactccctccactgatcatctaaaaaggcaaagccctttcatagaccttggtttccttaactgtctcccttacatgaaaatacattttctgaaggcaagacaaaagtctattttgattttgtgtttctaacaccttggcatcagaactgagacttggtgagccattgacaattatttcaggtatgaatgaacaaatgaataaatcaatctatgactccaatcattatattttacagagaaggacctagtaaaggtaaattgagcactcatcttgaacatttgttttttaatttctaagtaattatatatatatattttttgagacagggtctcactctattgcccaggctgaaatgcggtggcacaatctcagctcactgcagctttagcctcccaggttcaagcgttcctcctgcctcaaccacctaagtagctggggctacaggcacacaccaccacacccagctaacttttgtattttttgtacaggtggggtttcgccatgttgcccaggctggtctcaaactcctgggctcaagtgacctgcccgccttggcctcccaaatgctgggattataggcacgaggtgccacacccagccacgcctaggtttttgatgagaaaatttttccatattcctttaagttctgtttttctgtgatagaattatggacttttcttcctctagtattctccaccttttttttcttgtctggggattggcaaactttttctgtaaagggctggatagtaaatattttcagctttgtgggcaatagttcttgcatcagctactgaactttaagtagttcagacacaactgctcaatcttgccattacagtgtgaaagcagctgtagacaacatgtaatggatgagcctggctgtgagccaacaaaactttatttacaaaaacaagaggcaagcccgactttgcccgcaagccatagtttgctgactccctttctagtccaactaatttagaagactgtggagagcgaagggtgagagcaagcaaactgtatacagtatgaaatgtacaagggctcaatagggaattgtcctttggaggacttggcctttgcccaccaatgtggtgagatccagagttcaggcattaccagtttgtggatcattggagtcttggatatagcaagattgtctcttcagagaccctagtgggagatggctgtgaccttctagattttaactgtgggcttagctaaaagagcatgtgctctaccgtgtggaacacagtccaaatacccaaggtccaccccacacacgctgctgtgggaaatttcacagtctctcttactgagcatcctcaggaaacatgtaaaaatgggaatgtagtctcaccaagtccaggtgagactagaggaactagtctcacctataaaagcaatagtaatgcccctagctaccctctatcaagtaccttctctgagttcagtattaaatcctttacataaaccagagctaacatttattgagcatttgcttgtgccaggaacagtgctaagtgatatatatgttccgtcatgaatttctcaccctatttcataatgcggctgcttctgttcccccactcttacccaggaggaaatgaagttcagagagggaaagcaatttgtccgaggtcaaatttgctcaagttgagcctacagactctgccgtgttctgtgctctatgctaccccctcagggacagctacctgcctcaggggagctgacccagcctcttattggtcacttaaatatcccggagtctgtgcaagttgcctcctgttggaggcaatgactcccttcagggtttgcaagaaattctatctttgggacactggagaggaagggaaaacctaatcccaaggaataaactgagggttttgttagaacatgtcacacttaataaaaagcaaagggtgttgattatttttttctgtaatattctgtcatcattttccacctaagttgtttgtgaaacctaattaattgctataacaaaacccatccaggcaagatataaggaggacagggatatggctgatgaatcagcttttagcatttagcttaaagtgaaggtgaatgctcatgtctgctactttagccaaattcaaggcttcactcataaagtaagtctttgttcaaggcagcctcaatgcagcctgagcctgctttttatttagtctcattactacagaaataccttatagctagtatcttaattattcatggtttgttggcaaattaagtcacttgcttctccaatatctagaaatggaagaagtgttcaattccaaagaaattatgccttcctagctttgctagcctgacaataatgttgttggcaaataccttatgaataggtgggagatcttgtttcacttatagtatatgaataaaaagaacacccccaggagactgacaggtatttcatgtaatggatacctcccttcccaccctatttctctctagagtgatgaagctttggctttccttacaaacaagactattcagactagaagcaagaaaaatgacacctttttatcaacaagatcatctaaaatttggttcagtaaaatatgtaactccctggtgtgtgtgtttctagtccatatgcctgaaagctgagcagtgcagtggaacaatcccctctctgatttagaattcacaattatgggatagcaaaggggtaatcttatgataagccccttaactcaaattcctgtggcaaaatacatacaaaggtatttgagcattaatctttgtacttatcttgaaaaatagctaatatttttatgtaaagagcactagatttgatattctaatgatgcagtgaacattgttggttgcatttcagccaaacattttgcctttcctccctggcagctctgtggtctgagtagggccaacctcaatcctaggttcagaaatgggtcccttcccctctagcctcagcaaatcaatgcaatccagtgtttcttaaccttttaattcattgttatctgcttaaggagcctttttagatttttgtttgtttgtcacccctcctattttatttcattttatttatttattttgagacagagtctcactctgttgcccaggttggagtgcagtggtgtgatcatggcttactgcaaactccatctcccaggtttaagtgattctcatgcctcagcctcccgagtagctaggattacaggcatgtgccaccatgcctggctaatttttgtatttttagtagagatggcgttttgccatgttggccaggctggtctcgaactcgtaagctcaagtgatccactcgcctcagcctcccaaagtgctgggattacaggcatgaatcaccacactcagctactttttgtatttttagtagagacggggtcttgccatgttggccacgctggtcttgaactcctgacctcaagtgatctgctcaccttggcctcccaaagtgctgggattagaggtgtgagccactgcacccagcccaatccctcccattttaatgtcacagatatgctgtatttctgtttatatattgcatgtatattcgtgctttataaataaaagtagtgaatttttttcccacccccctcctccaaaacaatttttgcctcctttgggccatttcactctcattgagaatgcataaattgtcatcccatactctgtgccaatcagtgcatggcatcaggagtgggtacagaccctaaattggagttccagcatgtaaactgggacttttttttttttttttttgatagttggaggatatgagaaattctttctttctggatgtgtggatataaggcctgaaactgctgtgattatctgctattgtgagggaagaaaccagctgaagataaagccaacacatcagcaagaccaggtctgaaagcatggtaccctgatcaaacaatacctaaagttcattctactgctagacttttcagctgtgacaaaagtcatttctttttactctgtaggcaagtttgaattgggttttctattataataaaaaaaatcctaactcatggaaaagataacatttattggatgctttctaaactccaggcagcgtgctaaatatctcacgtcaattaattcttttatcaatctctgtgattagtactattaatttctcattttataaatgatgaagctgaagtatagtaagattaacttacccacggtcatacataggcaaagactggattaactcccttgtctatttaacttgcagttactgtcttttagttctacacaattaagtcactactttttcacttaatatttgaaaagcattaaaaaatgatcttcctttgcaaaggattatgttgcacaattaagaatattcaaaggctgaaaatatttttgaaaatcttatttttgcaaaagcacaggaaatattaaacttagagatcattttcttctgattctgtattcataaaagcctttgttatttattttcattgatacatattagatgtacatagttcgggggtacatgtgataatgtgacacattcatataatcaaagcagggttattgggatagccaatgctttaaatattttaattaattaattttttagaggaggtctccctctgtcacttaggctgaagtgcagtgggacaattatggctcactgcagcattgaactcctgggctcaagtgatcctcctgcctcaacgtcttgagcagagagaaccacaggttcatgacgctatacctggctgatttttaaattttttgtagagatggggtctcactatgttgctcagactggtcttgaactcctgggctcaagtgatcctctcacttcagcctcccaaaatgttgggattacaggcatgagccatggtgcccaaccgttatcttttcttcgtgctagaaacattcaaattattctcttctagttattttgaaatgtacaattgattaaagttaaaaataaggagtggggacttattttttttttattttttatttttttaagagatgggtctcactatgttgcccgggctggcctcaaactcctgggctcaagggatcttcctgcctcagccttctgagtagctgggattatagacacacagcacactgcctgactaccaccattattttagatgttcttatcaattatgatatggtattggctcagtcaccatccattttagagaaaagaaaaaaatacatatattttagtagctcagtgtctcaaattgctattctgcataaaaattatcagtcaaccttataaagaatccataaggtctcaggtttctggaatctttatttttgaattggtcagtaacagtattacagataagccataaatcctctgaatccttggggagtgaggcacagagtcactctggttggctacaatatttgcgttccctttttgaaagtttctcaaacactaaaaaggaaaaacaaaattacataaggggcacttattctacagaccaaactgaacagggatttcccaagagaggaaaaaaaaggcttgaaagacagacacacttctggctccaaaaagccagagagctatgtaatgtggccagatgggatatatccacaattccctaatactctcaaactcccacatgctgccctggttcccaacctgcctttcagattccatttcaaaatgcaagatatcacagatatgttatacaaagcagaagcagtgaaagcacaagttcaaatgttcctcatattttaacaagggtgacaaggggacgctgactctttagacttccacaggctaaccttaggtgctggccttttcattttgcctgattgatggaagattatggtttgtcaaaatcaagtgcttgatcatgtatgagacacaatataataagacataaattctagacatattaggaacagggtcaaatggggggaaatccaggaactgcaacaaagctattccacatcacaggaaagaaaatatgatattatctttccacagtagacaccaagtatatttctaaacaatgcagatttttaaaaatctcaaatatattaacaaccaaagcacagaacttttaaattcataaattactgtctaaaaaaaaaaaaagaaatccaggcaaactgcagtaccagagaggatgaatggtctcctagttgagcaaagttgctgcattttttgcctgcaggatgggaccgagcagagaaataaaggggctgtgttgtgtgacagggagtaaatcctaacatgagcattccaacgtgtagccgggccacccctcccttccccagcctgtcatcctcctgcaaagtgttcacaatttgctgtccttccttccaaaagccagtagacacagaatcagcttttcctggctctgccttacaagttggggctgcctgatggaaaactgaaaatccaacggaaggataaaaatccaccaaggccccctctgccagcaaattggtgtgaaaccgttgcttcagaagcagccactcccacccccaatgaaattaaaaagaaggactcatttgaatgtctaagtggctttctgaagaccctctgttgcaaagcaacagcctccctagtcaagcgcccgccagtacaccattgctctgtaacagatgtctgcaaacgctgggactatctcgcaagtgccccccatgcccgatttgaaaaattcacaagctctgtcaagcaataattacctagagctgctgagcgtttgacccaagggccaagcagtctgctaggagtttaagaagagctggggggaataaaatcatacaggtggagcctgcttcccacgagtgcccggcatcctgctggggccctcgggtgccgcgcgctccagctcacctggtacacgtcctgcagcccgcaccacgtccgcagcacctggtggcaagcccgcagcctctccgtgtaccatctccgcagcgtggacacggtcaagttccatacgaagcggctgccgctgaacagcaggtcctccacgccacacatgaacaccgaagccatgcctcctccttcgctctgaacccgggcgtcccggctctcgtacgtgcagccccgaccccagcggcctgcccgcctgggctcccgacgccggcttctgctggcagccggggggtcaagcctgccaccaaactcgtctttcaccgtgcgtcctggccaggctccggcggcatgccctgggattgggtgcccgccagccaacggctgcgactggcacacagaagcccagtgtccacccccgcccgctcgcagcgccgagcaagctgtgctaagctccaccaagctggccctcgatgctcccggggcacgggaagccctggccggcgaggactccccctggcgcttccccagggcgcggggcagggacggaagcggagcaactctttgcaggcagagaggggagctgcatttcagcacacttggcttccacgtcttgcgcgcgcgcgaacacacacacacacagacacacaccccccacaccggacgagtggtctcctaatctgcctcggggaacaccttactcatcttgctctgttcacactgataaaacacctctgggcagccacagatgcagaagagagagagagaaaaaaaaaaatctccaaggcatccctttggaccctactcctgggggaatagccacgaatgtttccttggttctgctggaagcaggagatgaaggcaacagtctcaaagcaacaggcggccctagaacctgcctttgctcctaacttgagggtctcagagaaaatgacagcctcctgtggttgccagcaggaaggcaggtttcctcacaccaagatgctgctaataccaatgcagcagtcagggagaaaaacagagttcttggtcccttgtaaatagcttgccgttactagtgctgggaaacagaagcccataagagaatcggtggtttagttctggaaaattcagcctctggacatgtctaacctcacctgcaagcaccaacctgcatgggtagtttattctcccctcaaaaccaaaggaaactgttccaccactcatgaagtcactagataattaatcttatttatttatttattaaagttttccctcgggaattgatgctgattgttggaaacatttggaaaagggagctcaaggagtctcgcctaccaccagtctctgtcttcctttatttatttttgagacaaggtctgttgcccaggctggagagcagtgactcaatcatagctcacagctgccttgaactcctgggatgaagtgatccatcttcccacctcagccacggggactacaggtgctaagtttattatcattattttttttgtagagatggggtctcactatgtcgcccaggctggtttcaaatgcctgggctcaagcaatcttccagcctcagcctcccaaagtgctagcgttacagacatgacccattgtgcccagcctccattttcccttagaatgtatgaagatttctcatagcaaaagtgctgtagcaaatttcaggatggagttttttcctgaatccatctgtaagtcaattgtctgtattttcttggctgtttcacatctgggttgttatctatgctattaagtggcaccaaaaggaaaggtaaggcaccaaagcttttctcctgaactagcccagaagactccagaacagattatcgacaagtaaatcagcttgatttcaggtatcaaatgtgcttttataatcttaattcaggtgaaactcaatcagtcaaaagacgaagaacacaaaatctgtcctcaaagtgcctgttgttttcagtgactgtaatcagaaaacttttaaatgagatttctttcgttaataaaattgcccaagagtttttgttgaattagttaataggacacaagacttggtccaagatttgcaaacctttcttcacaataagtcttctctatgtgccatcagtattagtattgatggtttttttttcaagatgatggtaacgatgaatctgaatataatagattttactgaatcaaaagaaaatgaacttagcttgaaaaagaactgtcatcatgctgaatggaaaactactgaacttcaaaaatgccctattagtacgagcaaatggtggtggtactttttttttttaaacgatgcagttcgactgtgttctcggaaatgtcaggcagccaagggaataccagaataaaacctacaacaggtcaattacctctgtctcatgacaccatcctctcagaagagaggctctagaaacactctggctgttagctatctgtgcgtaggtctaatgtcagcagtcactttcaaattccatcattttcattcaaggtttccaaagtcagggcaattttttagaagataggatgtagtataataggggctctcaaagtgtggtcactgggccagcagctttagcatcacctgggaatttgctagagatgcaagctctcaggcagccctggaatcagaaattgttggggggtgagatcagcgatcagagctttcagttggcctctggaggattccgactcatgctaaaattagagaactacaatagtgatagtatggtgattaggagctaaatcttctaaaagagacccacccaacttcagatctcctctcctcaggacccgtgagaccccatataagctccttaagtcaacaaagtctcaatgtcctcatgtgtacaatgtattatcagtattcactacaaaaagtttggggaaaattaagtaaaatattctgtataaggtctttagcacggtgtctggtgaagggtaagcatccaaagaaaactaatcaccataaccccccgaatcaagaattgcttcagttttttgtagtcagataaaacagtataagtaaaatgtgggtttttaaaatgatagatttagtgagtataagtgcagtgttgttatatggatatattgcattgtggcgaagtctgggctttgagtgtagccatcacaagaatagtgtacattgtacctattaagttatttctcatccttcatcccctcccaccctctgaccctccccagtctccattgtctcttagtctactttttttttttttttttttgaaacgtagtctccctctgtcgcccaggctggagtgcagtggcaccatctcagttcactgcaacctccgcctcccgggttcaagtgattctcctgcttcagcctcccgagtagctggaattacaagtgcacaacaccacgccaggctaatttttgtatttttactagagatggggtttcagcatgttggccagctggtctcgaactcctgaactcgtgatcctcccccctcggcctcccaaggtgctgggattacaggcgtgagccactgtgccaagccttcttagtccactctctatgtccctgtgtacatattataaaatgtgtttttaaatttcaactagttacctacatgtgctttcctatgactttctgtttgctgaaggtgaaagtttgtggcaacttgttttcagggagcagttctgttgctctttcaagttcccaaaaagctttttgagcttgatcttccccactagaggcaacttgtcccgtggactcagagaagctgggtgcaagacagaagacatcttatttctactgacataaacactgatgctttttttcttatccaaatggctttcctcttttgtagaagaagttcgaaggtcaagactgagtgattttagagggaaggaaatacaacttcctccactccagggactgcagtgggtggcaactgaacccagatgtgcagaagtggagaaaagtgctacccaagtatggcatcatccttaaaatggactagccacatgggactaaccagatcccagacacacacccttgaagctagtctaaaattttctgtggaaaaggagctaaatcaagctagcttcaacattgtcttgctttttctttctttctttttttttttaatttaagaagaggattttctttcctcctcagcacagagttccctgcaatacactgtaatttcctgcagctctctctggaggcttaagaagatgcttcgggtggcagcattactcatacacctgggagttgtgctgtcgtaaaagagaaattgtcattatgcctgaggctcctgtaggttctcctttgaggaactggcaggaagaagagcatgaatgccaagaagataggacaaattccaacccctgtctctaggaagaaagagcaagttagtgaaatggcagcttccagtggtcccctctgcctggcaaaaacacagagtccacctaatgtctgtggtcatttttcagctgtactctctagacacctgaaaaactagtgtgggtaaactgacagatcatggacgtccaacatagggcttgaggtgaatgaaaacaaggtctagttcaatggttctcaaccgggggcaattttatacctccctcccatgctgagacatgtggcaatgtcagaagacgtttttggttgtcgcaactgggagatgctactggcgtctagcaggtagaggccagggatgccgctaaacattatataatgcactggagagcccccagagcaaaggactctcctgcccaaaatgtccctggtgcagaggtcagagaaccctggtctaattaaatgctacaccctggccaggcacggtggctcatgcctgtaatcccagcactttgggaggccaaggctggcagattacttgaggtcaggagtttgagaacaacctggccaacatgacaaaaccaatctctactaaaagtaacaaaaattagccgggagtagtggtgtgtacctgtagtctcagctgcttaggaggctgaggcggaaggactgcttgaacctggaaggtggaggttgcaatgagctgagatcacatcactgcactccagcctgggcaacagagcgagattctgtctcaaaaataaataaaaaataaaataaaataaatgctacaccctgttcttcctctcacatggctagttgtggagaaacagtcttccctcttgttattttctttccaaaaggcaaaagaaatgaagcaatcactgtataatggttttttgtttgttagtttttttttacacagccacaatttcgaatataatgaactcaaagtcttttgagaaataaccggaatgccgtttcctatgattttcacttacaatttttggatacttatcatccaaagggagaataactatcataacaactattaatatttttgtacttcagtttttgtttcatttcatttatttattatttatttatttttatttttttttattattatacttttaagttctagggtacacgtgcacaatgtgcaggtttgttacatatgtatacatgtgccatgttggtatgttgcacccattaacttgtcctttacattaggtatatctcctaatgctatccctctcccctccccccaccccacgacaggccccggagtgtgatgttccccaccctgtgtccaagtgttcccactgttcaattcccacctatgagtgagaacctgcgctgtttggttttctgtccttgcgatagtttgctcagaattatcatttcatttaaatcagaggctccatagtactagaagaagtctttctttggcatgtttatagaaaaaattccccccacactaaacccaggtggaatgctgatgcctcctttgggccatgcactgttatgaaagtctctgactgtacacacaatgggatattgctcctctcagctcacttttctctattagactgtcagctatgtgaggaaccactgtgatgtgacgtggaagcaaggctggctgggatggctcctccttgtgcaggagtatcccatgcactggaaggcatttagtgaccttgggctctgcctgataaatgcagtagtgccccagtcattaggacaaccacaacagaaagcacctccatacatttctaaatgctgctaggtggggtagtagctgccctcattcagaaaccactggtgcaagctgggaaagggtcttattcatatttgtttccccagtggctggcacatagcaggcaatcaataaatgtttattgaactgaccaataaatgactatttgtcttaacggtgaatacagaaagtggttcatccattcccaaaacacagtcttgttcattagaaaattacgtattgagttcgcactatgcatcaggcagggaactaagcactcagaacactgacaagactgagacgatctctgtctaagcgagtcctagaggacagtggggaagtcagaagaggaatctgaacaagaaatgtaaaggagcaggcactgccacaggggttccaatagagacaggtgagtgaggatggggggattaagggatgcctccctgagcacatgactttcagcagagacctgaaggctgagtacgggagaatcaggtgatgatgggggtacatgatagcaatccaaggcacagggagccttgaggacaatgcttgtggcaagaaggatcccatatttgtagaacataagggaaaagggcaagggggatgcttgatggttgggggaccagaaaagcccagcagcgaggctgctgtagagttctagggtacaaagaaagagcttgaggcagggctgtgggaatatctacataactaagctgaaggagtgttcctgttcctcagtcctcgggaaccatggggccttcacacacagaatggggtaagaggttggtgggcaaaagtgccaccctcaaagcaagcttctcttgtggcctctgggagggctccccaactatgcagtggcaggctcctcactcagggggtgggggtctgaatgcctcatgtccctctacatcccattccaaaaaggaggcaggaggcccgagcgacacaagttctgtttcaatgccactcgagccagaggctaggtgactggtctcctgctttctttcatctttccctttgactgagagattaaggggcatccttcagtgttggcctcaagcaggaggagatggcaggaaacacatagaggtggtggaagcatgaattggaggaagtagccattgtccccctcatagtccaaggctgaccagcaggctgcttaactctctgcagctgccttcatgactatgaatggctttttggcatcacaaagggctaaaaatcgtagtagctaaatatatccaccactaaggcacctattcagcgtctattctttggcttcagcaaactcatttcactcctgggggtgtaggagggggaagtaaacaaagcaaaactttctcatttccctcatctgttattttatcaaattaaagtctccttgctcaaagaaaagaggagggatgctatctatattgtctgaagaagtacaaaaaaaaaaaaaaaagagcgtcatggtgtgagactttgtcttgtacccatttttactagttaatcaactgagcagacattggaaattcctgccagatcaaattttagaagttatctgtctagatgtaaaagcatccaaatgggaggatggttccagggaagtccagtggatcagggggaaagggcttgccaccttctttaagggagaaatggtatcaatcttgtgactgacctcccacctccagaatttgtcaccttttatttatacttaacctacatgtacttcaacaatgacaaaaataaaatagttaaaaattggtctatatagcaccattttttttctatacttattaagtctacttaacctacatgtacttcaacaatgacaacaaaaaaagtcataaattggtctatatagcaccattattttttctaaataaataaaggcagctttgcttatatcatcagttgattctcacaatatatattttcccaagaacaagtaggagaaagttattttggccccatttcatggataaagaaactgaggcacagagaagcaggatgatttgctaaagaaaagcatttatggcagcatttttaaaatggtggagttgctaatttttcagtcctttaattaagagacaaaagaatgaatttcttttgtttttataatttggtttgggcctcagactaaaatttataaggtattgtcttagacagttcaggatgctataacaaaagtcccacaggactgagtggcctaaacaacagaaatttatttctcacagctctagaggctgggaagtacaagatcaaggtgctggtcaatttgttttctggtaacagccctcttcctggtttggaggtggctgttttctcccaagacagagagagttctggtcttttcagccccttataaaggcactgatcctaccatggggacccccaggcccacggccttatccaagcccaattacctccccaaagctccaccaaataccatcacattggtgtatagtttcaaatacggatcttgggaagacaaaactttcagtccatagcgggcatggatggttctaggatgtgttttattactctaggaacttaacatgacaaaaagtccaccctttgggtttacccaatttaattaagaataaaacaatgatctaaaatgtcaggaaataacagatgctggtgatgctgtggaggaataggaacacttttatactgttggtgggagtgtaaattagttcaactattgtggaagaccgcgtggcaattcctcaaggatctagaaccagaaataccatttgacccagcaatcccattactgggtatatacccaaaggattataaatcattctactataaagacacatgcacacatatgtttattgcagtatgatttacatagcaaagatttgggatcaacccaaatgcccatcagtgatagactggataaagaaattgtggcagataaacaccatggaatactatgcagtcataaaaaagagtgagtccatgtccttcacaggacatggatgaagctggaagccatcattctcagcaaactaacacagaaacagaaaaccaaacacccgcctgttctcactcataagtggtagttgaacaatgagaacacctggacacggggaggagaacatcacacaccggggcttgtcgggggtggagggcaaggggagggagaacattaggacaaatacctaatgtaagcagggcttaaaacctagatgacgggttgataggtgcagcaaaccgccatggcacatgtatacctatgttaacaaacctgcacgttctgcacatgtatcccagaacttaaagtaaaattttttaaaaaaagaataaaaagatgagaaaaaaagaaaatctataatgaacagttattttttttatggtagataaaagagcggttacttgaaatccaatggctcttccctcctatacaataaatggtagaagaaaaacaaaaagatatatgcaaaatctttactctccaaagatcaaccatactacctaggtgtacatagtactgaactgcagtacactgagaaacagaaattaccaatatcagtggcttgcaaagtattaaaatatctcaaggccgggtatactctgaccatcaaacaaatatgagcaacaggttataaaaataaactattttcccattattgctaaaaatacagaataatttggtagtattgttgctaggaatttcaactatttggcccttagcagtaagagcaaaagaaaagaaaggaaaagtctagcatcccaaaaaagggacatgaaagtatatcttgtatcttgctatcctaaaattaactttttaggataggaacatactgttctcaactacaaaatgaattgtatacaagaagagcaagcagcaggaagcagcatgctacaagccttgaaacctatggctatgttacacagtggagaaaatagttatgtattcctcagactaagagttcagggagctttaagcagtatttgataggaaagaagagaagaactgcatgctttggtcttgagtcaataacagagaaagaaaagaggggttttacttctgaagggactagcatcagagaaatttaaggtagacttcctcaccctaaaacagttccattatctcagtctggtgggtttatagataattttggtttattctttgtatgtttatatattttggcagaaaatgttggttgtctgtccaccacctattcccctctttttcaaataatcttattttgccagtgtcctttttctatgttgctgatatgaactattgatctaagggaaggcacaacacccaactctggcagcaagatataaagtgaagctttccaaagagttacagaaaacaggggctgggtgtggtggctcatgcctgtaatcccagcactctgggaggccgaggtgggtggattgcttgaggtcgagttctagaccagcctggccaatatggtgaaaccccttctccactaaaaatccaaaatttagccaggcatagtggcacacacctgtaatcccaattacttggcagggtgaggcaggagaatcgtttgaacccaagagcaggaggctgcagtgagctgtgatggcatcactgcactttagcctgggtgacagagtgagactctgtctcataaaaaaaaaaaagaattatagaaaacatatccctctttgaagagaagaaacatcacaagaattttgtcagcacatgaaaagatgctgaacattattaattagtcattgaagaaatgcaaatcaaaaccacaatgatatactacttcacatccattagaatggctataattagaaagatgaataataacaaatgttggcaaaaatgtggaagaattgccatcttcatacattactagtgggaatgtaaaatgtggaaaagactggagttcctcaaaaagttaaaaatagaattaccacgtgatccagcaattccattcctaagtatgtgccccacaaaagtgaaaacaggcattttaaaaaacctgtacacaaatgttcacggtagcattattcataatagccaaatggtgggaattacccatacgtttatcagctgataaacagatttttaaaatgtgatatatccatataatggaatgttagcaataaaaaggagtgaggtatatactcaagggaattgaaaacgtatgttcacacacacaaatttggacatgaatgttcacagaagcattcttcataatagctaaaaagtagaaacaactcaagtgtccatcacttgatgagtggatatacaaaatgtagtatacgtatatgacggaatactactcagccataaaaaggaatgaaatactggtacgtactacaacatggatgaatactgaaaacataatgtcaagtaaaagaagccaaacaaaaaggccacatatccacagagacagaaaataagttggtggttgccagggagttggggcgtgaggtgtcgtgaatagggtatgactattaatgggtatgaaatttctttttgaggtgatgaaatgatctgaaattagataatggggatagttgtgcaactttgtgattatactaaaaaccaatgaattgtacactttaaaagagtgaattttatggtatgtgaataaaaatcaatcgattaataatgaaataagcaattgacaaaaaatagataactttaaaaaaagaaatgaaatctatgccaagacatggatgaatctcaaaaacactgttaagtgaaagaagccaatcataaaggaccacatataatattgatcccatttatatgaaatgtctagattaggcaaatctatatagatagaaattagattagtagttgcctagggctgagggaattagggagaaatggggaatgactgctaattagtacagggttttttttgggacaatgaaaatgttctaaaattagattatagtaacggttgcaccactctgtaaatacacagaaatccattgagttgtacattttacataggtgaactatatggcatgtgaattatatcccaataaagctgttaccaaaaaaagagaggtaaaaccacagaaaacatcttaacttgtacctgtatttgctgaatattccacaatgagtgtgtaatacttatatcttcagaaagaaggtgttcaaatttctcttgatttggaaaaaaatcctattttataaaacaaggtaaaaatcagagcagaaaaaaatactgtacatgagctcagttataaaactgagtgcatgcatgtaagggaaaaaacctagaggaaaatatactaaattattgacagtactgatttctgagttctgatcattggatgattttaatttattgtggtggaggaggtttttctttctgtttttctgtattagcacatactacttctttattcttttgttttattttttaattgacacataataattacatatttatgggatacatagtgatgtttcaatacttacaatgtgtagtgatcagatgagggtgattagcatatccatcatgtaaaacatttatcgtttctttgtgctgggaatattcaatatcctccttttagatgattgaaactatatattattgttaattacagtcatcctacagtgctatagaacaccagaatgcattgctcttatctagctataattttgcacatactactttttgatttctaattggaaatgcacatgcaatcatacaaaagcttattcagcaatgaaatgtaagcctccctcacatccttgttccccagctccttatttccagggctgccatgtaagattgttcaagatgccagttgcacaaggcacctggctaaggcagtgagtgggggctgtaatctagccagggctctgctggataagccataactcatggctttgagaaaaagagtccttttcatcttaaccccacaggaaagcgttatgcaaccaagtagccattctgcccttttcccctgcccaaagatacaaacttcctagtttcttgtgtatccatcctgacatagtctatgatatccaaacatatactgcatactgtaacatatatatatataagctattttaaaagagtaaagaaatggcaatacaatgacagcaaaaggcaatgcagtataatcagaattctagtatttctacagaagtcattcaaggcaccatggtaaaattggatttaaagaaagaaaaaaaattacttggaacaaataaatcttaagggaagaagcccaaatgcaataattgttgaattttttccacccgagctgtcctcaatccacatgaattgtttatacagcaaatgaaattggttgtatccattgccaaggggattcctatttggtacttcgttcatggccctccccacagcttagaagagtgtggaagcttgtttgtggtccagtttctactgcagaaagctttagggttttaatccgctgagaaatctgagaatgggtgtccccaggtgaaacccagcccttccatttcattcactcttatgtccttccgaacaagaactgcttcgacaggcaatcctaggccactgtctcaatttgtatcccaacatctctatattcattctatctgcggtgaagtctcaacttgttcagagaaaatgatggttaaattagtaaacaagtcacattatgagatctgactgtaaggattgctctgtcactctgcataacttttgtctgtgttcctgttttatgttttgcctcattacagagagccatactggtcttcttttgggttctaatgcttttccctcaggctctttatatttgtggctctttaagtcctcaacactcttctccatcctgagattgaatccagtgaactcccatttatctttcaagccttagctttaatgttgatccctcaaagcaggtgagtgccccatcactgccgcttaaacttcccttctcattacatccaccatatttaaaattacctgctaaggcttgattttgacaccagaccataagctccatgggtgcagggaccatgcctgtcttgtgacccttatattgtcattgcttagtattaggttggtacaaaagtaattgcagattttgccactgaaagtaatgagctcagttgttagttacttttgccccaacccaatacgatacctggctcatattaggtactcaataaacctgttaattgagcagatggaaatgtaaaagctatgagtgaccctacaaaaggaaagtctttccttgtttaaaaaaaattgaggctgggcatggtggctcatgcctgtaatcccagcacattgggagtctgacacaggaggatcacttgaggccaggagtttgagaccagcatgggcaacatactgagattctgtcttcaccccaaaaaaaaaaaattagttgggcatggtggctcatgactatagtcctagctacttgagaagctgggtttgaatccacgggtttgaagatgcggtgagctatgagctatgatcactccactgcactctagcctgggcaacagagtgagaccctgtctctcaagaaaaaaaaaaagtgtaccatttagaagaaaatttagaattgattgagagccaagaataataaggcttagaaactactccttaggtctggaagcattttccaaggaagaagcctggaggaaactgaggctggtactgggttaaaactaactactggatgaaaaaacaaacaagacaaacaccactggggtgcaatggttgagacccaggaaggcaatccaagaaggctttggtgtgagatatttctgtatgctgagaaagaaggtggtgggcaaggtctctggatgtgacctaccttactcttaatgacttaccttactcttaatttgccctgattcaaataaatcttgacagtaggatcaaggattatctgagacatatttggtcctcctaagtggcttagttctctaaagcccctttcaagagtgctttggggcattcagaaactagctctgcttctattacactgagttatgctaagagcaggataagatgatgtgaacttatttgccttgtggatttgttccctgttcgtatttctaaaatagaatacttaagtctgttaactgattaactacaggagtacagagaatgtcaatggttaccggcattctttacttccattttgaatgcccttttccatacacactactatatggttttagagaagataaataattaaaataaataatttaagatacacagcatagaaatatataaaatgcaaacattatgtttacatcataaagcacagttacataaacaatagattatgttcaggctgaagaagaatttttaaaatgcacaatcactgaaatatggttgtgatgaaagtagaacatccaaattaatttccttccatagcaatggaaatatatggaggaagaccctcttcaactattccatccaagtaaactacacgggacagaggagggatatcaggggcttgggggttgtcccaaagcaattttagcaatcagaaattgaatttacctattttatcttaaagattcctgaagtttttttattcttcttcataatatatctttggttttctttctaaaaattcaataagtaaaactgttgttccaggaagatgtgcaatgtttattttgggtttcctataatctctcaggacatctctcaggagaagagtgtatctttcttcctctctttcttttctgagtcagggtctcactctgccacccgggctgaagtgcagtggtgccaccactgttcactacagctttgacgtcctgggctcaagtgattctccaacctcagcctcctgattagctgggaccacacgtgtgcaccaccacaccccaaaatttttatattttttgtagagatggggttttgccttgttgcccaagctggtctcaaactcctggactcaagcgatctgcctgcctcggcctcccaaagtgctgagactacaaagcattagccaccgtgcctggccgagagcacaaacatctcagtgtaagaagcacaggggtcaacaagaggagatacaaccactgtaatctatacagacttcagaaaaacttttagtttagtaaaaataaaatgtttttcataataaatgattaaatgcagtagcctgtgcgtaggcaattcttgtgggatcttatacagcctcctgtctcagcatatgttaataacacaactgcagtgaatttcctatttctcatgtctgcccaactattgcagtcatgggtgattatccaatatccgttctacccaaaaggacaggcctagggcaggtatggtaatcccatcctccctgtcaagtgattggtttaggaaagggcatgtgatcagctttgcccattaagaccaaaggggatatctactgagggggcttctgggaaacctagcttaactctggttgagccatcttgttgccacaatgaggatgaagccaatacagagagctgatttttaaacaaggcaattaccaagatgagaaactggagccttcaagtattgtgtgtgagctgccctacctcaggatatcttaacataatagatttccttatgacatatgaaataatatctttccttattaccttattaacccaattaatgtgtgggttctctcttactttaggagatctttaatgatatactttacactggactgaaagctttgagaaggggaggatgttttgtttatctttgtatcccaaaacctaacacagtatctcagatataggaggtgcgtaattcatatatgtagggctgaattgaaccaaatatcaaacataagatgtacaaaatgaatttcccattgcctctagatctcgtggataccaaatagctaaataagcaacccagattatagacagtatgacatgagggtaggtgagaattattggcatcaggagacagtgcaataattgacctcaatacattagtcagattgcacatgacagacagtaaatcaaaaagaatcaggaatcaatgagatatacatatgaaaatcactggatggagagtgattgaaaaagactccagaagattattttgtttaaaggaagcatagccctggaatttctgtattatggtattaatcattcaaacacagaatacggcagagaagagaaacaacattttatatctggaacatccaggaggatatgccagcagtagctagatgtttggaggaccctgaagatactgggtctgtgtccacactaataaaacagaaaggctaaatcagatcccctctacttcatttgtaagaactgcctggatcacagaggtgctttgaaacttagcaagggttcaggggcctctaatgaacacccaaatattcctcagaaaagaaaaaaaatcattccttcctgatattccttagaaaagaagctatgtgcaggcattgacttatggggtttcacacccaccaagccatgttaatgttctcaacaactcagaagtattctcactgtccccattttaaaactggctcaactgggcagttattttcattaaccaaaggattcaattaatgctagatacaaggaatgccatgtaacatagcattgtaacagaggccttctgctagcaaaacaacagggctcagtgacagggaaatctcagtaaggaagaaaggaacccttccccctgaaatgagtggggaagctaaccccattcctgccgttgctactaaaccctgagactatgaaatgtcagcactattcaaacagtcatagaaaacttcacagagaggagaaacaggcaagacaggttttggaagtatagaaagcttaaatatacacctaacgcaatcagcttgaaaataaaagaggcatatggacatttgaaccttacaagttcaagtatactccacttatgaagtatagtacagcattctctatctctattccaaaagtgtgcataagcacgcatgcgtaccccactccccccacctcaacacacacacacacaggtctctctttgcacattttattctaaccagaatcagagacatgtctatccctaaaatattattttgttaattttagagacagggtctctcttgtcacccgggctctggagtgcagtggcacaattatgctcacagccttgaattcctgggctcaagcaatcttcctgcctcagcctctcaagtagctaggactataggcatccaacaccacacctggctgtttaaaaaaatgtttttgtagaaacaggtctcactatattgcccaggttggccttgagctcttggcttcaagtgatcctcttgtctcagcctcccaaagcactgagattacaggcctgaaccaatgtgcctggtctcctaagaatgttttcttttggattttcttgaagaaaatcgcaaatagaaaatacagtgtgagtgtatttttgcccataagatttctctccaataacagaattcagaaaaaataaaattaaataaatgcacaggctttctgatccagaggattctttcatagtattactttcttgaatattaaggatagaaaatgtaactctggctttgagatgtgattattagagttagaagcatcaaataataacttcagctactttttgttgatttgttttcatgaaacagccattaatcatttaattttcacaatgacctatgaaataaagtattattatggcctctattttactttattattattacttctattatggtaaagctgaaacttaggttaagggagttgatgggttaggttcagactctgaagtatccagaggtcaataatccaggcagaactgtgagtttcgtgcttggtactgggtggagttgggcataaatgaagtaggtcaagacaaacagaaagcaagttcatgtgagcagcttggaatgaggacaccaatcaagaagacactgagaagggtgacagtcagatggttcagaaccccagactccacaggaatggaaagaggatgcaagagatcttgttatactcaggtatggttaccaggagggcagggatcctgattgtcttcctcacaactgtgtcctcagggcttatcacagtgcttgcaaataacaggcaggaatgaaagagattaaaaacttggtccaatagcctagaagagaaatgtgaggtgccaactatacaggggctataaagtcttcatcagagctctttgctcgcgaatgatggaaacataattataactaatttaagcaacctggaatttattggctcatatgacaaactagggaataggcagggtcaaacagaccttgtagatgccaagaatgttttctttctccttgctcttgccattgcttcttttacacagttcattcattttctctggtgtgttcctttacacgtgtcattcattctgttgagtgtgctatcacaaaagggtataaaaccacaaccaaaggcacctccaagtgtatgtccttacagactcaccatcagagaggaaagagagctcttcgctgctagctcctgtaggttaaatcatgggcaaggatgctgattgactatcataaccactgtggccagggtggaggacatagcggtttgtgtagtgactggcttagccagaagcaggagccatcctgtggtctgggagggtgggtaccatgactggcagccctgtgcagggcaacttggtcagatgtgtgaaaagaacattttccccaataaaagggagttcctgttaccagaagaagaaggtagaaggatgttgggcagcagaagcagccgatgttctctacaagggctcttacctttgaggcaaacatatccaagcaaagggaggaaccattgctaagccgtgacgttctagttctgcgatacgccacaacatctggctcactccgataccatgtttcccagtcctaccctctttggtgtcagaaattaaatgagccatgatgacctgctttctggtctgcagaaaaagcctcctagttccaactgaaatttaaatttaacttggtcccttgtagtgaaacagtactgcaggataggcaccatattaatagtatcaaactttttattaatgtcatttcaaataatattttgcattttcaatgacttggttatgtggcaccttgggtataataattattaaattctttcatctgttccaaagcaaagggatgcattgctttgtttttcacccaaagaatatcaataacaccacattattaattttactggggtcccatgaatctcaaagcttaaaactttattaaaaaggcactcacccttgcacttcttattcccttttccacaaatcgaacacaaaaacacatgaggtgccaacagctaaaaccttttgccaagattggcttaatgcttttaaatggccagaggcacactcacactctcagggtccaacttctagagcaccacatttaatgaacaatggctcttggaaaacctcatgctggatcccagccgatactcacagctcacaactttgctgtcaagatgccaactgtgcaaggctctaacgagactttcccagtgcatctggctcctcccagttaatagctgtcattcccacaggctcagctggtcctcagcaagtaagaaggagcatcctccccaccaactgatcctttaaatagccttgccacatttccattgtaaaatattcactttcctttctgttctcctctccaacttctggggaaacaagtgagaaactgctaagtgatgctgcctcctcgtttgcaactttgctatcatctcctcctcaaaggaagccggttcagtcagtcttgtggcagcaaacatgtccttaggggcaggtctctatagctgtcaataatgactatgtttagccaagtcttaccaaatgtcattaatgttaggttttgtttttgttttttttttagagacaatgtctctctctgtgtctcaggctggagtgcagtggctcaaacacagctcaccataaccttgaacttctggcttaagcactcctcctgcctcagcctcctaagtagctgggactacaggtgtgtaccaccacacccagttaatttttaattttaattttttttttttttttgtagagacaggggtcttgttgtgttgcccaggttggtctcaaactcctgacttcaagggatctgccttggcctctgaagtgctgagattacagatgtgagccaccacacccagcctaatgtcaggtttttaagcaagtatttgcaccagtgtttgaagagtgtcttttggaatcttcctgaaatttgcataaactagaacatggggtgagggtggcgtggtttaaggaagaaagtggtaatatagatgttcccactccagcccctggcaatactatatacatcttttactgaatgtaaattcaacaggtgcttgggtataaaagacagtaaggattagcatgagaaagaaataatgtaatgtaagtgattccacctatgaagccacttagtaaaggcgagcgttagatgggacttaggaatattctcaatggggcttagttcctggatatctctcacggtgtcagcattgcacagtgtaatcactctactatttaaagggaggcatttttcatacaacacggtccctaacctcaagacaactactttatctggtgcttaatctaagaaacagaaacagtgaattaagtttcaactccggacttaacaagaggtgcaatgtctgacatggcaacccaaacgatgttcaggggttacttattacacaggatttttgtctttgtgattttctgatctgatggtgtccactgggccagggatggaaagtagttttccacttgaatgccaagtccagttgattggtagtggctgcctgggcattgcttcgagaaggattctaaggcccagtgggaaagagtgctatgattgatcagcaatatctgccataggcccagacgcggctgcagaagtgtcacccatttctttcattgagagggaaatgagggttgtattgtgtttttcctttccaaatattaggcatttgattttttttcctcgtggagccagggctagctgaggtttttattcctggccatgtgggggaaaaaggagttagggggtcacggaaaagcgtctgtggcgtttactgacctaggtcatccggctcagcacactttttaaaaatacagtctcaattgtagctacttaactctgctgttgcagtgggaaagcagccgagacaatgcatactcaaatggcacagctgcgtgccaataaaactttatttacaaaacaggccatggccaaccccaatctagatcgtgagagagatgggtaggaattaatgcatagatgaaatgggaaggtgaaatcaggggaaaatttgtttctagaaaggaatttaggagcaaacctgaaaactcccttctgaagtgatgaagaatcctgaagtcatgaggcctgaaaggttcttttcaattaatagtctgtaatgcaatcataagctcctccacatgcaaccaagaggctgctgcctatcaagtgtggttcaagagccaagtgcccccaaaggcatcatcttgctagtctgaaagttccgccaattgacgctttctccagaaagcccttgttgaaaagtaaagccgtctccacagaacacttaatccaataacccaccagcacttggagaacatattagttaagagagagcaggactgtgatggagcagaacgtgggacctgtaagttttgagtggaaaatgctgtaaaacaggaaaatgatatcataaaaaggactcagggcttgttgcactgcctgggcaggcagggcttggtagggggagtggggggtggacaataaacaagggcagctctgctgagctggagccagcagcatttggagatagttgcgtggagtcctggcaggggaccagagccaccttagagcagggatggcgccagtgggaggaatttcaagcagggaagagtcgacgactggagggctcactcccaagttgcacctggggaccactgcttagagtgtgttttttagagaggccagtgagaaactcaggtttgaagtcagattctatcaacctggggtaaaatcccagctctgcacttacccaccttataatcttggaggaattatttaaccaccttaaggcttggcttggcatctgtaaaatagagagaaaaacacttccatcctgaggttgttcgtgaggaatatatgcagagtgtctaaaaggccagttcttggctcacagtgagttttcaggaaagggagcctgtagtcattccactactcagtctcagcagaaaactggcattgcttggttcagcacttctttgtgctgaatgtgtgaatgcaaaagggaagaaggcagaggttactagcggattccggctcagtctttaccctagagctagatgcctgaacttctctctttgagttggagaagcaaatccactcggctgttgagacatttccaacaagaattcatttcaattggaaactcatacaaccaggagattcctaggcatggtcccatttctctgtgtgcaccacagaaagcttacaatgacccagtagaaggagtattagtgcatcatctgtcctcataaggcatcaggaacacaatgagctacttcccagtcacctctggactgccaaggggttggccagatggcatagtggccaccagcattcaccctcattcttctagctgagaaaaatctcgatttttatacattatccacccctccctcacacaacccaggtgctaacctccacttcaggggaaaacctaattggcataaaccaattggcatgtgaggggacctgggacagaagccagtccaacagagggaatctcagggctattgcttggaaatctaggataaaggtaccctctcttctctgcatatagaaagctcagatgtgaggactaaactgccacagccattcttggtactaaaaaggaagaaaatctgacaacaaagcccacatgtggggaaagcagagtagagagaattcagagaacactggcagcctcttcaactgcacttgaagttagaacccttcaggttctcagttacatgagccaataagcagctcttatggtttaagctggtctgaaatggggtttctcctggtcatatgggttcttccactttcaggatcctcagaacccccagcaatgccaacaagaactccaccctttcctcaaatggctcagatttcctgacaacaaacacaatttcctagtgcacagaacagacccctggcttgcttccctcagactgtgaagcaaaaggacaaagtaacaaaggttaactttcgttggtaccttcctctctgagcccatctcttgctcctgactattcctctccttcaggacactcgggccaatttcaagttccaaaagcaggtccgatatcagctctgaaattccactaagtctccagatactactggcactcctgtgcctaagagtgagtgtgtgaatgcaggggtaagcgtgtgaatatctgcgtgagtgtaatggataagtgtaaatgtaggaatgcgtgtgtgagtatgagtatgagggtgagcatgtctgtgcatgagcgagtgtgaatatgtgtgtgagtacgtgagtgtatgtgagtgtatgaacgtgtatgtagtttgcaagacctgtacaagctgtttctggaaaagtgctccacctaggggcagactgtcaaactgatgccctctgatggcacaggcatggcccagaaacggccattgagaggaaggaaggaaaatagaatattttacctacgggttcagcatcttctcttaataaaagtaatgcctgaaaggttatggaacaagggaaaaaaagaaatatataaataaataaataaataaatatatatatatatatatatatatatatatatatatatatatatatatttgagacagggtcttgctctgttgcccaggctggaatctggaggtatgatgacagctcattgcagcctctgactcctgggctcaaggaatcctcccatctcaggtctcaagaacaatatttttaattacaatggaaaacactactttaaacaaattgaagtttgaaaatttgtacctggcctatagaagaggggctgtaagccataaggggtcagccaagtgaaatccatgagtcccatgggccgtattctcctgtggcaaactagagatggcatccctgattgaagtggggacaccgccattcagccctgaatggtgccaagtgataatgatggcccagtggtgccaaaactctgatttaaaaacaaaacacatcagaacaatttatccagatttgtacctgaactatcctaattttctacatggtggctactaattcatatggtattctaactgtaagtcaccaatttgcaactaatgctgtccattctctgttgtttctcaaaattgaagaaggtttaagttaggactcttttaaattttcattgtcctgagagtatttacaaatatgactcaactcacaaaaatacaattaaccacccacacttcagtctgaagcaaggtacacctggatgattataaatgtatctaggcaatacaatttaaacctgggatagagagggagaagctgacagcattgagtttctgagttatgtttttcatcctacaggatatgaatcaccccaggctccatccttcagcagggtaaatctctttgtcagaagcatgaggaatcagaaatgttctgtctcccgacttcataaaaatatttcactaatgaacaaagtctccagttccaaagctgaccctgatctcctgtctagggaaacttttaagaagttcatcgaataaagtagtgagtaatttacaatatcctggataactgcctagggacgtggttataatataattcacattgggattccagttaatgatatagcctccaatctagtttcaccacgcacttcttaaagtggaagatttccgaggtccttgcttttgaacaattatctatatcaaatcagaacaaactcctgactgagtgatttttaagttttattgttctgaagcccaattgcaaaaataagtggctgagtgttcagaaatacagcaggaatattacccacttgctaatctagctagaaattgcatttctttctagatgacagtaaaaacaggtaacatttattgagtgctcactatgtgccaagcactactttcagcacttttcatctataaatttattaatgtgctcaaaaaccctaggaggtgggtccatttattatgcccatttatcaaataaggcagagagggattaagaaaattatacaaggtcttccagttggtagctggtagagccaggtttgaacccaggaattctggccccacaacccaagctaactgctttacaagactgagatgcagattcaatagaccttttgaattagaatagaagaaagataaactgaggacacttgatgtcacaggaaaagggtgcctggaaatcaacagttgttactggagtcagactatgtggtggactggtcaactttcagaagtctgattttattttactgattgctattcttttgataaccctaaagttagtgagagcagaggggaccgaaagtaggtagaagcaggaggaagaagagataaaggtggaatatgggctgcttcaagtatccaagggaagtaagacagtcacttgctcaaagttcttccctgtagaggccaaagagaatttcatttggctgagtttctgtttaaaacacaaatggctgtattgtaacataatgcacatttacaaagcattcattctttcctacccattaatttacttaggttatctaagagatgcagaacttgaatgagcgaaaagactaatttcaagttttaccattggaaagggttaattcgtcatgttgagtgctaaagctggggcctctgagtggatgaatgggcagtcagaggagacctaagagaattccaatgagaagctccactttttttttttttttttttttttttttttgagacgagaagctccactttgttcccagttccttgaagttgggtgggaagcttcacacgcaccaggcatgaaatcaaaccttctctgtggttacctattatcaccgatgggtctctgagttatcatggtttcctcttttgtcccactgctgtagtctattcatacctctattgcagtaattccattgtctatgataatggttcattgctatactcttgatacgcagcacagtgcctaatgtatagtaggcataagagtcaggtttgttgaacgacgggattaaagatgctcaactagactaacacataaaactagtcattaatatggatgaaagtaatcattagtatttattgagcatgaatgagccaagtgcttacatgtattataacttcatttaatctctcaatgactctataatgtaggcattatcctgattatctccattttacagttaaagaaacgaggcacagagtagtgatttcctcaaggtcacttagcctggacttgaccccaggccgtcttgatgttagagccagatctataaaccttgaactgtatctctccctttattttactgtcctgactgaatgcaattaggcacactaaatgttcttactaattcttctcaaatactttcccactatagtgcctctctcagaacggtacctgcccatagtcacaaatcacagtaaccccatttcataaccaggctccctcaaatgtcattaaatcctagcagtggctttaagatagaaataaatatgcaagatgcttgaattagcaaggtttcccattttcctctttccctagctttagagtttgacttgattgcctcattaatctcaagggaatgtgacgcattcaccacacgtccaaaagatgtgcagcgtttcacaaagcagcagaatgaagacaatacaaccctgcatctcctatgccgggagctgcagagaagtgcgggcaagaagaaaatggtgtaaacggctcctacgtgtttctcagagatgtaagaaaaaagtggagagaaatttctatttgcttattttcttttgtttacattaatgtcattccatgcctttggggatttggaaccttctggaatttctcgattctgggatgttttgttgaatttcatttattcttactaaggatgatgctggcttggagaaaagacgtgcatatggcatgttcctcaaaacacatatgttcccatctccagaaggaaactagaaaatatcatacagctgcatttcatctatagggagagagtgcttctagaggagaaaagtggttgcaggtaacagatgcctgcctgaataaaatcataagagcttgcacaaaacacacaatacctacttcaaaagacctcaaacaggaaataatcaaggtgctgctttaacagtggagagatacacactaggacaagactgtccgtcaagcagatgagtagcacagatcagacatggggaaggaaaaaaaccacaaaaacagttctgcactaaaagtatgcttcccctcgctttttacaaatctatactatgtggctagaaaccatgcatcatgtaagagatggttcttcttttcagcgaaggaaaataatgcttctttttaattagaaggtgttccttcgatgaacatgttgtggtccaggggcagaaaaagtcaatggtaatcttagggcgtgatccgcctgccttggcctcccaaagtgctgggattagggttgaatcaatagatgctgtttattgctccaggtgagcagtgccatcaggttgacgtaaagcacatttcgaggggctgcatttcaacactatcatgagagctgcatgaggtcaagggtgtgcccagaaagcaggcccagcctgtgcaggtaactgcgtagggcgtacccagaagtgcaggtagctgtgttgtcctccagggactcccatgaggaactctctaaccttggcttctattgtacttatgttgagactcacagcgaacaagctgttttttttttttttttttttttgagatggagtctcgctctgtcacctaggctggagtgcagtagcgagatctcggctcactgcaacctccgcctcccgggttcaaacgattctcctgcctcagcctcctgagtagctgggattacaggtgtgcaccgccacacctggctaatgtttgtatttttagtggagatggggtttcactatgttggtcaggctggtgtctaactcctgacctcgtgatctacccgccttggcctcccaaagtgctgggattacaggcatgagcgactgtgcccggccagcttacaaactttttaaggcattgaccactgcccagtgaaaagaaagaaatagtcaacatctatattttgtgaacaggcaacaatatgagtgaatccatcaaatggagataaagccccatactgacttctcaaggctgggcacccacctctaaaaggatgcagagtcacaagatactatggattggggagcagatccatgcccccagttctttcatttcaaccatatgccccaagagtcttctatgtctgtggtcaagccccatctacctctcccttgccccttgtcctacgccccctcttccccctctgccctctaacacactacaatatctggctgcatggccactgcacaccctgttgcctccatatggaaccctcagcctcttctcccttttcctggttaggtgctactcagtcttcaactctcagctaaagagtcatgtccaggaggaagctgtccctgattccctcagcctaggccaggttcttctgataagtaacttcttagaacagcaattattttctttgacttactttagtctgcaattatgcatttattaatgggactatttaattttgatcttttccatggggctgtggggttttgagagctggaaactactttgtctgcttttggtctctattgtttctccatccttcatggcacattgtagggctcaaggaatgtttgttgaataaagaaatactcagtgtattcggttaacacattaaggaccagataaaagacagtagtactggctattattcatcttttattctctatgaaattaatcatttattcaagatgaaaactagactcccctgctgaataaagtgccctgtcctctgagttagaaagattaaatattaaaagttttatataggggaaccactttttgctttgactgccagggcataccaagtagctcaaagctaaattttgggcctgcccttaataacaggtactgttttgcacgtggttctgagtaatgcatttctaaataagcatccccaaagatgcaaagcaggtattctcagctgctgaaagctgacatacagaaagaaaaagcaggtgttccaaggatctttctgggagaaattgctttattaaaaatttttttgtagagacagggtctcactctgttgcccaggctagaatgcaatggctattcacaggcacccacaataaactgcatccttgaatttctggactcaagtgatcctctcactttggcctccaaagtagctggggctacaggtgtgtgccactgcacccagctgagaatataaattataagttagattgcaacccactgaatctggccaaattgtcttcaggctcaaaaacctcaaatgcaaacctgttctttttttttaaattattatactttaagttctgggatacacgtgcagaatgtgcaggtttgttacataggtatatatgtgccatggtggtttgctgcacccatcaacccatcatctaggttttaagccctgcatgtattaggtgtttctcctaatgctatccatccccttgcccccaacctcccgataggcccaggtgtgtgatgttcccttccctgtgtccaggtgttctcattgttcagctcctacttatgagtgagaacatgtggtgtttggttttctgttcctgtgttagtttgctgagaatgatgttttccagcttcatccatgtccctgcaaaggacatgaactcattcttttttatggctgcatagtattccatcatgtatatatgccacattttctttatccagtctatcagtgatgggcatttgggttggttccgagtctttgctattgtaaatggtgctgcaacaaacatatgtgtgcatgtgtctttatagtagaatgatttataatcctatgggtatatacctggtaatgggattgctggaccaaatggtgtttctagttctagatccttgaggaattgccacactgtcttccacaatggtcgaactaatttgcattcccaccaacagtgtaaaagggctcctatttctccacatcctctccagcatctgttgtttcctgactttttaacgatcaccattctaactggtgtgagatggtatctcattgtggttttgatttgcatttctctaatgaccagtgacgatgagcttttttttcatatgtttgttggctgcataaatgtcttcttttgagaagtgtctgttcatatccttcacccactttttgatggggttgtttttatcttgtaaatttaagttctttgtagattctggatattaggcctttgtcagatagatagattgcaaaatttttctcccattctgtaggttgcctgtttactctgatgatagtttcttttgctgtgcagaagctctttagtttaattagatcccgtttgtcaattttggcttttgttgccattgcttttggtgttttagtcacgaagtctttgcccatgattgtgtcctgaatgtattgcctagggcaaacctgattctattataaagcagacactatcgccattatattaatttcatctggctaccgtgacaaattaccatagctgatggcttaaaatggccgaaatttatctcacagttctggaggtcagaaatccaaaatcagtttcactgggctgaaatcaaggtttcagcagagccatacttcctccagaggttgtaggggtgaatcattcctttcatcttccagctcttagtggctgccagtattgcttgacttgtggccacatcactctaatctctgctctctctctttacatctctttctcctctgtgtgtctctctagcctccctttgcctttctttcacaggggtcttgtgatggtatgaagggcccatacagataatctagaataattttttcatctcaagaaacttaaccacatctgcaaagtctttgatgtatatatatggtaacatttacaggttccagggattacaatctaatatctttggggcaattatttaacctactgaggccatctttttcatctctaaaatgtatacacacaggcatatgctcatacattataactaataacacatgtttaccaaaaatatacacggtgtacatagaacaattttattaatccttaaacattactactctgaattgggcttagagcatttggtaggagggtcgatgtggtatagtaggcagaaatctaacatgggccctatgacctccacaccctgtgtaatccccttcccttgagtgtagccagggcttgtatctgcttctagccaagagaagatggcaaagatgatggggtgtcactcctctgattaactcacattatatgcccaaggtgatgggttatcaacccacaatgactccatcttagcagattagagcgaaagacgttctcttgctgtctttgaagagcaaaattccatgttgttggcatgttgtggagggggccacatgtcagggaactgcaggtggcttccagaagctggggacctcagtcctacaactgtaaagaactgaatcctgccaaaagccagtgagcctggaagggaacgtagagcctcagacaagatcctagctctggccaacatcttaatttcagcctggtaagaaactgagcagaggacccagttaagttgtgcccagactcctggcccatagcaactatgtgtgtgtgtgtgtgtgtgtataacacacacacatatataattacatatatacatatatgttgtttaagctgctaaatttgtggtaatttgttatgcagcaataaaaaactaatactcttggtttgcaaagtgtttattatcaagatataaggtagagaatgaataagcacagataaccaaaatgaagagaatcaactgcaccaaatggccagatagcaaagtgcactgggaagaaaatgtaggttgcatatgtgaaatggttgacagccagcaaatggatttacattaactaggaaatatatgggaaataggtttgggggaaacttagaagtgaaaaggggtgagttttcacctaactatttcagttacaggagtagaaatccaactgaaactgaccaaagcaagtatgaatgaataaattcaatgaagatgaatatggagagtttattggctcacatacctgatcagcccagacgtatctggcttcaggcaccaatgccctgaaatctgtctctctctagctctcagctccctttcctcagtattgatctcatgctcaggcagcctcttccagtggagccagaggtggccactcataggtccaggcttatattcggctcattgagcaacccgttgtggaaagtgagattctctttcccaataattccagcaagactccctcagttatccttcactggctcactggctagacctgagtcatctgtctaaacttgataccaaaaaggggcaggagagcaaagctacccaagcccaaaggaaaactgggactctcttaccagaatggggattggatactgtgcaggcaaaaatcacaggtgcccatgacataggatgcagtatggtagaagtgcatggatggcaactccacatttgggaaaaggatggaagaggccttgtaaagtcaagaaccaaataaccaagcagtaaatggaagttcctatgcagcatacacagagaagaacttgcagactgagatacaggaagagatgtttgggtttaaaatgggtcaaggtgtttgtttctttgtttgagatggagttttgccctgtcgcccaggctggagtgcaatggcacaatcttggctcactgcaacctctgtctcccaggttcaagtgattctcctgcctcagcctccggagtagctgggattacaggcacccaccaccacgcccagctaatttttgtactttcagtggagacagggtttcaccatgttggccaggctgctcttgaaatcctgacctcaggtgatccatctgccttggcctcccaaagtgctgggattacaggcatgagccactgtgcctggccaggtcaaggtgtttgatctgctggggttgataagcaaaataatccctgggaaaaatctcagaaggggcgtggcttgattaaactggcagaatcgctttctagcaacaggtgtaacttgtatgaaaagggatatcaaaaaaaaaaaaaaacaaccaaaacaaccctacattcttttcacctatggaacaatcatatgtctcaggtgccatggtttctaccttaccttcatgatcagatttatttctcaccaatagccctacaaagtaagcgttttaacacttgaaaaaattcaggctcaggaggttaagtgattttccccaggtcactgacctagcaactggcagaacaaggactcaaattcaggtgaatgtgtctccggagtcactatgctaaaccccctatttctgaattagagatgttcgggtttcaaatgggtcaagatgtttgatctgctggggttggtaaacaagattatccctgtaaggactttaggcacctgaacgggacatgagaatggagaaatgcacaataatatgtaacattcatactgtgaaacactatttcaaagcctcctgtgtggatttaagtgggtagtctacttttactctggcctaagatttaattggctaggatatcagaagaagccaaaagccctttggaaaaagaaaggtggatccaaaagagcagaggaactgtatgaagcaaagatgccagggaggataaatgaccaacaatatgttaccagatgcgccctccctgagaacactggacttggcaagggtaaacaataagagaggaagtcagggacggagagggccagggaaagttcaggcctccctccctcccacgccctcactccccattgtggctcacactgagtcagcccagatgggaagaaggcagagacctcacccacccagtgtccaccctacccatggcctggaaataagtgaggatgagatttgtgagggcagcttagatacacccaggtgctacttggtcccccttttcctccaccctcacacagccccagaggtgccagtagtcagatctctgggagacagtataccagccaggcccttgaattctggtgccagctctagtattaattaccggatgactttgcataaggcactttgtgtctctgggcttttatttcccgtatgaagagtcatctgaggttgaattagattagggattgtacatgcaagtgccaacagaggccaggcaggcaatgaaaatgtagcaggctgggtacaggatgacagggaacagtggggactggagagcacatgttttgtccagtgagggcattcccagtgtctccagatgctccaatttttcctgggaagccacaattcagacttttacataaagtctcccaatctttaagtgttggcaacaaatcaagcctgcagagcagttggcaatcttgagtctagatgtgccttgtcccataagctagtcactagccacatgtgactatttcatcttaaattaattaaaattaaacaaaaattaaaaattcacttcctcagtcacaacagccacctttcaactgctcaatagccacaggtattagtggctaccatattggataacacagatctgaaacatgtccagctttgtagaaaattctcttggatagccctggcctaagtgatgtctaagataactttcagctagtaaaacaaaaaataaagacaaaatgaaacaaaggttactttcttaattgataggaaacaacgctactggaatttcgtggcataaccataacacaaaaatattggtgtcattattttattttcactctgatgagttcccttcagttgcatttaaattggtttctgcagatctgttaatagaagcagcctgatactttctaatctgcttcaacacacaaagtacattcatagggatttgaaatctaaacttatattaaaaggagaggggccgggcgtggtggcccatgcctgtaatcccagcactttgggaggctgaggagggcagaccacttgaggtcagaagatcgaggccattctggctaacacatggtgaaaccccgtctccactaaaaatacaaaaaattagctgggcgtggtggcatgtgcctgtagtcccagctactcgggaggctgaggcaggaaaattgcttgaacccgggaggttgtagtgcgttgagatcatgccactgcactccagcctgagcaacagagcgagactctgaaaaaaaaaaaaaaagaagagaaaaggagagggggcagggaagagagaaaccctattttacttctagtacttacccctcccctgctaggtgagatatcacttccatacagagcttttaactgcctgtgcaagagcctccattgtgacaagctgcaatgttttaggtcagtagtcaccaaacttttctataaaggaccagacagtaaatattttcagctctgtgggctatatgatcactatggcaattattcatttctgccttattacatgaaagcagctatcaacaatatgtaagcaaatgcgcatggctttgttccaataaaactttatctgtggacgccaaaatttgaattttgtataagtttcatgtgtcaaatagttacttgatttcccatacaaccatttaaaaatgaaaaaggaaaaaaaaaacattcttagctcaggacggtagcaaaacaggcagtgtgctgaatttggcccacaggcagtagcttgcagacccctatgtcctgaaagttctctgatggagagactgctgaactgtagggcagggattgctgagctctgacttatatatatgactcactgggcatgagtcccatgtaagttgtatagttagccaatgttgttcaggaatgaagggaaggaccataagggcccttttttgtgagacaaatttattgatatagtcagtcctcattatttacaaaattcaaacttgcctactggttagaattcattcataactccaaaatcaatactcaaggtacttttttgaaaaatagagacaggatctcgctctgttgcccaggctgtagtgcagtggcacaatcatagcccactgcagcctcaaactcctgggctcaagtgatcctcccgccttggcctcccaaagcgctgcaattacaggcatgagccaccacacttagcctttgctcgaggtatttttgcaatcattctctgacttgtggggaacagcaaaaaatttgagtcacccaatgctcctgttctcagctgagatataacaaaataaagcgctgccctcttgtttcagttcatgttaggtacacacgtccctttcagagtctatgtagcaacctgttttacacatgttggtgcttttggttggtgattttgctgtttaaaatgccccctaagcatagtgctgaactgctaaattagctgtggtatgaatgtttgtgtatttccaaaattaatagtttgaagcttaatcacccgtgtcagaatgataggagatagggcctctgggacatgattaggtcatgagaacacagtcctcatgaacgggattagtgccctcatgaaagaggccccagagagctgccttaccccttctaccaagtgaagacacaatgagaaggtgccatttatgaaccagaaagtggacccttatcagggtctaccaaatcaagtggactgtcaagtggtattagcaggaccctcatccattgacactgaatggcctggtgtcttcatggtgaatttcccaggctccagaactgtgagaaatacatttctgttgtttataagctacccagcttatggtatttcgtaacagcagcccaaatggacaaagttcctaagtggaaggcagctgcaatgtccttgttaaaaaaaaataatgtcttagataagcttcattcaaacatgaattatagtacttttgatatgagttcaatgttaatgaatcaactacatatattaaataatgtgtctttaaacagaaacacacttaaaacaaggttatgtactgactggctgatgagaatgttgtgacgaggtttatagcagcataacttatttccccctaggtgtgatgtttcagtatttgctaatttggtgttcatgatgcctttactgaatataactacctcaaataatgagaactgactgtatactgacactaaaaggacaaggtctcactctgtcacccaggctggagtgcagtggtgtgatcatggctcactgcagcatcgaactcctggactcaagcgatcttcccgctttggcctcccaaagagataggattacaggtgaaagccacagcacagccaggattgtattattaaggcacatgtgccttagtctgtcacttctgagtggtttctctcttagcttactaatataagaagcaaatccacagacaaagagggatgggaataagcaattttcataagaaacacaaacagccaataaatatacaaaaatccttcactgatagtcggaaataaatattaaacaaatgagatattttttctcctattagattggcagaaacagaattacttttataagacaaaagaattgaggtaagatatatgttgactaccttaaatcccaatatgggatttaaataaaaaagcaacttctttaaaaattcaaagatgaatttaaaatttgcttaggaaggtaattctgaagctgatttcaagaggcaaagctaaaataatgaatgtaagattctaaataacaagttatatagatgtaatatagaaaaatcacaggtgctgttgaccttatctttagcctttggtaattaggacttgaactataacagccttttatttctacctacccgcaaccctctgcttttatgtactttacctctgcttacttctctgcagccagacagtgacttaggcaaataggaaggtaggtgatgtgctattagtgttttaaaaggctttcatctcttccatggtttttcatggtgttattatctcttatcagtagttaatttatatagtatttccatgatgccttcttaacaatatccagtgtattagcgtcacctccttcttacacagtaaattcatttcaacactgcattggccagaaaggacatgcagtaaatgttaatcaattctattgccataagaaacgtgcatggagttaaagttcacaagaaacagaagctagagaactaacagcaaagtggaacttgctgctcattagttcacgaacacactccccaaaagtgaagagagacactctcacctgaaactagtgctagaagtagttatcctgttcacacagcacaccctactgcccatgggggaaagttcacttccaatgcacaactgagaaattaaatatggaccctgctggccagcctccacctaaatctcatctctaatcgatctgcaattcaataacatgcatgtcttcttttgcccctacctttcgtgatggcttcagctgaaacataaaagggctttaaaagattaatagttccatcttgatgccaggtgaagtaaattcccaattcattcaatcctcactgtgatgttttgcacttggtacaaagtagatgcacaataatgttttataaaagcaccacaataagataggtattatttttatcttttttttcagaagacttaaaaggattaattagtaactctccaaagatcccaaagcccaagtaagtgggggagccaagagttgaacctcatctaactccagagcgtatgcttaatgactacactatattaccctcttattctttaatgctaaaataagctttcagcattaaaaagaaatgaaccgtcaggtgataattagtttcaaagtctaccataacaggttaggccttttaatagctttaataccacagcttttgctaaagattgatcaagaacacaggccatttcctaaatacctcacacaaaggcaactctaagcaagtgctaattttaaaacagggcatatgccatgttatcaataggaatccaaagttaaacaacagaatgggctaagtgtggagcttctggcatatgctgggatgtaacagcccttctctttaaatcaggtgttgcacccatatagtttgctaaggataaggtatgaataaggaaatgctggggctgtaatgaataggttttcattattgtggatttgaaacaaacttttaaaagcgtgtgtgtgtgtgtgtgtgtgcatgtgtgtgtgttgggtaaaggattacggagattaacattcaaaagacagtcaacagagaatagtccagaagtggaaggaatttacgacttagccttagagttttctcacgttaataccaacctattggtaatgcctgcctggagccctgtttcaggaagtattgtgagacccgttctgagttctacaaagaaagggtgctgtgttgattaataatgtctgtcctggcagaggaaaggaggggagcatattaactgcatagttgcttttcttaggactagaagattcacaggagtgccatatttgttcattaccacagagctatctcagagctgccagctaggactgagaggaaagatcacactgcagacccaggatatttaaatcagaaaataattttaaccgtgaaaacacagggtctatgggatttatcctcagatgtaataagataagcccacagatgcgcttaggggctgagatgacagaaaggccacttggctgagaaacaggagggaaaaagagccaagcaatatggctgagaatttgttctccatactggtacaacagagcttggtagatttgctatttctttggctcagcctcatagattttggaaatgtgactatttatagggattcttatttttttatttctttcactcatcccttaaaagttttaagcaaagtctacttgaaaaatgtcagcctgtctcaggtgtgctgagagaaaattaagttttgtcagtgtttagtcagaatataaaaggaggggaaaactgacctctggtggtaaatttggaaaatccctaatacaaagatttccaaaaagtgatccaggaagcattaacccctcaatattttctgtgggagaagggctctgtggtaaaaataactctgggaaacaattacatactatataaatataatatatatttatatgttatataatatatttataatatattgttatatattacttaatatacctgtttttttggcaactcattgtgtttaagcccttaagaattcctgcagaagagaaactatttaatgccttttaattcagcattttctaaatctgtttgaatataaacatgaaatatatttttaaaattaacctaacattttgggagacatgaaccttagggagaagaatataagatcacgttttccccgtccaatatggagaattcctttcagagctcttctctgataaaaccttagaacacttgtgtttttacacgtagccttcccttccttgttctcctccatgactgtgtttagtaagaagctaggtaaatgttttttttttttttttttttttttttttttgagacagattcttactctgtcacccaggttggagtgcagtggctccatctcggctcactgcaaaatccaactcccaggctcaagcaattctcctgcctcagcctcccaagtagctgggattacaggcatgtgccaccacgcccagctaatttttgtatttttagtagagactgggtttcaccatgttggccaggctggtctcgaactcctgacctcgagtgatctgcccacctcggcctcccaaaatgctgggattacaggcggcgtgagccaccacgcccagccaagaagctaggtaaatgttaaagaataatttcccagttagagacaaatcatttacatatttcaagttaacaagcatctactgaagaaaagctagtagctgtatcagtgcactcaagcttttcagttgtaactatgcagtagaaatcttaaaaaggccaacatagtttatagatgactcttctaatacagaagctcttcagagctgggagttggtaaaacagtggctcagactattttgtgctctggagctatataattttggggtttgatgacaaccagttctgcatctcactagctgtgtgacctggggcatgttacataacctctctgttctcagtgatctcatctgtgaaatggaaatcacaatatctcctagttctgctggggattaaatgagttaacacttgtaaagttcctaaaacaacaagtgttaactcttttaatccccagcagaactaggaggtactatgatttggcagttggctggtaatttgttgcttcttaatttgcaccactaaagttaggtgcatgaggcatcatttaaaaggaaaatagattttttttcttttaaaaatattgtacttttgttttagatcctgagactactaagaaattttaactgattgtcactaaaatgtattatggtggtattttaaactattaacactttttctttggaaaaaccaggaaagttttcctcttcttaacattaaaaaacactgtggtaaagtagataaaacaaaaattcatcatttaaaccatttttaagtgtacagttcagtggtattaagtacattcacattgttgtgcaaccatcactctcatccttctctagaacattttcattatctcaaactgaaactctgtgcccactaaaatgtaactccccattccctcttccctacagctcttggcaaccaccactctgctttccatctctatgaatgtgactacactaggtagctcatacaagtaagatcacactgtattcatccttttgcgactggcttatttcatatagcataatgccctcaaaggtcatccatgttgtagcatgtgtcaggatttcataatacacaccattttggcagcttttttccctctgttacttaatacctttgagagatctaccctgacactttttaaaggtcagagtgttctattagatggaagtaccatcatttatccacttctctcctatcaacaaccatacaaattgcacccataattttgctattataacaatgctaaagtgaacacacttgtgcatatatcattttgtatttgtgccagtttatctggaagataaatccctaaaagttatgttacctggtcaataagaatgtgcatttagaattttgataagtattgccaagttaacttctaaaaatattgcccctactggcattctcatcaacagtatatgagagcctttttgtccatatccttccaatgacgagtatttaaaatatttttttgtccttgccagtctcataggtgacgagcatggttatttaaaatagatatcccgacacaaagaaaagataaatattcaaggtgatagacatcccaattaccctgatttgatcattactcattgtatacatgtatcaaaataacatatgtatccctaaaacgtgcacaactatgacatatcagtacaaaatccacacacatgaaataaaacaggtataagggaggacttgctggtatgcaacgcgggcagaagggtgcttgggtgaaatttgagggcatcagaatcctcctctggtctctatttggagacctcttctttttttttttttttttttttttgaggcggagtctcacttactctgctgcccagactggtgtgcagtggcatgatctctgctcactgcaacttctgcctcctgaattgaagtgattctcctgcctcagcctcccaagtagctgggattataggcatgcaccaccacgtctggctaatttttgtatttttttgtggagacagggtttcatcatgttgaccatgctggtctcaaactcctgacctcaagtgatccacccacctcagcctcccaaagtgctgggattacaggcatgagccaccatgcccgggcctggatgactcttcttattgatccaaggcagagaatggtattctagtacaaacgggactagaaagagttctgcttggtactataatcaggactgatattgagtaggaatgcacacatacagctatgcttagttaagatattgacaattccaccatagtggttggcaactgaccagtccctgagccccattcttgaatcccagccacctccccacaatccagcacctcaagggtaaaacgtactgccacaagaggccctttcagaccctgcccagcactatgggcaaggcctatttaggctgatccttatttgtgctgagaggctgttaatagtttcaatattgctcctgcctacctgggtctaactttttgtaagactcccttctatttctgagcctctagcactgttgtaaagatgttgtctgtctatttcagttacaagatcctgtctttctcattcattctttcactctcaaaatgtttactgagtacctcgtatatggcaattgctggaccaggatcccagaatattactgtgaagagggcaaatgctgtcccaggcctcagggaacttatacaccaggagagaaggcaggtgaaaagtaactgaagagacaaattaattcatggtagtaacgagtgctataaagaaaacagggaaggctctaaaggtgagttaatgaatgactgacttctgccctcattgcgtatctgtgcatcctctcttaaacctacttcaaataatcaagttcagcacctatcagactggcaaggatgaaacaactttggaatactccttgttgcagggatatggaaaaataggctctcatatccattgttgatgagaatgacagtagggacaatatttttggaagctcacttctcagagggggctcctttagtagagaagccagagaagccccggtctaagacttaaaggaaaaagatacaggaacaagggagggaaagagccaggctgcattgtgcagtgggtgcaaaaaatccaagtggaaaatcgctgcttgtgttttagagggaatcaaagaaggcaagaatgaggacagggagctaaggaggtgaggctagagacaatgtctgggaccaggtcaagtctagccttacagattacagcaaagagtttaagatggtcttatttgtaacttaagaaaagtactgcatcatttaagtctgtattctccaatgcttcttaaggtgcttgaatcaaggagacaatcaataagagtttgtttgagaagtacactgagcccctgtagcttttttctatctgtgcctggcacccatcagtcctgtgacagctgcttgaacagtacaaatatgcccagagttaaagaactgatatcttccacttgcccaacatctgttatgctcttccacatctttgcccctttaaaacaaacaactgaaatttccatccctgaagtacactttactcaatgataaaatcaaccaataattactgagcactttttatgggctcagcattctttcaagtgctttgcctatattgactcatttcatctactgagcaactctataaggtaggttttaatatcacccgcattttacagatgaggaaactgaggcaaagggagattaatcattttgaccacaattatgcaagtggtaggtggtagggcaagatctccagagtcgacgtccttgactgctacatctctccagcaggcgccagcatgtggatttgcaatcttaccattgatttcatcaaaggaagcattttgagacataaaatgctgttcctaactgttgcacattttactcacgtgcagttcatagttgtgcatattttacatcaatgtccttcaaaccgtttttgcctgtcagatatgaacttctgagagcatctcatgaagaaacattttgagatctcatctggttgtgttgcctacatgcctggcagtttggtttctatagcattgctatcattatgacaatgcttatgcaactgttcaaatattccatccccctcttattatattataaaaaagcagtggaaaatggaaaataaaacgccagtactgatactaaggatacaaagctctcccttactccaattaagctaaagatgaaaatcattgcacttataaaaagaatcaattgtttgctttgctcagttgtcccctggacttaagctggtgaagctgttcaactgcaaataaaaagaaaatacttttataaatgcgtgtataaatattggaaatataggaaatatgtctaaggcacagcacaattagtacttttttttgtttattttgctctgtgggaaaagacctataaaatgtaagcatatcattcaactttggggtgtttgactttcatttgaaagtaggggagtaacttaatttattaattttcttcatcatttgctagtaatgtaaatattttgttaatatgccatatcatatatcatataacatcctgtccaagccccgcttgacaagtcaatgtgtactcacatgcaaacacacataaactcacttttctattctatctaacatatcaaagagttcagcatttacagaaacgtcaacttacctttaactagtaagtattctcttgcctttcttttgtttttactgtaataatcttcagattttgtttgctatgcatagatgtcatctttttctttcatacactctttcttctggatttctcatcaaagcctgtaatacagaagagagaagctccttaatttctgtaggcacaggaggagaaactataaatctcaagtcagtgacacttctaatttatttctaattttcccctggctgactacagtttaatcacagttttagaaattcacctaattccatgagatttagaatagagttctctcgaaatacagatgaaattgaggctagtctccttaacaactaaagagttcataccaatttggcttcttacaggatgcatgtcactgaatacaccgttttagacttctactgtctctgtaggaggagattctgaagtgctcaaagttatctacactcagttgcaaaatcagggctgtcaaagtgggagagagaactcagtaatacatcccctccgaagccatgtttcagagttactgaaaccagaatggcattcctgaatctttttttaacagatgtcagtgtggcgagaatgaaacacgtcatgaatactgatgaaatctagcgtgcatatcacgccataagatatcctcatttatatgtatttctcattctccctactacagaaaagaaaacagcttttcccccagaagctccacttcagtcaataagcatgcttctcctttgtcacttgtgaggtcacactgtttcacacacacccaagtgtaaaaacaggacaaggagggaggcagaagtggcagatgtggtatcccttgttctgccatgtggtaagtgaaactctctgtggcaccatccgcttggcacctccccacaccacctgcccctccactccccctggatgtgcaaggcatctaggtgcaagatggcacaagaagcaggaagtcaaggggatttcctcacaaacacctttgccctctctctccttcctgatgccatggaacaaagtcatttttctagcaggaactccatattcaaggagcttaactcaaatgagagcacagaaaggagaaaaggttgagagtttcctacaggcaataatttttagtacccctttaggaggaaaacatgttgggcatggatagttatggtttgggtagtactaagatcagtatgaaggattctcacacccagttatcctcttggtcctcatgatctctcagtgaaacattaggcaaaaagaggatacactagagatgtgttttagtctaagcccccactttacaaataagataaatgaggtacagaaagagagagagaaagcaacttgtaaaatgttacacagggcagagctggcactggaatgactcagtacattttctgccttatcacgtcatctctccacatctttcttgtgtctgcccggcgacaaaagctccttgagggattaagccctgtaaacaatgatataccaagcagtgtctaatgtcacgtgcaaagaactagttaaatcccttgcttctttagtgggtgttaacaaagactacacagctgctgtcaacttggatcacaaaggcagaaaaaagagaaataaacagatatcttctggttgccttcaatagctactatttgttaagtgtccaacataagccatatgctatgccaggcacatcacttgtattctgctaatgcttctagaaactccaaagataatatggatgctattatactaggaatacaaggaaaccaagtcagggaaatagataccttgtctgaggttacacacaactggttagttctcagattccattcctgccggcaacaagcagcactataaaccaaagaaatatgcatctacttgaaaaccccagaacccaggaatagaaacaaagtggacagtatttggaaggaaactaaagagagaaacaaaggaaaactgagattagagcatcatgggaatctattctacaactattaacatgcaggagggatatgttttaagatctacgaacacaccaaatatgcaaatataattaaagcacttgactccacctataaaatttggtacaagatacttgtgatattgggtatctgggaatgagcaaagaaatgttaagatctcaatgagttggggtagatgagttacaatcacgcactatattagtttgctagggctgccgtaacaaaataccaaagactgcatggcttacagaacaaaatgtatgttctcacatttctgaaggcttaaagtccaagatcaaggtgtcaacagagctggtatcctctggggcctctctccttggcttgcagatggccacctctttacatggtctttcctctgtacccaaacacccctggtaccactttttgtgcccatatttcttcttataaagacaccagtcacattgtattagggcccatcctcaaggcctaattttaacttaatcacctctttagagaccctatccacatgcacagtcacattctgaggtactatgaattaggacttcactatatcaatctaagggctggccataattcagcccataacactcaccaagtgactagttctggtaccgcagagatgaaaatccagacacctgaaaagtaacaacctatcatcaaccttcagtgtcattcatgaagagctgaagccctctaatatttgaattcaagttcaggaatctaagggtttactataggttttaggttaaaaaaaaaaaaaggagaggaaggccatttaataaaccttggtcattatggtgtaaaccaagcatcacaagactatgcttgccagttaaatatagcatgctgcatatttttctaaataaagttttattggcacacagccatgtctattcatttatgtattgattgtctatggctgttagcgagctacaactgcagagttgaatagttgtaacagaaactctctggtccacagggctgaaaatatactctatctggccctttacagagaaagtttgctggccctttacagagaaagtttgccaactcctggtttaaactgtgttaatcaggtttctttacagtagggcttttcaaggtctttccaatcttcaaggggaagatatatagtaaaattgcatcttacgtgggaggtagtttctaaagtcagttcaaagtgaaaactgtgtatagtcaaaatgaacactggaaaatcccttagggaaagtgccaacatagagcccagcaactacatcatcatgaatatagccagtttttccttcaaagttgcaacagataaaattttcttcaagcactacataaaaggctctatttatgggccatttgtataaaaaggtgcatatctttagataacagaatcactctcagcataagagacttgagaaaactgagaccaatcaaaggacaggagattcagttaccacctcctactcacttgttgaatttgcagaagttatgtatgcactggaaatgactctactggagtttgcttcctttctcagcttacttcaccagagagttcccctccctcactattcttatcccatagaaacctctaatatatgcaatctctaatgataaatatctaataataaaacctctaataatgcaatcaatattctgtggagcacactttgggaaatgctgaaatactaaaaaacgtaggtgttacggatcaatcaatcagacggaaatatatacaatgctttcttaacactgataataaaaaaactgtaggataaaccacaatgagataccatttcacacctactaggacggatatttggggaatgaaaggaaaataagaagtgttggtgagaatgtggaaaaactggaactctagtgcattgatgatgggattgtaaaatggtgcagccactatgaaaagctgtttagtagtctctcaaaaggttaaatatagaattaccatatgatccagcaattccatctctgggcagatacccaaaagaattgaaaggagggccttgaacagatatttgtacaccagtgttcatagaaacattatccacaattaccaaaggtggaaacaatccaaatgtccatcagcagattaatggataaacaaaatatggcatatacataacatggattataattcttttcaccttaaaatggaacgagattctgatatatgttacaacataaatgagtcctgaaaacattatactaaatgaaataggccagacatgaaaggacaaatattgtatgattccacttacatggagtgattagtatctagaatagttgaatagtaattattatctagaacagttgaatacacagagacagaaagtagagcagagtttacaagaggctgggggtactggggaatgggaagttattgtttaatgggcatagagtttcagttcaggatgatgaaaaatgttctggagatgaatcgtggtagtggttgttcaacattgtgaatgcacttagacagagtcttactctgtcgcccaggctggagtgcagtggcacaatcatggctcactgcagtctcaaacccccaggctcaagcgacccacccacctcagcctcctgagtagctgggaccacaggcacgcgccaccatgcccagctttttaaaaaaaatttatagagatgaggtctcactatgttgctcaggctggtctggaactcctaggctcaagcaatcctcctgcatctgccttccaaagtgctgggttcacaggcatgagccactgtgcctggccaattgtaatttttaaattgataaaatggtaactcttatgttatgtatgtgtgtatatatacatatatataatataaaatatatacactagtgtatatactagtatactattcatagtattatacataacatacactgttatatgtagtatgtattatataatataataaatattaattaaaatatataatatgtactattatatatcagtatattatttacaatatttaatagtatattatatatactatataaatatatatactatatatatacagagaaagtttgtatacatactatatatactatagtatatatgtagtatatatactatataaatataatatatataaatacatattatatacaatactatataaagtatgtataaatactatatatactatatatactatatttatatatatttatatttttatatatactatatatatttatattcatatatagtatatatactatagtatatatgtagtatatatgtagtatatatactatataatatatactattattgtataatatatattatatattatatatactatataacatatactaatataatactacataaatatatactattattgtaaataaaagtatatataatactgttatatatactactatattatatgtaactatatatactactatatgatatataattacataatatattattatctattatatataatataatagtatatacatatatactgtcaagatagggtctcgccctgtcacccaggctggagtgtagtggtgcgattgtggctcactgcagcctcgaacctcttggctcatgtgatcctcccacctcagcctcctgagcagctgggactacacaggcggcattaccacacctgggtaacttttaattttttttgtagagacaggttctcgctttgttgctcaggttgttcctgaactctcggtttcaaatgatccttgggccttggcatcctaaagtgctgggattacaggcatgagccactgcgtccagccttgttatgaatattttaccacaataaaaatatgttcaagacaaaaaaggatatagaagcaaaattgtaggaatggggatggggcagacttaaattatttagacatcacttgaatgtgtcattctgctaaaaatctagctgttgacaaattcctggcttgcttaggtgacaatttcaatacttggaaggcagaggatgctacaaggggaagtgttcatccaggaaaaccttttgggcaatagataaatgaagcaaaaaagtggtcacacactcttggagttcaaagcagttgagggagggatgctggggtccttgcctggctcctctctggttccagtactgcctcccaccacccaatctccatcctcacccttccactcatccccattcactgtatattcagcagccaaagtgggggtaaaatatggaaatatacagaagaaaatgcaacaaactcctatccatgcgcccatcagtcaaaactaacaaacgttgtttttcatattttttcacatcctgtctttactcttttaagtgatagaaccacacagaatttatcttctatgttaatttctccagtccaattctttcttcatcttcagaagcaaccattattctgaatttggtagatatttagttcgtgtgcgtgtgtgtgtatgtgtgtgtgtgtgtgtgtgcatgtgtccaaacatattctatgattttgtaattttaaaactttttataaagagtattatgctgcctattatattttgctcaacatggttttttgcgatctagattattaactgttgcatagtgctctgtcgtatgactgaattacagtttaattctccatttgtggactgatggctatttgggtagtgtccgatttttgttataacaaaggatgcgacagcacacatcctcatgattctccttctgtacagaggcctccctgtttagttgtgagaggtgtttggggcacaacctacatgagagtacatggcagtactgtgtgggtatatgcaggaatttctcctggtaaatctcacctggggtggtccaatcctccaaggtattatttggaaatgtgggagaatctttcgtgagatggggatggaatggggcaggggatgctaaattttgtacagtgcatgagagtcctaaatattttgtcccccacaaaataccaagagtccctcctttgagaaatgctgctgatttctgtcccgaagtagaatctttgtgtggtagaatctgtgtgtttagaagtctaactagggaatgacaacttgctctccaaagtgccacctgccacagctcagagtgcctgtttacctcaattctttgccaagtctcattgtcagccttttgaatttctgctattgtgacgggcataaaatgcagtttcattatgatttttaaacttgcatttcctgcttttattagcactgtggaaaaccttttcaatttttactgctcattcatgtctcccccttgtggaagtgcctgttaataagctgtctatttttctattgggtagtttaaatttccctttttgatttgtaggagttcattagagattctggaaacttgcttttggtagttatttggggttgcaaatgccttctaccagtttgttgtttgtctttttattttatggtgccatgttatgcagaagttatacattttgatatagtgaaattcatccaaacttgagtgtgacttttgagactctagtttataaaatctactttattctaagattcctttctccccatctaaaggttttacatttttatttcttatatttaagtttttaatccatctcacaatttattcttgtacaaactgttatgtaagaatctgattttttcttcttacaggctatcagttgtaacaataccatttacttttgatactgtgttttcctctgtaacttctaaagcatcctatatcatatagaaagaaccatatttgtttagttcatcattgggctctcttttctgtcctattgatctatttttcaattacccttcaccagtaatactgtctatggctttataataaattttgatagaggaactcctaatcttttattctttcacaaaactcccttattaaattcttgaatgtggctgggcatggtggctcatgcctgtaatcccagcactttgggaagccaaggcaggtggatcacttgaggccaggagcttgagatcagcctggccaacgtggggaaaacccatctctactaaaaaaaatacaaaaattagccaggtgtggtgatgcacccctgtaatcccagctacttgaggggctaaggcacaagaatcgcttgaacctgggaggcagaggttgcactgaggcaagatcatgccattgcactccagccttggcaacagagcaagagactctgtcaaaaaaaaaaattcttgaatacttacatttgcattcatatttcagaatgctggggattttgcttagaactacaatgaatttgtaaatactcaacatttcatgatattgatcttcctttccacgtatatggtatatcttgtcatttctttagctcttttaaaaataatttacaataacctttttttcctgaagcagatgtatattttcttaaaacgtactctgagtttctgagtggttttgagctctggagtgatttttttgaaacccaaatctgaagatagcaaatcatccctccctgaatgtagctcccctgaggctttctgttacactaagaatgaaatttgaactccatactggagcatgattataggacatggtttcctatcttcctcctggacttttattgtatgttctgttagtcattaagctttagccacagtggttttctttacttttttttctaaggttagtcaagtgaggcagtgagagtggagtggttttctttatgtactcaaacataccaagctaattttattttgggacccttgtccttgaggctgtgttttttctggaatcttgttccccagatatgcatatggctagtttcttcctgctgtttgggcctcggttcagatgtcttctctcagagaaactatccctgcccaccagagagtagccctccaaccatccgtaatgacatagcttctttatttcttcacagcacttgccacaatttgaatttatcttctttgaactctttattggtgtattattccccacgatatactataagctccacatgattgaggaccttgctgccttgttcttttctgtgtccccagaacctacagcaattcctggcacatggcagctgttcagtgaatatgagctgaatggataactgagtggaaaaatgaactcacgtggatctcccctaatgcccctggttgctcctcctgtgtcctcttatatcaacaaaggggtatttcctttctcccatatattagcagtaaataatgatgtaagacatttctagtctcttgaacaaatagtttaactgcagaaatacttacaaaacggattccaaacacatttatgttctgcattccaggtttccaagtggcttagaacagtgaaagtgccactgtctattcggcccatttctactcctaagagatagctattaagtttatttgcataaatccagaaaccatttatccatttacaaatctccagctatctaatctatctcagattacacaatctgaatgattcaccaaagaagtttcttttttttttttttgagatggggtctcactctgtcactcaggctgtgatgcaatcatagcttgcagccttgaactcctgtactcaagcagtcctcctaactcagccccctgagtagctggaattacaagtgcacaccatcatgctcagttaatttttaaattttttttagagatgggatctcactatattgtccaggctggtctcaaactcctggcctcaagtgaacctcctgcttcagcctcccaaagtgctgggattacaggcatgagccactatgccctgccaataagttttattctattgaaaaattgttatttttaagtgaatctgagtttgttaagaaggcagattgtcaatcccacttctagaggttctgattccacaaaccaggggtggggccttcattttcaacaagcactctagatcattctaacataggtagtccaaaaaccacttatgagaaatactcataagtgagtatttatgagtattaaatactaggttaaggcaatttaatgccatccttatttaagatgatgcagcctcccaaatactagggggcagatggagccatacgtgcacccactgacgtcctatgtcatgtcctctttgcccaagaagagggcattgcggatccatgtgcctccactgaagccctgacaaccagacctgcttatgaagccacataaacattatcagggcaacagctcaaacaggcagtgaggaaatgggttctagactctgagtggctttgggccagtttcttcatatgcacaatgagaaggtgggccagtgtgatgttatgatagaataagaaatctgtttgttcttccccagttcctggcaaagagcttctgaaattcttgtaacttcggagtgattggggtgagagaagcatcttttgttactcataataagcccctttcaaccacatctgagtttatgttaatgagatggctgggggattccagccccacacagcttcagggtgggggctggttgccagaggaaccaaccatgtgattacagggttggaaatttcagtcccaccccctgacccccagggaggggagaggggctggaggttgagttcagtcaccagtggccacaatttactcaatcatgcctaactaatggaacctccataaaaaccctgaacaatggggtttggagagcctcctggtgaatgcattcactttttgggagagcggcacatcccaaactccactggcacagaaactcctgctttttggacccctctggactttatatatacatctccatctggctgtttgtctgtatcctttataatatcttttctaatgaactggtaagtgaagtgtttctctgagttctatgagctattatagctaattgtcaaacctgagcaggaggtcataggaacccctaatttgtagttaagttggtcaaaagtgcagagggcccaggacttgcaattggcatctgaaatggggtagtcttatgggactgagcccttaacctgtgaggccaaaaccacctttgcaaaattatgacagtaagagaaatctgacacagccaactccatcttgcttccagcaacacacacttgctgtcctcactcattcctgggtgtaggccaagctaactttcaaaggaatttggtttatagtttaagcttaaagcaagaatgataatagcccttctgcaaactaaactgcctttgtaaaactaatgaaaagccacaaggttaggattacaagagggcctgaattctgctaagatgtaggcacagttaaaacaataaccagccattgttctggagctcacaagatctgtaacttccccaattactcctgtagatacatcactattgtagaacccaagattggtcttttgagatgtttttcagacttttgcattttgatgactaacttcacccataccagggactcagctggacctgtggcccccacccagaggctgacagcacacgaggaccattttccacacccctctgatttcatctcccatccaatcagcattccccattccctagccccctgcccaccaaactatccttgaaaaaccctagcgtctttggggagactgatttgagtaacagccccaatccttctgcttggccagccttgcattaattaaactctttgtttactgcaataatgctgtctcagtgaattgggtttatctgtgcagcgggcaagaagaacacatttgggtgattacagtatctgatgctaatttcaggtagattttgtgaaatcaaaattgaactgaattgaattgaggacatccagttggtgtatgaggagttggagaactgactgcttagtgtggaaaatccacacatttggtatcagaagtgttgtgattattgacataaagttgtttttttctttcaaccacatagttataaaagtgcattccagctctatcattttatgagacttcaacatctcatggatttctgtgtgattaggttacgcctgactctcaccccataccttccaaattttctaggaggaacttatatcatgtttgtaatggaaaagaaaataaccaaaacattttaaaagataacatttcccattattactcaaacaggattttcacaagctaagatgattgcttctgtttcagtgctatgttcactactcatctccacgaacataaagaaacaacaaaatctctacacacacttatccaccagattgttttaaacaattttcaaacttgttttaataggcaaaactggctctgtaatgctaaactagatgtaaatagcccaaggatccaatttcagccaaaatctcataccacgtggagaaattaagcaattcttaaatatttaataataccctgtaattttttagactcctgggctccaaaatttctgacaaagtaattcctatgccacaattaataaaaatagacaaccttccaaaaagtctcgcaaagcaaaagtaaactcctccgagcactcccgctgcggtcagagtgatgcatacaagtgacatacccgccagaaacgacagcagccagaaagggtttggagcttgccctgaacgggtgtctgctgaaaaggctcataaaaagaaggttgtgattagaagatcatgacatttccagcacccacttattagcatgtctggagaatcacagaagggggacgatgcagtctttataaccagagttcacgtcacaggatatttacaaatactgctattccagtcttcggagcaattcggtctctgctctaacagcagacaaagagtgcagacaccctagccaatcactccaggtggcctcctaagaaagattcctgccaaaccttggctgctcaggccataaacctgtatattcttcctccgcatcatcccacttctcattcattaaaccccctgcttaaaactcctcagtgacttctgattttacatagactaacacttaaactccagctcctatgtggattcctatctacctctgaaatctcatttcatgccagtcttcccttcactctcaatacaccccacattggcctccttttcccaccttactgggtcaagtccattctcactgcagggacttggcacttgctgagtcactgcttggattgttatttctctggatcttcacatagctggctccatctcataattcgaattcaactcgcatgaccttcccagatcactatatcctaaatagtattaagctacgtttgtgttattctctactcctgtttattttctgtctggtcctgaaattacactgtttatttgcttgctggctttcttgtcccactagaatttcacctccaagaggagggagatattgctttgtcctgttcactgctacatcctcgtagcctgggacaatgcacatagtagatactcagtgactatttgtcaaatgaatgtatgtgttgatttatttatttatttattttctgagatggagtctgactttgtcacccaggctggagtgcagtggcgtgatcttaactcactataacctccgcctcccaggatcaagtgattctcctgcctcagcctcctgagtagctgggattacaggcatgtaccaccatgcctggctaatttttgtatttttcgtagagacgaggtttcctcatgttggttaagctggtctcgaactcctgacttaatgatctgcccactttagcctcataaagtgctgggtttgcaggcgtgagccaccgtgactagcctacaaatttttttattttttttcttgagatggagtctcaatctgtcatcctggctggagtgcagtggtgcgatctcagctcactgcaacctctgcctccctggttcaactgattctcctgcctcagcctccctagtagctgagaataaaggcacacaccaccacacctggctaattttcacatttttagtaaagatgaggttccgttatgttggccaggccagtctcgaactcacctcaggtgatcagcccaccttggcctctcaaaatgctgagattacaggcgtgagtcacccgcgccaggccatgtgttattttagattaagttagaacccaattttcaatgttctccctctactcagagttaaaactcaatttgttgcttggaagacaagttaatttgcagaagacacatatctcactctctgtgaatatcctcattgtcaccccacaactagtttagaatctctgacatggagcgcattcctctgaaaacacaagaccctttggagacatcagtcaaatgaaatttaagcctcattgacaagctaagatgactcttacagtgcttcttgagggaatgattgtgtaggtagtgactgctggaagtgaagggctcagagtctgagtgggttgatccacatgtcacacagattgaagcaggtagagttttttttaatgctagggaaattttgctgagatactctgtgttctagccaggcattcagtataggggtggttcatttggggctcaaataagaggatcaactaactgaagctttaaatgggtatcaaatgaaggtaattccactctgacttgcacagtgagctacagagtggtagtgacagcaaattttctaaacagtatcataatttataagtctcttttacatactcatcatctcttttgtttcttagggaaaatctgtgaggttggccaaatgtagttattgtacctatttcatatatgtgaagatgagactcaagatcccataatgagtaaataaccagaaccttgatttggaatcaagatcttataagatcatcttctagacatactaatgtaccaataacagagatattgaagaaggcatttaaaaaatcaacttttttgaggtataacatatatacacaataaaatattcccattttaagtgtggagttaaacagattttgacaaatatatacactctttacccaccaccacaatcaagatatggaatatttctctttttttgaataaattcaggagatacatgggaaattttgttacaagtatataatgtgtagtgatcaagtcagggtatttagaagataacaaaacatttttctctccgaagaagttcctttatatccctttgtgctcatttctctctcttacttcctgcccttcccttaggaaaccactgatctgctctctgacattacgtattactttttctagaatttcacatgaatagaatcacatagtctgaatttttttgtgtctctggctccttttggtttgcatgatgtttttgagattcatccatgttatagcacatattagtagtttgttattttgtatggtttcattttatagtattctattgtatggctatatcacaatttatttatccattcaccttctgatggacatttggattctttcctgtttggattatcataaatgccactctcatggacattccaatacaaatcttttttttttttttcgttttttcagacagagtctcactctactggccaggctggagtgcagtgttgcgatctcggatcactgcaacctctgtttcctgggttcaagggattctcgtggctcagcctcccaagtagctgggattacaggcgtgtgccaccacacctggctaatttttgtatttttagtagagacgatgtttcaccatgttagccaggctggtctcgaacgcctgacctcaggtgatccacctgcctcggcctcccaaagtgctgggattacaggcgtgagacaccacgcctggccccagtacaaatcttttatgggcatatattttcattgcttttcagtaaatactctggagtggaattgtgagattctatgatcagggaatttttaattttataaaaaactgagatctatggtctaaagtggttttaccattttatatttacaccagcagtgtatgggaattccagttgctccatatcctcactgatacttgccattgttagtctttaaattttagccattttaatagctatgaagcagttggcatctcactgtgatttgagtttgcacttcctagatgactaataatgttgagcatcattttcgggggcttattgctcatttgtataacttctgcaaagggcaatttgagatacaagagatacaaataattttgtgtctcgtgcaagcgtttactttattgtagaaacaattttgaaaaaatgcaacctggaaaaaaattataaaatattcagactataaagaataaagaaaactataatatggttagaatgtccacatttttattttttctttagtgtatattccttgaatttttttagtatacattcatgtaatgctctaacaaactggggaggctgagttttcaggtagaagctagcaaagaaggaaaaggctttgctctctttatttccattccctagacttcattttgtagacgatgggctcaattattcacagcatctttttatatgtagcctcgtaaaactgtaaggtgaatcattacaaaattaatattcaacaggctttatataactctgcttaattcaatgcataactcagatttttatcaccccaaggcctctcaagatctataaatgcaaccaacttaataagataccatgtattttaactctaacattacctcagcgacctccatactgcacaaccactaagtttagactagataaccaaatagacatctatgacagaaatgaactgtatttaaaatgtcaagtcctgcatgaagacgtgcatgatgacaacgaagattgtgttctaacacatttgttttgagaaccttacagttttgactttaaaaaggagcttattttgcttccagagcactaagctacaagtattttgtgccacataacccaaaagagttgactcttaaataatcatcatttgccaggaggtgaaaaagcggatgaatgcatctagatattatctcctagcccccattcaaataaatgtgtataacttccatcctaaaaggactcttacagatcatccagtcctatgatcacattttctggacaaggaaccaaggcccagacaagtgaaattatcagcctgaggtcagacaaccagctaaaaagactgagtgtgaaatccaggtcttctgaatcagattctaaattcttagtcttgtgattttttttttcccctaaggcttttgttttgttttgttttcaatggttatacaggttcaatgcagaaattttggaaaacccagaaaagcacaaagaaaaactgttagaccaatttttaacaatttaaaattgttaatctccatactttaagacaatcactcaaacttttagtagggcactatgatacagaaactaagagggctgcttctggagtcatatatttggcttcttatcctgactcctatgcttgacaagcttgtgggcatggaagttactttaccttcctcagcctcagtttccctgccagtaaaatggggagaacaaggttcctcagcgtcagtttccctgccagtaaaatggggagaacgaggtcactgatttctcaaggttgtgagaatgaggtgagatgaaatttgtaaagcatctcatacaatgcctgcagacaataatcattagccatcatgattatatactttcagacatttatttatgttcacgtttttatgctttaaaaaagtaaaccacttcaggccaaatgtcgtggctcttgcctgtaatcccagcactttgggaggcccaggcaggaggatcacttgaacccaggaattatagatcagcctgaaaagaattagccaggcatcatggcatgggcctgtagtttcagctacttgggagactgaggtgggaggatcgcttgagctcaggttcattccagcctgggtgacagagtgagacgctgtctcaaaaaaaaacaaaataggctgggggtggtggctcacaccactaatcccagcactttgggcggccaaggcaggcagatcacctgaggtcaggagttcaagacgagcctgtccaacatggggaaaccccgtctctactgaaaatacaaaaaattagctgggcatggttgtacgtgcctataatcccagttactcgggaggctgaggcaggagaatcgcttgaacccaggaggcggaagttgcagtgagccaagattgtgccattgcactccagcttgggcgacaagagtgaaactccacctccaaaacaacaacaacaacaacaaaaccccaacaacaaaacaacaacaacaaaaaatgtaagccagttctgtggcctttttccatctgatggtacatttgccatgaaaagtcattttctgatggccttcccactaaactaaactttcccagaaaagtccaaatttaaacagttatctgaagagccacacactggggctctgactaataagaagaaattcccacaacccagctaatatctcgagttttagattatgtacaaggctgcggccatatcctaatgatgacttctagcagagcttcagaaagaatgtggctccctccttccactccgagcctctgcttctcagtgcttccaggaaccagcagggccccagggacctttccacatcagggtaatatcagaggatgatgtgtgattttatcatagccagggtggtgatttccaagtaaagtagggatggtttttgagaataaaaactgtcctgctgcgatctcttttcttcctatcctgcaccaaaacaaacaaacaaacaataaaccactacctacatttgtgagactccagaaagaactgttggcctggcaatgatcagtgactgatggatgatagctgtaggaagtgctgtgataaggtttatgaagctgtagcctggatcagtggaagaatatattgtgattgatcagcaatgtctgcagtggaaggtggaaacagcacggtggtacacaggccatggtgctgtcctccctggtctattttaatgtcttctctttataggtatgaaaaataaggtttacagcaatgaggtatcatggcttatccacccacaagtgcagagacagaacatggcaaagctgagactagcaaccattccttatggtttgtagctcagcaatcctctcatgccaagatgcctttcttctctggtgggtaagatggtttacttcttataaccactaggtggtcctggcatgttacaacctattcagatcacttccataatgaaaaaattatgccaagataatttaaaaaaacaccagtcccagctctgtactaaggccctggcaacagccagcacacagctgttatgaggatgcatattctcttttgacaaaagacaggtggctggtggtgtcatgttggtctgagataacatactgtgcagaaagagagacaagcagggaaggagagatttctttcccagactctcacataaatggatttcttctttgcataatggagctctaaataaataaaatacaaaacaaatgtttacaatattgttgagacactgagttgttcctctccaggaaaatggaattcaacacgaactttataatggtaggaggaagaagcatcatcatttattccttcatatgttcaccagattatttactaagtgccagccatgtgcaaagcactagggatgcaacagtgatcggaagagaaatagtttatgtcctcacatgaagtctactgggaaagctggactattaacaagcattgtaataagtgtgtatatacaaagaagaagacagtattgaggaagcaactgggcagaggtgaaggatcaacaggattggcatgcttaagtagaaagggcatgtgatttggagctggtcaaaagcgaaatcttttcttgccacttaccgagtgggtgaccttgagcaagtcatttagactttctaccccaatttccttatctgtgaaacaaagctaataatttctaccctgtcaggattatgctaggtattgagttaaagtttattaagttcccagggaagcctggcacagagtatgagttcaacacatatttgtcaagtgaatgaaagaatcattatcaaatacacattggatctctaatagaaaaagtgacacttgggcagagactgatgaaacagagagaaactagacattagtcttgtcttatacctatttagagactgagactatatagcaaatagcaaattcataaagaagcacatttcatgtggctaggtcaggaagtactctacaacagaactgtctagcagaaacataacgtgggtcacaaatgacaggcacatgtataattttcagatttctgcagccacattaataaaagtaagaaagaaaaatagaataagtttagcaatatatttaacccaacatagccaaaacattattattttacatatagctgacgtaagtttattgatacaatattttgcattctatttttcgtactaagccttcaaaatccagtgtgtgctttatatttacactacatctcaatttggccttgccatgtttcagatgctcagttgccatgtgtggctaatggcttccatactggacaacacaattccagaagtgtggggatgggagagtttattgaagacacaggcagtcaggtgggcttagggaagagatgaagagatgggcttgagtagatggccattaaaagacctgatttggtgtttttaaaagctgtatctatgtacagtgccttgtgttgcagcaccttatagaagcctcttgcatctggctggctctgtgtcagggaccttctgaatctacttctggtgcaggggtcatattcttgcatttggtccttactctctgatggcaccttcagactctcagactgtactttgcttcctggtaccctctgacttggcaccgtgcatagcgccgggcacctggaaagcacatgtatgtaaaagcagatttcttggctgcataatgcagctctaaataaataaaatacaaagtgatgcctggagctagccaaactctggctctcaaagctgctagggctatcagagttgtcctctagcctagggagacacacagagttacaagtttaaaaaatcccaggaatattcccagtagaaaaccaatctcagcatggcttcccagtgggggagagatgggcacatggcctggctggggtgcatggcatttggcagagaggaattggaaaaaggaggagatgattatctgacgctttgagagcaggtcctggccaagtgcattctctaaggtgaaatggagtaaggaaatccatgtagccaagaaaagtgcagtgatgtgtaccagaaagaaattcagatgatggataaaggatgagtgagaaaaatggatgtgaaaggagggaggcagaagcctagaaaacaagagtccccataagaacttggtatctcctcacttaagcaagcattgatgtgtcccccgcactgggacccaagctggatcacagtggtgggctgcacccatgtttgcctcctcctcaggcctataccatcccacagcccaggacaatcaaataaataagagaagtagattggatgaggaggcagaacacattctcctgctgtatccccagcgataacagtaacaatgaagaaggaggaatttctgagtgggctgtaatttctgttcaatagtatcatcaaaggaactcctgtcccatgtgtagaaggagatactcactccctgactttacccaactaacagcaagtaggaacgttgggaggtgacagcgtgctggcagccctcgcttgctctctgcccctcctcggcctcagtgcccactctggccgcacttgaggagcacttcagccagctgctgcaccgtgggagcccctctctctgggctggttgaggccagagccactccctctgcttgctgggaggtgtggaggaagaggtgcaagtgggaaccagggctgtgcgccacactcacgggccagcgccagttccaggtggggtgggctcggcaggccctgcactcccagcagctggccggcgccaccggccccgggcagtgaggggcttagcacccaggccagcagctgcggagggtgtgccgggtcccccagcactgccggcccgcccacgccacactctaattctggccaggcctcagccacctccccgaggggcagggcttgggactgcagcccaccatgcctgagccccgcagtgggctctggtgcagccagagcctccccaaagggcaccaccccctgctccgtggcaccaggtcccatcaactgctaaagggctgaggagggcaggcgcaccatgcaggactggcgggcacctccgcccgtggcccctgcgtgggatccactagggaagtcagctggactcctaaatcgggtggggacttggagaactttcatgtctagccggaggattgtgtatgcgcccatcagcattctgtgtctagcttggagttcgtgggtacaacactcagcactctaaatctagctaatctggtggggacttggagaacctttatgtctagctaaaggattgtaaatacaccaatcagcactctgtgtctagctcagggattgtaaatgcaccaatcagcaccctatcaaaatggaccaatcagctctctgtaaaacagaccaatcagctctctgtaaaatggaccaatcagctccctgtaaaatgggccaatcagcaggatgtgggtggggtcagctaagggaataaaagcaggctgccagaggccacagcagtgataggttcaggtctgtttacataatgtgggaggtttgttctttcactctttgcaataaatttttgcagttgcttgttatttgggtctgcactgcctttatgagctgtaacactcacggcaaaggtctgcagcttctcatctgagaacagtgagaccacgaatgcaccaggaggaatgaacaactccagacatgccaccttgagagctgtaaggctcaccgtgaaggtctgcagcttcccttctgaagccagcgagaccattaaccggtaagaaggaagaaactacgaacacgtccgacggaacatcagaaggaacaaaccctggatgcaccatctttaagaactgtaatgctcactgcgagggtccgtggcttcattcttgaagtcagtgagaccaaaaacccaccaattttgggcacaaggtgaccccaagtgtggctaggtgttttaatttttccaaagttttaactacgaattttatgcaacactttgtaattccaattttttaatgtctttaactgtgttaataaatttttaaacattgtgctggctcccactgtgtgagtcaaagaaaacagaccacagggctggcagcttgagacttctactctaggttcaggatcctgttccaccatcacctggccatttgtagcttctcagttccattttgttctgaggcttaaatcagaaccacttgccatcagttccattttgctttgaggcttaattcagattatgcacatcaaggacttagtttagtttctggcacgtggtgaaggcagttaataactggtgccgagtatctctaaagaacttgtgagctttccatcacttatatagggattgaatcacaggatgcccccagagacaaaacatctgaaacagggctccctacctcttcctttctgcttcacagccaaggtgtatgacactttcatttcactttgtcaattcatgaaactcaaagtgtttgcacaaagtaagaaaaaaaacgccaaccgaggtagaagtgtaagttgatgtaagttttcgagaaagcagtttgatcatgcttagcaaaagactaaaaaaattcatatgccttttgactcagctattccatttcaaggaatttaccctaaggaaaaaatgatggtttttcataaagccttagtcccaaaaatgtttgacagtgcagtctataatagaagcaattaaggaaattaaatgcccgtaaaggagagattggttgcaaaagttatgctacactagaaagctgatttttctccatcacagccccctcattactttcagagcacttactatgttaatcgtgtctcctgcagtaaactccaggaaagcagggtccttgtctgtcttgttcgccattgtatacaccactgtctatgagctggcacacaacagacactaatgaatatttaaatacatacaagacagtttacgtagtatgattccatttttgtaaaaaaaaaaaaaaaaagcatatgtctgtacattattagtgctttcctctagatggggtcagcaaactagttcctggactggctaaataaagttttattggagcacagccacactctttcttttacatgttgtctatggctgctttcatactaaaatggcgcagctgagtagctgcaacacagtccatgttgcccacaaaactaaaaatattcattatgtggccctgtagagaaaaagtttgcagactcctgctttaaatggtaggagttcgttttgtgcagtctaattcacatacacacacacaaacgtgtgtgtgtgtgtgtatatttaacaatgaacatgtattacttttataaccagaaaaagttaaagttatttttgcaaaagaaagacatgaatgaaggaacaaagaaaaaagaaaagaaaggagggaattatttattcatgtttaccaatacagaaaaatgtccacagcaagcaaaaattttaagtattgtatgaacaggatggttatatttttgtaatgtctggatacaggactgaaaggaaaaaaaggttagcatggctgtatctgggtaagggaactacaaatggcttttatttccttctttgttctttgttgtattttctcaattttccataataaacatgctttacttttgtaataagaaagagagaaaataagtgatattgaagatagagaaaataaaatattagtctacataaaaagcaacaatgtttctaccagtctttgaacatctacttggggtcctgggagtgtgtccctttgggcacactgcttgtcattactgcactccactaaaatggtaacatggccgaggtcgaagtgttaaaatcttgtgccacgtttgttttccctaaattatttatggtgtcctccaaacagaatggatgtttttctttatattaaaaaattttttaaagtccactgaattgtttctgaagcacagtttaccgttctatctagattagaaaatatatttagaaaagaagttttctggcttagtagccgacccttgcgcccacaatcacatttccctaatttcagccttagctgaggttgacggttctagcaatatggacagctctcacctcattcttccaccatttgtctctctgcttttaggaggaggtaacacccccaggggcagctctcaacaatggggagcatggataaataccccagcctctgggctgcagagttggcagaaaggagcccctggtgcccatagaagccatctttcttggcttttctccctctcttgttcactctctccacttctttctcttgcttcctgggaatctcctctcccaaactagcttcctgcacccaagatcctgtttcaggttctgctttggaggaactcacactaaaagagtttgtaagcaaatggcaaattaataacaaaatttacaccacagagcccagaaagtgctcatagatggagtcaaatagagctcattagcttctaggatacatgtgctcattatatgactattgactagatttttacattgggtcatgtgggctgggtatacgatggtgaactagatagacacagtctatgctcacagagcatgaggcattaaacaacgattatgcaaatcatattaacagaaaggacaggaaagatgggaaaatataggaaaaactagtctagtctgagatttagcatggatttctgagaagacaacatttaaactgggtcttaaagtagaggttagccaaaaagtagggaagagctacaatgtgtcctcaacgtacaaagactgaacatggaaggtggacatttgatgggctaattaaccatgttacaggatttgaagatttcaaaaaatatagccagccaaattctcctctttcatctgacatggttaaatatcccatgagcagaataagtgtttggataccttcagggtattaattactgagaagaccagagttggccattatgattcaaacatggcttagaaaaacacgcttgtaatcagagccagtgtattggtagattctactcttattacctgggtagaatgtgggtcttccatgaggtggcaaaaaaacagtctaaccttgaagctgatgggctgcttaaaaaaaaaaaaaaaaaaaaaaaaggagtctaatttgctccaaagacccaccacttcggattcacaaagatgtcacttaaaattggtttgaagaacacctgcctgctgactcactctgaaatgggaaatcaactcagaagaatctgatccttacaaacctctagggcacacatgcttcctgagactctgagtctgcttaacttcctcctaaacacacagtgttttatgtgctaacaaaatgcaataaatacaccgttggtacttccatgtttatgatccactgccttttttcttgcagcaatcttgtaagaatttaacttcatagttttattattctcactgcatactaatacttcaaacatttcagtaaattatggttctctgcttcctacttcagaatcattgaactgatttaatgagctctgtctaattattgcatttcacctttcttattaaagtgcagcagtgctttggctgaaatagctggtaatagctcaaatactcagaaaggaaaaaaatgaggatggataatgcaggactcactacagctcattttatgctagatataatttttaagaatatatagatatatgtacaccttaatcctctcatacattcattacatatttttaaaatgcctgtatgtgctacccacttgtgaaagataccagaacagatttaatggtgctttcttagattggcacctttctatcgagggcataaaacacactgattaaaaactctggaaccagactgcatatattgaaatcttggcttcaccattagccatgtgaccttgggcaaaacaatgaaccaatccctgcctcggttttcccatctgtaaaatgagagttaaagtattaatagcatgtacctccacaggactgttgtgggcattaaattagtcagtacatacataacatgtcaaaagactaccaggagcataacaggcacttggtaattgttacctcttttgtgttccatattgaattgtgcttgtctgtaacaaactcacagcaactgtaggtgtctctatctacttatctatttaattagttatccattatttatttttatttactgtttacctccatcaaattataggatacatgaaaagacagactaaatgcccagtgcctggcattgtgcttggtttatagtaaggcactagtaaatgtttattgaatgaatgaaccaaggaataaatgattctctgtcagcacgcacgacccctctcattccccacagcctttcgcttcagagatttccatcacacatgtctatcaaatgccatttgttggaaattccacatggctttatactcagatggtgcccgtgataaagggaaggcgttctggcatgcgtgaaagttacgatgccagatgacaagccaattcactgcattattcatcatcacatgttgttggccagagaaccgactgctgtctgctgagccccacaatggtcaagtgaagaggctgatttttaacagaaggtagtagcatctttagagagacacggtgatgcagtaggaagatgaggtttaaaaagtgagatgttcctcagtcttgtctcggcttagcaaggctgggcaagtcacttcactctttggggctcttggattaccgtatttgtaaatggaggacacaaattgtcatcagtaattcccaaactggttgcacaccagaatcttctggaaagcgttttaaaatatagtttgtttttggctagcgggaggcaaatttttaatataaagtgccagatattccaggttttacaggctgtatgatctctgtcacaactactcagacttgactctgccattacttaaccaaagcaaccatagacaatatggaaacaaatgggtgtgtctggatttgaccaggttacccacagcacacagcttcctgagccctcctctaggccatctgtggcctccaagcataagggtcagttctctgcatatttacaaaagctcctctaagtgacttcagcagcagagatgtttgtgaactaccagattacgtgatctgtaagactccttccagctctaattggagctgagattctacatttcttattttcaccatgagaaatggctattcttggtcaacactatctagacaataattctcatattctttcaaatgcatcacatttggatattagcattctacatctgaagtttttggtctctcaaaattcaatttgctactctaccaggaaaagtttgaatagttctttcaattgtgtttagatctaaagcagctctctctgcgtgtgatatcccctgtcagttctttgtaaatgacattttcattgttaagttgcaaatttgaggtttaatattatctcttttaggcaataaagcagcacagtacacacctccactttaagaaacaataacacataaaaatgtgaaattggtgaggcctggtggctcaggcctgcaatcccagcactttggaaggccaaggtgggccgagattgcttgaagctgggagttcgagaccatcctgggaaacatagtgagaccccccccatctctaaaataaataaatcaataaataaaaataaccaggctgggcaacatagtgagacccccatctctaaaataaataaaaattatccaggcatggtggcgcacgcctatagtcccacccactcgagcagctgaggtgggagaatcacttgagcctaggagtttgaggccatagtgagctgtgattgcatcactgcactccgccctggaggacaaagtgagactctgtctcaaaaaaaaaaaaaaaaaaaaaaaaagaaacagatcatggactcttaaaacaaaaagtgaaattatgaaacagttaaggggtgtttataatatttggcccaggctaggatttcctttgtatagagaacttcttttctactgaaatcatgactgtcaggtaacaatatatcctggatttttccaggacggccccagtttttacctgttgtctctgagtaattaacagagtgccactttccctctcaaaagtgtcccgtttggatgacaaataacatggcatccttcctgtaggtgaaacagccaaaatgattgctccatttattttatacttagtaagaggcaggcctgctctgggggccttctctatattatcccaatgaatcctcacaatattttgcttacgggtgatatcctgaggttgggtctttcaaaaagcagatgctgagacaaggagtcagggaggaggattttttctgggaaatattaccaggaagcataggtagggaagtgaggaatggagtcagggaagggaaggatgccaaaacatggtgtcttcgtgaacagtaaccagagccgcaagtaaccagagctcagtcttgccgggaactgtctgagagactgtgtgagcatgcctcagaatgttcccatggaggggctaggaggccgcagttttatcctgcagttttactcctcattggttgagggtcactcctggaaatgttccctctctttccctgatgtctggcctgtcccatagcaagaagcagttcacttctgtggctagagaaagccctcaggtaaaagacacaaacagccttgtcagggtgcatgagaactgtctgaagacaacttctggggtaggcccagggccactaacagcacagctacagggagactgaagcttggtaaggttaagtcacttgcccaaagctacataattggtgagtggtggagacaggatcttgactcatgcattctggctctgcacagcttacccttaaccatgcatagaactccctgtgcctacacctgagtcacttgtgcatcacccaatatctgtgcactggccttgtttctggcctgagaggccctggcaatggcttgctgtacagccaggtagccaaggcctctgccacagtcaccaactgaggtacttgtggcaggcgattcctcctggcctctcagggaaatgaccaatgaactcttcttcctctctccccctgcactgctcagaagcataataatttcatatggcttctcccaagacacccctggaagaccatgtagtcagcttgtcacaaagccagctttctcatctatgatgcacttccttgtattcacctccttgccctccctgctcactccttcttattcacactcacacctgcttccctgggattgcactccccaataaagtgctagtacccaagctttcattttgtaatggaacataatctgcatgcagtaagttttgacaaatgcctacacctatgtgacccacccttgcatccagatctagagcaaccatcagcccaggaagtttccttagacccctcaccagtcaatccactcttctcacattcctaggcaaccactgttctgatttatttcagtatcaagctttacctgtcctagaatatcaaataaatgacaatcgtagaatctaacacatacagttttgcctgggggatctgttttccagggaacctgggtgaggacttacctctaacttggtatattttgagtttttctcataattctggtccattgaagtacacataccatataccacttccagggtagaccaaaataattacaaatattggtatttaaagttcacgatcaaaacattttcatttaatgagtgatattcaaagcaatgacctcagtgcattatagatcctaattttttatcttcattataagtctttaggatagctattatctttggcttatagattaggaaactaagtctccagttaggctgagtagtgacttgagatgacacaatgtaatagaggcaaggttgggatttgagccagactgcatctgcctccaagtcttatgctctttcataaaatactctacatataagttatctgaagagaaactccctattagtaaccatgactctacggaaatccataagcaaactttggctcatgatgcataaagctaaagggacaaggaaatttgcaaaaggagggctctctctgcacaaagaaatgactgcctcatctcctgagtacagctttgaaaggctattagagatccacccagtagaaagattactgggtatcacagaagatgattgatcacttattcccacagcaggcaggttgctgaaacactaccctggaagccagagggagtaaactgtgaataagtgaagcctcaccttgatccatttggaaaagtacagtacaccctttacttaactcgtacccattcaaacatatttatggggcaactaccacgtgcagactctgctgctctcaattctgaggttatagcagcaactaaggctgactttctgaataaatgatcaactgatttgtattaaacttttgcttatagtaatttaaaatacatgctggtaactttttttgcccattaatacctatcctgtcagaaatgggaagggtatgttggccaggaggttttctggtaacaggacagaggtattttttgaccatttagagtgccttggaaatatgctagcttggcaagtgagtgcagtaggataacataacattatcagcgcccttacccatagactgtctgcaggccagaaagtaaactgtcacctatatatgatttctaaggcagataaggcctggaaatggtgtttttctttcttcttttctctaaaacatgaaactaggactacagattaagtaaagaccatgtgatactcagtatgcaatggtttgcaaatgttttaaatgtggagacccctttcttatagaagtggtccttctaggacaggaggaaaaaaactgacagaattagaatatcactatttcacagcccttaatgaattaatggatccatcactgattgccaatatccccgagtgatcacctgatgcaatggggctcctaagggaacaacacaccgtcaataaattagtcttcagaaaacaaaattgaacctgaatcttaacaactatctcgatccaactaccaacaagcatcaaacagaacactgaattacaacacggcaatgaaattagcaaaatccagactgtgagaaactctgcaggtcaaataaccaattttcttcaatgtctaaactgcaaggggaaataacaaagagatggagggaaaacttacagattaaaagaggctttacagacatatcaaccaatccccaaaagctgatgttatttggaccttaagtcaaaaacaatcttcatccaggcgtggtggctcacacctgtaatcccagcactttgggaggccaaggcaggcagatcatgaggtcaggagattgagaccatcctggctaacatggtgaaaccccgtctctactaaaaatgcaaaaaattagcctggcgccgtggcaggcacctgtagtcccagctacttgggaggctgaggcaggagaatggcatgaacccaggaggcccaggttgcagtgagccgagattgcaccactgcgctccagcctgggtaacagagcgaggctccgtctcaaaaaaaaaaaaaaaaaccttcaggaaatacagaattccatgagacatttaggttagcattgactggattattctttctttaaaattattattatactttaagttctagggtacacaacatgcaggtttgttacacaggtatacatgtgccatgtttgcttactgaacccatcgactcatcatttacattaggtatatctcctaatgctatccctcccccagtcccccagcccccgacaggccccggtgtgtgacgttccccaccctgtgtccatgtgttctcattgttcaattcccacctatgagtaagaatatgtggtgtttggttttctgttcttgtgatagtttactgagaatgatggtttccagcttcatccatgtcccttgcaaaggacatgaactcatccttttttatggctatatagtgttccatggtgtatgtgtgccatattttctttatccagtctatgactgatggacatttgggttggttccaagtctttgctattgtgaatagtgccgcaataaacatatgtgtccatgtgtctttataggagcatgatttataatcctttgggtatacaccccgtaatgggattgctgggtcaaatggtatttctagttctagatccttaaggaattgccacactgtcttccacaaatagttgaactaatttgcattcccaccaacagtgtaaaagccttcctatttctccacatcctctccagcatctgttgtttcctgacttttttttttctcattctaagtggcatgagatggtatctcactgtggttttgatttgcatttctctaatgaccagcgatgatgagcattctttcatgtgtctgttggctacataaacgtcttcttttgagaagtgtctgttcatatcctttgcccactttttgatggggttgtttgtttttttcttgtaaatttgtttaagttctttgtagattctggaaattagccctctgtcagatgggtagattgcaaatttttttttccattctgtaggttgcctgttcactctgatgatagtttcttttgctgtgcagaagctctttagtttgattagaaactggattattcttaaatgttaaaggtatgagattgtttttgtggaaaaacagtccttatcttttgaggatacacactgaaatattttcagaaaaataatgtgatatctgagatgtgcttcaaaataataaggaggggagaaatagggtactaatatagcacagttggccatgagttgataattgttgaaacctgcatgctggatacaggaatgataatcatacattttgcctttgtttatgtttgtattttctcacaacacaaagttaaaaccaacaaacagaaaagcaaaaccttttcttttcttttatttttgagacaggatcactctgtcacccaggctggagtgcagtggctcaatcatggctcactatagctttgacctcctaggttcactgatcctcccatctcaggatcctgagtagctgggactataggcatgtaccaccacacccagctaattttttatttttatttttttgtagagtcagggtctcaccatgttgcccaggctgatcttgaactcctgggctcaagccatctgcccaccttctcttaccaaagtgctgggattacaggcttgagccactgtgcccggctagaagtcttttaaaaaataaaaccttaattagaatccccgccttctaggcaaagcaaaagttagaaagccagaacatgcttatttgtctccatctctctcccccagaggtcccactgtattttctaaggcactggtaagatggaaaaagaatgggctttggagccaatgagaagtggaggtactgtttgggtctgcaatttgacatgtcactttggttctccaagctcaacttttccatctctggaaggaagctaataaagctaggaaatacttcaccaagaagcacttgtgacttattaagagagctagcatttgagcggtaactggcatgatttggacccaaatccatctgcctcttaaaatccatgctcacaactactacatcacacagtcttctagagtggcacctcactgtttgtgaattggctatggagattcacagccagtagagacctaggttcaaaaaaaattgtttcgctcactgtaggcagtgaaacctgtggttccccaaatcaagcttcccttgtttcaatccctgctctcccattaccagctacatgactgtgagcaagtcacctgaccttgtcaagcctccatttttaaatctgtaacatgggttaataaaagaatgtgcctagggttttttgtgagaaataaatgacataatcacaaccatagtgtctcagctcttctcaatcctagtatatacctcccaactccagaagaagaatatgactagtctgtccaagcaccacattctcctgatcatgactcgtttaggtacgggtacagaatccatgctaggtaaatgggatcctagcaggggaccttctgctgcaaatactaaaaaggagggtgctctttccttttggacactgaagaaataggagtcagccaggaactgttgaccaatgtggaaaaacgcagagccaagggatacactcacctgggcctgaagctaccctgaaaagtttcagtcacaccagcaaataaattcttctgttggtgtaagccattctgaactgattaacagagtttttgacaaagagcaaatgtgcaataaatgttagctatcacttgaaacatgaaaacagatcaaatttttcctgctaccttacattctgttgctttgcttgggttatttctttttatttaaagtttttttttaaattacaggtcatttcagatatatgcaaaagcagagaaaaaaagtatcacggatcctcatgaactcccaacaatcatcaattcatgaatagtcttgttcggactatgtccctcctacttatttcctttttcccttttcatttatatttttcagatccttttatagtgttttcttgtgtagtagacactgttggtggcctacccatcactcatttcccaaatattccactcagtgatgtttatttcttaagctctctcatgcagccagagatatggacctgtttgtatttaaatcccagagatggacctgtttggtctaggggtaatttcattcccctggtcagtaacagggtcagaaatgcaataaatattgggtgttgaaacatgaaagggacactactggggaagggagatacttatggacaattttctgctcttaaggagcagccacaaaaaattgtctctctttttcctttgactgctatcctgtctggatgtgatgctcagaactggagcagctatatttgctactagtctgaagatgaagctattaccaaagatgacagaggacagggggaatgaagctgagaccttaataatattattgagcgactgaatcaagcaagtcgagggactgctccacctctggacttgctgttctgagagttaaaaatctgcttcattgtgtaaatatgtttgagtccaggtatctgttaattgctgctgaaaataaccaactttgccatcaatacagacctatggcctgtatagtccgagcttcaaaagctgagtaaggaatcatactgggatgatgtaacaaagacaccctaaaatacagtgacttcaaccagagataaattgatttctttctcatgttaagagtttgcagaggtgttcctaccaaatccctttaaaaataaaacccataaattaatctcacacatctcacttagtgacatggctgcaaccaattgcaagggaggctcggggatgtagttgttattctgggtggccatttgccggttctattactacaaggaaaaggtagaaataaatattgtaacatagctacagtggtcatgaggcgtcatcagaatgcagtataggaagtctcagctagagaagaagcagagagggttaatttgatttggttcaactgactctttaattaaaacaactcagaaatgtaagcaaaattcaaaagaaatgttcttaagtgcctccctacatgacttagcagaacgtatttacttagatataggtaaaactacacatccctttcatctcttctttttaggtgaatcccagaaggatctcagcaatcagcaatactttgttggcccagtttattaccttgtgtatgtgaaataactgaacttcattgattttccttgatttcaaatctcttttcctcagttaaactgcatgagagtggttcaattatattttgctcactggtcaccagaatcccatagcaagcccctactccacaagattattattaatcacagtaattcaatttatggaaaattaaagacagacaaatagagaaaaatgatagtgctaagagcacagtattctacagcccagctgaaatggctgttgataaaggttttatatagttaagatacaagcgagactttgatttagcggcagcaggttttaaatgatgcatgagaagccaccaaagcaaatccctttctctatggtcccctcagggtcaagtaccttgtttcaattataatttcaccaaattgctgtgttgcagcgaatgtttcagattaacagcagtatagcacagttctctgtgggacagaatcagaaaatctagttcagaggtttgttgaaatacaccccaagacacccagatgcaaaacacattagagactccaagatgatgggaatattttggatcggtattctccaaagagattacttttgcagaaaacaagtttattatttatggtggtaaataagatttctcagtgcagccaaagaggtttcttgcaattacattgagaaggcaccacagtgcagtccattatggaaatcatatttacattaatagagaaagcttttgttttgccaaaatgtgtatttctttttaaagcatactcatgatgagtttggaaggggatactaaaacgtttggtttgtcttttcattccaaatgactctattccttggagaagcattttgtatagtaaaacaccattttgcaagttctacttcaaattaccagtccagttttttttaatttaatgctttatttgagaagaaataatttcaattctaggtggtctttggtatgtccaaagaacaaagagaagtatgtccaaagaacaaagagggttttatttagaaagaagaaagttacttgtggtcttcagagaaagttcattggtattagtaaagctctggggagctggtaagctccaattggtgggcaatggccataggtaaattagtcctagagttgcaacaagttatctctgcagctgtagacaaaactggtctcaggctacagcaagcagtttcagtaaccaggctcaaagagaactacattcctagggcaatgttaagtgtcctaagtactttttccccctagcttttcgaatctgttttatttgggcatgacaagatctacccaattcatatgatcaatttgcacaattataataagagaatcaacattttatgtaagcacttaggctaaataagtagtagtaaaaccatcccacatggccgacaggcttgaaacaatagaatttagtcaaataatgattaactgcatcagaaatactgtccacctaggtagtttcctaagtgatttttgccaacactctaattctacacgcagtaaacacaaactgtaaatgttaagaaattgcccatggcataagagttatcttccaaacttctcatatgttaaggctactttttttctaatcatttgaagttacagagaaggtaagattctttcaaggggtttggtgagtttttttcaaagtttaattccttagataatatctttgtaatcaaatagaccgggctaagtcccagcctcattccttgtcaactggataacttcagaaaagtgttttaacttcttcaaatgctagtttcttccactataacatgaggatagtaaacactgatcatgaagggtgatcataaggattaatgagataaggtgtgtaaagatagcctcactcatggcaacggtcactgctcagcaagagaatgtagcccttatcactatattgctgagattttattaactaaccttttgccctattaatttcatgaccccttttaaaaataggtaagcgtcagaagaagatcctataatgtcaatgtgtgtcctataaaggttaattaggactccaagatatctcaaacttaattgttcatatgcccatttaatgattttctctctgttttccttttttcccccccaaaatacatgtctcttttctaagctctaaatgaagagcatgtgaccattcctcaatgagctctgttacatgttttggattgtttggttgagaacgggcttgagtactttttagacaaattgtggtcatttcaccatccactctcttctgactcagaatatggaatttgttcagtgcgttttcaaaaaatccacatttctgtttcaggtaaagaaaaacatctgtgttgggcagaagtatttctccacttctagtagtctcaggtactaaggtcccgactgactccaaagagttattgcctctctatagattcctttgggggctctatttattctactttctcccctcactggtgaaagttgtcttttttttttttttataaaagagaacttgcttttacttgcaaagattatttgagcctctttgacagctagaaatgatccttccatggaaagtcttccactagcttccaaaggactaaagcttaaagttgggaatttctttttcaggttcattaccagaatttctagagtaacttcacttccaaaaacagaaagatcaaggatagcatttacagagctgaagatcttgtgactaaaatgagagactgtgagttcagcatgtccagccttccttgttggctgttgtttatgtctgatgacattctctgcaactttttttttctttgcatattacagatgcaactccctgggattcttgttggatatatcacatcttcaacatctccaccctcattcttaatatcttggaagtgcctcttcactaatatggccaataattaatcactaaaaaggccaaacggaagaccagccagtacaaccagttgtagttacaactgttctttcaaagctttggattccttgacattcaaaactgatgccctttggatgtttccacttctggccaatgcaccaaaatgttacagttttgccaatgcaccacaatgtagcagtgtctcatagccaatagccggagatatcacccagaagttctctgtttcactaccaagaaagttaaggagtgtggacaccaagggtgaggttggagcgaaagtttaataagcaaaagaagaaagctctccgctgcagagaggggacccggaagaggggttgccaccagtccagtgttaagaggacatcccatggggacttgccatgggtcaaatgttcaagtattaccatattggtcatattgggagtagagggctccaaaggaccagaagttttatccatagtgatggctgtagtagcatatccaaggcttcaagtgagtctttcttttttttttttctttttttttttttttggcttagggggtggaatcttatttttgactaattccctctgggcattatttctaaaggagagaaatttaagatctaacttccatataggggggttatgctcattaatcccactccttatgattgtaaattgaagagaaaggatgttccccaaaggaatgaaggttggaggaaaacctttagcccttcttttcagaagtaatttatctgacaaggatggcagaagaccaattattggcatctgctttctttggccttctctcttcctatactccatacctccagcaagcacttatgtattcttgggcttgacaagggtgaggtcaggtgcaatcttctatccagctgatggctctgtccactctaccaagtcaactcttcccaagtttaggctccaaagtccagttacagggttagaataaataaaggccaattcgatttccagtctaaactgcattctacaatttggcttcattggcaatgcagcacgtatctgaatctccatctcactcctcattctgaacttggagatttgattgtctcccacaaagcccagacctcatatggttttcatatagccatcttgcatttgaccctaatttacctctccagccatatcaatctctcttttaatcatccaagtatatatacttttattttcccaacatccttaggtttttgtgtccattgaagatttaattggtggcttataatccatccatgtgggcattcacaatgatttttaataatgagtttaatacaactaatataatttatgaaactctgtcgttgctgaatatgacataaaaatttaggtgaaaagcaaagtagctttgggcaaggggttgaagaagtgaccctacacaaggttaagtcaataaggagaaaacccagtaaatccaacaagagaaggctgcttctactagtcccacttctaacaaatgttattgatctttcaagggtttgcgcttaggctgcccaggcttctcccatcccagccgtatcccatcctgccatgtaacttgtcttctccctcttttccaaccttccctacacaatacaaaaattagagatgccctaccgtcatccaagttctcttctaaactgcaaatgcccaagggatggtaaagcccatcagtgatttatgcaatggtctgaattacttgctctcctctattttctcatcttcagcctggtcttagctcatgtattgctacagaatcttgaatacatgtgacagaaacctgttttagcaaaccaaagttaataagaaagaaaggaagaaagaaatgtatttgaaaggctttagatagctcccagaattaaaggcagagtgaacaatacaattctggtagagtaggaaccagggtatatctggggaaactcagcagcatgaagttgcaaatggtcattccaaaactaccatctgatgacgctgagttaagttcctgagtattgctgctcacttcctcatattattgttctagtgtgtgttccaaggggaattggggatggttctgtgactgacagtttattaaaatccccagcccaaaggaaggaaagccagggaaacagtggagttcctggtagttcatctatgagcatttctgccccaaaagctacaagtctaaatgcttcatatattattacaacagcaaatgttgaacactgcaaaaaccaaagaattacaattagaagatatgttccaataccttgattgctttaaacactggagcattgctgccgatcttgtgtgctattactcatccattcagtcaccatttaggtatactaagcacatgccacacaaggggcaagagtgaacaagatagacagggttcctgccttcatagagactactgtctgatgtggaagacggactgtttaacaaccccttaaaccagggataaaatgctatcaaaggggaaagagaggatgctaggaaagcctatagacagagcaattcatgtggtccaggaattctaaaggctttgggaagaagcggctttcaagcttagaccaaaagaatgtgtttgagggaaaaaggaaatgtcttgctgttggttcccaaattacacaatacatagcaacgtgacctcgggtgtgtgcccttacctcttagggccacagttcttaatctacaaaacagggccaggttattacttacctcactagtgctgttgtgaggatcacagtctgaggtgtcataagctaatttcctgacctgtgtttctattttttctttttcttttttttcttttattattattatactttaagttttagggtacatgtgcgaaatgtgcaggttagttacataggtatacgtgtgccatgctgctgtgctgcacccattaactcgtcatttagcattaggtatatctcctaatgctatccctcccccttccccccaccccacaacagtccccagagtgtaacgttccccttccggtgtccatgtgttctcactgttcaattcccacctatgagtgagaatatgtggtgtttggttttttgttcttacgatagtttactgagaatgatgatttccaatttcatccatgtccctacaaacgacatgaactcatcattttttatggctgcatagtattccatggtgtatatgtgccatattttcttaatccagtctatcattgttggacatttgggttggttccaagtctttgctattgtgaatagagccgcaataaacatacgtgtgcatgtgtctttatagaagcatgatttataatcctttgggtatatacccagtaatgggatggctgggtcaaatggtatttctagttctagatccctgggaatcgccacaccgacttccacaatggttgaactagtttacattcccaccaacagtgtaaaactgttcctatttctccacatcctctccagcacctgttgtttcctgactttttaatgattgccattctaactggtgtgagatggtatttcattgtggttttgatttgcatttctctgatggccagtgatgatgagcattttttcatatgtttttttggctgcataaatgtcttcttttgagaactgtctgttcatgtccttcacccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcctttggtgttttagacatgaagtccttgcccatgcctatgtccttaatggtaatgcctaggttttcttctagggtttttatggttttaggtctaacgtttaagtctttattccatcttgaattaatttttttataaggtgtaagcaagggatccagtttcagctttctacatatggctagccagttttcccagcaccatttattaaataaggaatcctttccccattgcttgtttttgtcaggtttgtcaaagatcagatagttgtagatatgtggcattatttctgagggctctgttctgttccattgatctatatctctgttttggtaccagtaccctgctgttttggttactctagccttgtagtatagtttgaagtcaggtagcgtgatgcctccagctgtgttcttttggcttaggattgacttggcaatgagggctcttttttggttccatatgaactttaaagtagttttttccaattctgtgaagaaagtcattggtagcttgatggggatggctttgaatctataaattaccttgggcagtatggctattttcacgatattgattcttcctacccataagcatggaatgttcttccatttctttgtatcctcttttatttcactgagcagtggtttgtagttctccttgaagaggtccttcacatcccttgtaagttggattcctagatattttattctctttgaagcaattgtgaatgggagttcactcatgatttggctctctgtttgtctgtttttggtgtgtaagaatgcttgtgatttttgtacattgattttgtatcctgagactttgctgaggttgcttaccagcttaaggagattttgggctgagacgatggggttttctagatacacaatcatgtcatctgcaaacagggacaatttgacttcctcttttcctaattgaataccctttatttccttctcctgcctgatttctctggccagaacttccaacactatgttgaataggagtggtgagagagggcatccctgtcttgtgccagttttcaaagggaatgcttccagtttttgcccattcagtatgatattggctgtgggtttgtcatagatagctcttataatttgagatacgtcccatcaatacctaatttactgagagtttttagcatgaagggttgttgaattttgtcaaaggccttttctgcatctattgagataagcatgtggtttttgtctttggttctgtttatatgctggattacgtttattgatttgcatatattgaaccagccttgcatcccagggatgaagcccacttgatcatggtggataagctttttgatgtgctgctagatttggtttgccagtattttattgaggatttttgcatcaatgttcatcaaggatattggtctaaaattctcttttttggttatgtctctgccaggctttggtatcaggatgatgctggcctcataaaatgagttagggaggattccctctttttctgttgattggaatagtttcagaaggaatggtaccagttcctccttgtacctctgttagaattcggctgtgaatccctctggtcctggactctttttggttggtaagctattgattattgccacaatttcagagcctgttattggtctattcagagattcaacttcttcctggtttagtcttgggagggtgtatgtgtccaggaatttatccatttcttctagattttctagtttatttgcgtagaggtgtttgtagtattctctgatggtagtttgtatttctgagggatcagtggtgatatcccctttatcattttttattgcatctatttgattcttctctcttttcttctttattagtcttgctagcagtctatcaattctgttgatcctttcaaaaaaccagctcctggatttattgattttttgaagggttttttgtgtctctatttccttcagttctgctctgattttagttatttcttgccttctgctagcttttgaatgtgttttctcttgcttttctagttcttttaattgtgatgttagagtgtcaattttggatctttcctgctttctcttgtgggcatttagtgctatgaatttccctctacacactgctttgaatgtgtcccagagattctggtatgttgtgtctttgttctcattggtttcaaataacatctttatttctgccttcatttcgttaggtacccagtagtcattcaggagcaggttgttcagtttccatgtagttgagcggttttgagtgagtttcttaatcctgagttctagtttgattgcactgtggtctgagagacagtttgttataatttctgttctttcacatttgctgaggagagctttacttccaactatgtggtcaatttaggaataggtgtggtgtggtgctgaaaaaagtgtatattctgttgatttggggtggagagttcggtagatgtctattaggtctgcttggtgcagagctgagttcaattcctgggtatccttgttaactttctgtctcgttgatctgtctaaagttgacagtggggtgttaaagtctcccattattattgtgtgggagtctaagtctctttgttggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccttttattttgagcctatgtgtgtctctgcacatgagatgggtttcctgaatacagcacactgatgggtcttgactctttatccaatttgccagtctgggtcttttaattggagcatttagtccatttacatttaaggttaatattgttatgtgtgaatttgatcctgtcattatgatgttagctggttattttgttcgttagttgatgcagtttcttcctagcctcgatggtctttacaatttggcatgattttgcagtggctggtaccggttgttcctttccatgtttagtgtttccttcaggagctcttttagggcaggcctggtggtgacaaaatctctcagcatttgcttgtctgtaaaggattttatttctccttcacttatgaagcttagtttggctagatatgaaattctgggttgaaaattcttttctttaataatgttgaatattggcccccactctcttctggcttgtagagtttctgccaagagatcccctattagtctgatgggcttccctttgtgggtaacccaacctttctctctggctgcccttaacattttttccttcatttcaactttggtgactctgacaattatgtgtcttggagttgctcttctcaaagagtatttttgtggtgttctctgtatttcctgaatctgaatgttggcctgccttgctagattggggaagttctcctggataatatcttgcagattgttttccaacttggttccattcaccccgttactttcaggtacagcaatctgacgtagatttggtcttttcacatagtcccatatttcttggaggctttgttcgtttctttttattcttttttctctaaacttcccttctcgcttcatttcattcatttcatcttccatcactgataccctttcttccagttgattgcatctgctcctgaggcttctgcattcttcaagtagttctcgagccttggctttcaggtccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaacttgtcaaagtcattctccatccagctttgttccattgctggtgaggaactgcattcctttggaggaggagaggcgctctgctttttagagtttccagtttttctgctctgttttttccccatctttgtggttttatctacttttggtctttgaagatggtgatgttcagatgggtttttggtgtggatgtcctttctgtttgttagttttccttctaacagacaggaccctcagctgccagtctgttggagtttgccagaggtccactccggacgctgtttgcctgggtatccgcagtggtggctgcagaacagcggattttcgtgaaccgtgaaagctgctgtctgatcgttcctctggaagttttgtctcagaggaatacccggccgtgtgaggtgtcagtctgcccctactgggaggcgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctctgccctgcccccagaggtggagcctacagaggcaggcagacctccttgagctgtggtgggctccacccagttcgagcttcctggcttatttgtttacctaagcaagcctgggcaatggcgggcgcccctcccccagcctctctgccgccttgcagtttgatctcagactgctgtgctagcaatcagcgagactccgtgggcttaggaccctccgagccatgtgcgggatataatctcctggtgcgccgttttttaagcccgtcggaaaagcccagtgttagggtaggagtgacctgattttccaggtgctgtctgtcacccctttctttgactaggaaagggaactccctgatcccttgcacttcccgagtgaggtaatgcctcgccctgcttcagcttgcgcacggtgtgctgcacccactgtcctgcgcccactgtctggcactccctagtgagatgaacctggtacctcagatggaaatgcagaaatcacctgtcttctgtgtcgctcacgctgggagctgtagaccggagctgttcctattcggccatcttggcacactcctcttatattttttctttgctcatgatagtgttggttactgaatgagactcaatcatataatgatcatttgttacctatcaggacttttttggttatagatgaatgaaccccagtatgaaaatccctcagtaaaaaagggaaatttagagaggctattttgatatttcacgtaacagttaggcagtaagaatggcagggaggaagcaggtcttggaaaggaggtactcaggggctcaaatgcagccaagacacttaactctttctgcctgtcaacttcaatttctggctcactgacttttcctataaggaggaaaacttggccatggcaactctcaagcttcacctttcacaacttcagtccctggagaatgaaaatctcaatctttagggccccacattcaagaatctgatcccagagaagggcttcagttgaccttgttggagtcagatactcacctctggataaactagcagtcagcagaaaagagggtactagagtataaaacagtggctcctacagcaaccagcgaaataaggtttaacagagccattctcaaaagaaggagacacaggtagagccaagcagaaaatcccacaaatgtggactagatcctttttttcttttttaatgcaagttccttctttaaaatgatgctaaagctgcaactaattgaataaacaaagcacacaaattctttcaaaagctgaaattctgtttggggacaaaaatcatcacctgggtttcagaaatcactgagcacacattcattagctttgctcatgcaaaagttttcctgcagacctgtagttcaatgccccaatctaattccttagactctagctttctttaaggggtagggagtagggtgggggtaaaagctgtagtgcaatagagtatttaaaaaataaccctaaacaggcattgttgctgagagcttctctgtggccctaactaagaatatcacagaacttagtaaactaagttgggaattacgagccatgccctggagacctctgaagtgtgtctgctcccacacttaatgatcaaaaccacactcccacaggtgactgttttgtgaagatgtctaacaagaagtgagaaagaggagaaaaagggaaaggaggaagaaaagagagagggggaatggggagaaaaatgaaggagacaggaaaatgacagcagtctgacctgcgcaatgctctaacatcttccttaaaagagcatgtttcatgtgaacacttcaaccagtggagatttttctagaagcttactgatgccaatttccttttaactgaagaatcaaatctttcaccaactgttcctaaaatatattagagggggcaggaagtacatctttcgtccagggactgtcaaaagtatggggcttgtgccactgcctgaaatgacctcgggtgacccccataggggtgcctaaataacatcgcatcccagggtaaactgttactcttttttggtttgcttttaaccactttgaattaatatgtgacagtgttttgcacttttacatatttattacttctctaacaccaattctaccccctgttgtacagaaagagcagacactcggctaggcaggaggacctagatagaactgagtaacattggtgtgtttcattgcattgaatatcccaataatgttcaattttaggctaggaatatcggtcttcctttgagagtaggcatgtaaagctgcttcctaaaattttttttgtagttcaaaaaaggcagtaaattgaaagaaaaatatcaacagtggtggtaccagatgttccaaaagtactcttagttactaagtatgtatgtttctaggtccatgggtcaaaaggaagactccatgttcccaacccatgtcagtgtgagaataacagtcaaatattttaggtgagaagagtgtctgtggcttctaaggcctttgccagagattcttggattttaaaataaatcttaagagctgcttctttccttcagtccaagattgtattttcccttatgaagtgcttacactgatgataataaagattataatgatttagaatcccatagaggtttcctctgaaaatctttagtttaagaagatattttggagtctgtgatagaaagtatgccaaggttcaggatttgactaatgaaaagcttaaaatggattgtagaactgcctcacctcatattaatgatgaaacactggaaaatatgggaccatattgggaaatggtcaccaaagggacatttccctacaattcatgctgggaaacttcatgaggagaagacacagaaaacctggaaactgctggtggaaaaattgttacggatctcttcgccaacttctaaaaataaaaggcaataaatgttaaccaactgtggacccttatagttatttttaaaatcaacagaaataaaatggaagacttaatttccattacgatgaccttatcaaaagccccaaattattttatttgaaagaaaatgtcacttaaaaataaaaaccagtcacattcaacaaataaataatgaaaccagaaccctgctcagtgaggtttttgtcggttcagcttgccgattttgttctccctgaaataaaatacatcttagcttgctttcccctttaaacaaaaaatcacagcaactgcatttattacattctcctgagtctttggtcttgcttctttatttgaatttctcttcttttttatgaacaggtctttaaaaaattacctcaaagctttttgagcaaggcgtaggatgttttgagcaagggatgggaggttaaaataatcttagtgcatttatttagtagattacaaatacaaggagtgaagagcaacagaagaatgatttaacagttcaagacaaagaagtggtcataagcctctgtaagattgactgcccggtcagattcccacaggggctggatggggaaggtggaggcctggttacaagacacaatgcattctagaattctaccaggtgctattatatatttgtaccaggtgctattgttacaagatctttggggtgttgattttctggccagaaacctctgtggcctttgctcgagttcttgtcctgtgtccaggaagactgaggtacacagacaaaaggagggtaaacaagatgaagaggagatttattaagtgttagaatagctcagaggagacccgcagtgattagctcctatctgtaggcaggtcatcccatcaagtgttcagctctcagcagagaggagtccctggagagggttgctactttctacagctggtgttcctgactctctgcaggtccctgaagctcttagcagagaggatagctcctctctgctgctggttgtccagtcatctccagttatcagcagagaggataactcctctctgcagctggtcctctcatcatctctccatcctctctgacctctgccctgctctggctgaacctgaggcttttatgggcctcagaggaggggaagtatgtgctaactcgtccatgggcagccatgggcaggcccaggaaaaagcaccatgagttctccctccagtaggcagggctgacagctcagttcccaggcttcaggtctgccccagcctgaaggtggggcttctctgggcccccccaccttctgcccaggaggctttctgcctcccgtgaccatccatggcacccaggctgctggcaccaaggtgcacctgcaggccagctcccagctgtcctcaacccccctcaacttcccctcccctgctcctctattaccaaagtcctgaggggccagagcagcagggggctggcatgtcagcactgctctgtgggtgcacacacccggctgggctgtgacagtggctgggcttggccccaactccactcagagattggagtgggagccaggagtcgggggaggccaggcagctggaacaggcaccgcagagcctgcaagggcaagtggggcctttgaggccccctaagagtgcagggatgcctggatctacagccccagcttgcacagctggagctgcaccagggtggggggctcctgcctactttgtgaagcaggaggcccagatccgcacccaggacttgggtggctgcagccctgctcaggagaacagcgttcctgcctactctcagctcccagaagcaaggggtgcctgggttgcagccacagcttgggcagctgcagatgcaactggggagctcccaccccaccaacttggaaggggtagggctcccgcttgtccctggttcccgctggctccatggagcatggcacctggcccagccccctcacagcctggggttggggatccaggtccttgctgggcctggaccagcatccagggcaggggcaatgttgctgcaagctcccctttggccctggtgcttggggtgacccagagctccccttcacctggtgcgacgcagcccagccccatcatggtggcccccaaggcagtgggctgcaggtgtggggctgtccacctccctgtgccctccctgcagtggccagtgtgatggcagcagccacaccagaaggcccatcgctgccatcactattatgtatttagcatctctgtaacaccaatacatgcagatatatgtattctagaatattataattacagatgattctagattgagatacaatgcattctagaatacaatgcatagtggtggtgcacatacacatatattggctacatggggcagttcaatagagcaattgcatgtagttgccatgttgggcataaatagcctggctttgaatttttcccaagttggctggaagtctggttattgttgtttttaatatgaaacatcaggtttctaactgttgccaactaattcaaaacatttatttttattattttccgtaagttgttggggtaaaggtggtttttggttacatgagtaagttctttagtgatctgtgagattttggtgtatgcatcaaccgagcagtatacaccacaccatatttgtggtcttttatccctcgcccctctcccactcctccctgcaagtccccaaagtccatcgtatctttcttatgcctttgcgtccttatagcttagctcccaaagacattttttataaaacactatatggacaaaagaaaacatatttgtaagttagatttggcctgtggattgctggtttgaatctctgccaggtaactaagccattaagtgttgggaattgaacctataacttcactctggagtgagcagaaggggatttacattgaatcttggaaagaaaaggggggaaaatgtttataaggagaagggagagacagtggcagacatactacatggggaggaaagcataaaagaagccccaaagcaagaaggctcaaggcatgttgaacaaacactgaagagattagtttggttagaagagaaaacccatacactgatgtgaggcaaagtagcaaatgttaagaagcaatgtttgctcatttctgcttgccagaataatttcacaaagcctctgactctgtgaagatatgcaactctccagaaagatgctttgaaaagacaaaacaggataaataaaagacaaaacatgcccctgcccccaaggtctcttgtttgagtcactatattccttaaaagataaattaccctagaccttgcctttctctacacttaagataacgtctgacagggtcagtgattatgcctctgtaatctataaccagatatactcttacacccaaaccttgatgtgatttctgaacaaatctgatgtgattttgcatgtactgaatctccaccacctgtacttgagcacactgggctgaaatactgtgctggagcagtctcatagaacctctttaaatggctgatcccagactataggcctgagtctatagtccccagtaaggcttctgaataaaactaactttaaatcttcaaaagctttctttgttcctttagatgacactgagaaagttagagataaggcgtgtaaagcaaatgaaggatcagatacataaggatcttaaatattagctaagaaatttgaattttatttcataggcaaggaagatttgggggtctagagattgggttttccaataaaactaacccagcctatctggaagagaaagagactacaggagaagagactggtcaggagactccactatcttaggaggactggtggaggcaggaggaatggaaagctagtgaatgagacagatccatggcaatggataaatccacaggactcataatctgcttcctcttagaagatgtcaaagatcactcttctgtttggggcctttggtatttgcaggcatcctagtgcaaatatccaggaagacttttggaacctgaatttaggaggctgtccagggatgctgaggcagttggagtgctagccacatgaggatggcccacagataaagctcaagggagaggattcacggagagaggaagcatgaacctgggaagatgaatacccagtatctatgtttcttacagcttacttcaaaaaccttgctaaattgagaaatcactacccttgaatttgtgattgatctcaaataaaaatgcattctattttatttgtattattgtatgtatcacctaatttaaatgtgtccattgtaaaatttcatctcttcaaccagattacgttttaagaggaaaagggaaagaaaaagaaagagaaagaaagaaagaacaaaagaaagaaagaaaagaaagaaagagaaaaaaagaaaaaaggaagaaaaaagagaaagagaaaaagaaagagaaaggagctttggagtagatattgccttgtaagagtggttaaaatggagccctgttaaggatctgagaattgcctgaaggctctttccagtcctataagtaaacaacactagagcttttgtccaaaaattcattttatagccagagaaattgaaggccctccaattcaaaattcacctgacagctatcagctgctttaccatgcaaccagagcttggctctgtgaaggcttcacatcatgttagaaagatggcaccaattaaaaatgcacccacctcagaatccagagataaactctaacttctatggtcaactgattttcttcaaaggtgccaagtcaattcaatagggaaagcatagtcttttcaacaaatcatgctgagacaactggatagccacatgaaaaataataaaatgggacccctacttcatatcatatagaaaatacaactaaaggcatagacctagctataaaagtttaaggtataggcctggcacggtggttcacacttgtaatcccagcactttgggaggctaaggcgggtagattatgaggtcaggagttcgagaccagcctggccaaagcagtgaaaccccatctccactaaaaattagctgggcatggtggcgggtgcctgtaatcccagctactcaggaggctgaggcaagagaatcactcgaacccagaaggcagaggttgcagtgagccgagatcacaccactgcactccagcctgggtgacagagcgagactccatctaaaaaaaaaaaaaaaaaaaaaaaaagtttaagatataaaactcttcaaagaaaagacagtagtaaatatttgtgacctcgggttaggcaacaattccttagatgtgacacccagcacaagcagtaaaagagaagggtgatacattggacatcattgaaattttttaaaattttgtgcttccaaggacactatcaagaatgtgaaaagacaatccactgtctgggagaaatatttgcaaatcatatatctaaaaagaaacttatatccagaatatataaagaactcttatatcttaatacgatgacaaatcaatctaaaaatgggtaaaaaatatgatagacatttctccaaagaaaatatataaatgagatatatgtatataaaatgtatacatatataaatgagatatatgtatataaaatgtatacatatataaatgagatatatgtatataaaatgtatacatatataaatgagatatatgtatataaaatgtatacatatataaatgagccaatctaaaaatgggcaaaggatttgaataggcatttctccaaagaaaatatataaatgagtagtaggtacatgaaaagatgctcagtctcattattcattagggaaatgcaaatcaaaaccagagtgagttgctactttatacccactagaatggctataataaaaaagacagataataaatgttggcaaagaggtggaaagaaacaagaaccttcacacactgctggtgtatatgtaaaatggtgcagccactttggaaaagtctagcagttcctcaaaaaataaacatagtgttgccatatagcccagaattctattcctaggtatccactggagagaaataaaaatatgtccatcccaagatatgcacacagatgttcacagaagcatttttcacaagagccaaaaaatgagaacaagcctaatattcatcaactgatgaatgggtaaataaaatgtgatttatccacacaatagaatactattcagtaatgaaaagtaataaaatactgatagagctacaacagggttgaacctcaaacacattattatgagccagtcagaaaaaccacaatcttatgatcccacatatatgaaatgtccagaataggcaatccagggagatagaacgtggacgaatggctgtctagggctggggtagctgggaggatgggaagtaactgccaatgggtatggggtttctttttgggatgatgaaaatattccaaagtaagattatggtgctggttgccctaatatgattacactaaaagccactgaattgtgtattttaaacatgaacaaacattttaaatgagatgatggtttataaattatatcccaatgaaagcttaaaaagtttcatctatcatgtgctacatgaagttttcagcactagccagaaagggtctcttaatcttgttagtctcttttctttaagatctttgcatcagttcttctttttgtcatgaatgccttgattctttctaccacaaacttgcttctcttatcttccaaaacagcttcaagttcctgtctctcaaacatgccaggcttgttcctattgcaggcgtttgcaatggtgcttccttctacttgaaacctctctcccttgcctctgcaggactgcctccttctcaccactgaggttcaactcaaaagagaggtcttagacttccatagcttcagcagcccacagtcaccacctacctctcactgtatttgtgtcatggcaagtacctaacagtagcttctgtcttggtttccatattcccatttgtatttgtttgcttgcttgctaaaggatttactgtgtatcttcctcactagatcatatgttccctgaggacgggagctctgtcacagctgtccccaccacaccaggcctataataagagacgttggccgatgcctttagggtgaatgaagcacacgataaggttgcttgcttctgccctagtaataggatgaaaaagaatgaagccttttccctctccaaaaccccaccctcattcatccccacctcctccaagaaggagccagaatttccttaacaacaattttttgatgctaaaaacctctccccgagagactgattccagaaaaataaatttctcttcacctaaaggtgcagcaccagctcaatgaaaattgtttcagtaaaactagtctcaggaaagatcaataggaggaaagagagaaaagcaacaaagactaacttgcacttccaatgcaaggaaaatcaaagcggagtctgtcccaggggagttcaaacaatagaaacaataggtcgagaagccatgcagcgattactcagacaaaatgaagatcactccaggaaaatgaagaagagaatgaagcatagcttattgtggagtttgtcctgaaatttatagctgactctatgagaagaactgcaaagcatctagcccttcagcattgaaagacggaaggaaggaagagaaaggaaaaaagaaagaaaaagataagatgagaagaaaatgttttaaaataaaaaagcaaaaccatttcctcacctaatcttcttctggataaaagagctagtgagagaatcaacacaaagaaaatgacacctatttgcaattaaagaaaactttacataaaagcacatattttattctatttcctgaacttctcttctgcaaaaagaacaaaaagagagaaaaagaagaaaagagacagggttaaagttacaaatacaaaaccaatcaaatgatgctggcttcctttttaacctaagcaccacacagtcaatcaataaaatgtcaaaaggctttcacaatttacctgttacaccatgagagacatcacatccaaataacttgctgatatgcaagcctccagctagattcacaagaggaatgaagaccaagttcagacacagcaaagcaactcacaccactgcaaccatgtctccaggtatgaacatttgaagaccagtagtaacatatctcaaagaccactaaattatttaggaccatcattcaggaagtgttgtcatgctcaaacaaccggagatcagagattatacctaagcctcctcttccccctcctccgccgtacccccgcaagtaccaagacagtcggccaagagcaagtttagtatcagcttatcataggctctagtcttagccttgcaattacatcctgccctggcaggaagctgaacctggcaatcaagattccctctcatctctgttttctatatcttgcatgcttggggaggcggcagagcatgtggtatgaccacatgcagagtgaaagtttgcaagacctgcatttgaatcctgattttggcacttctcccatgtgagcttggcagctcacttcacctctgagggcctgtttctcactggtgaacaagggccagcgatccctctttaaagggttatgaacatctaataattcctggcagccagtagcttgctcaataagtgttagtcccctttacacagtaaaattattagctaaacagaaaaccagcattctaacctgagcaggtctctttgatttgagaaaaaatacatgctttagtttacatcatctgattgtattttgtggatcattacagactgtttgtaaatccttctggaagaaggcatgagatatatctgatacaaatatacattcttggaggaattgagggaccttgctatgtgcataaattcatagcctgcccttctgcgaccctggaagaaaccattttgtcagggaaccacttatccctaatttacctgatttgtaatttcagagtttcataaagtgaaggcacaactataattacccttagtgctccatttaggcggtcatgatttttgacaaactctaatgcttggcaacctaaccttctagcatgtctggaatgtcttgtatgtctgcttagttatttgcaagctttctaaatagacctctaccacttcatggctggtaaacgtttccagttacattttagtcctcttgttggtcttctaagcatgacatatactctatattttatgtatgagtgtttcaaagatgagggataattctcagcaaccatctctgtatcttcagtctcaggtgctccattaggattcttaagagactggatgaagtcattatcaaagcaagagctgttacttgaagaactggcaaacttaaatattatcttacaagcagccaacaatgcacattcctttatacacaatcaaaagcacaaactcacactcacatgcatgacttttagcttaatttccagtttaacatttagaaaaagggaactattggccaaataaacttgtcaatttatcaaattaagaggggagagtagagtacagtgtaaggtctaatcttactgcctcaagtatttgaaaggttgagtcaagacttacaaactcaaaatgctgctaagagccaataaggcagataacgtaagtgtataatcaaggccacgtgggagcaatagggagtggtggggcttacggcaaactggaaaaccatctcctgccttaatcatttaaaaaaatatattttgctagccaaacaaaacacactgtgagctgcatttagaccaggtctggctgctatttgaaaattcctagttcctggaatggaaggttaggtacaaagtaaggaaacattttaaggtcccagaagtttgaccactgtatccaagtagatctctctggttctctacaccagcactccatttattcgccctcctagcatttacagcctctgtaatgaattggcctcttgatttgcttacttctttagaattctctctctctctctccatctctctctcgattataagcttcacgaaggcaggggctgtgtttaccttgcttacggttatcatcagcactagccagggtgagggacataattggttctcataaaaactgctgaatggatcaaggaaggagtatgatacgttttgtcatcctatgacatatcttgttcatcttgggaccccaagcatatagtagtacaatagtaatgataagtactggggtgcagtagtggggtgcaatcatagcttgctacagcctcaaactcttggcctcaagccatcctctcacctcagcctctggagtacctgggactacaggtgtaagccactgtactcagttaattttttaaaagaaatttgtagagacagggtcttgatatgttgcccaggctggtctcgaactctcggcatcaagtggttctcccaccttggcctccctaagcactgggattataggcatgagccacagcacccaaccatgatagtatttcttgaatgaaattattggtgatcatgttccaccacgaatggttaaccacagggaggtggtgtatactgggtgggtccagggtctagaaatagatgtggtcactaggctgaggagatgattgggcacgagatccagctctgcaaggaaattcagtaagacagaaaatagcaagttttatgaatactaataaagcatgactagtaatctaagcaagttgctggcatcagggatgtctgctgatggctaaaaatagagaatccagaaagggtcagtgttcccagataaacgtatgtggtctgcctcaagtaagcaactgataatagaactacaatcatgaaagccaaaggctgagttcacacatgtgggaagaggggtggtagtcaaagtcacaacagagaataggcactaagaaacaatcagctgggtgcggtggctcatacatgtaatcccagcactttgggaggccaaggtgggtggatcacctgaggtcaggggtttgagaccagcctgaccaacatggtgaaaccctgtctctactaaaaatacaaaagttagctgggcatggtggcgggcacctgtgatcccagctacttgggaggctgaggcaggagaattgcttgaacccgggaggcagaggttgcagtgatccaagatcacgccactgcactccagcatgggcaacaagagtgaaactccgtccaaaaaaagaaaggaaaggaaaggaaaggaagggaagggaggggagaggaggggaagagaggggagtggaggggaaggaaaggaaggagaggggaaggaaagggagggaaagggagggaaaggtaaggaaaacaatctaggcacccaaaatgtgtttagcattctaaaattccagaagtggttgcaaggtatagacttggtcgcagcatccaggatgaagctcaagtcaggcccatagtgttggttggtgttaagttccctaataaactacaaccccactaaggacacactgaatgccaattcctgagggaatacactcctctttactgtagagacaagaactcccaatcctgccttttgtcttgaatgactgtgatactagactgtttcatttccagaacagaagaacctgtgtgagttactgctattacttacattagcaatcaggactttctctatgaagaacagaaagataatccaaaccccctttagaaagaaagagcaatctgttggctgcacaaatacaccatgggaaggcaggaggagagttggtcttggagcttatgctctctctctgcccctgggctgtgtcactctctatcgttggcttcactttcttctgaaagagatgggcttttcctatgcagaatcaatgtagcttggtagacaagagcacgaatttgggtcatccgacaggctgggtttgaatcccacctctgccccttgaacttagttgaattattcatctgtaaaatgggcataattaatggcacctcactcttaggttgagtgagtaaggattaagtgagtaaatatatgtaaatattattacagcagctagtgttactttcagtaacacaagaagaaagagatgctaaagggactgtgatgatttcaactatgaaatggacatacaatatattttattgttgtttgactacgttgaaatatatatttaaattgagggccatcattttatctaaaatttactagtaattcactaaacagatttccctaattaaaaccactcaaaccagtatgcagtgattttatggcacaagaatagactatgagtatatggtttgcagcctggacaaaaacctttttgggtctgacctgaataagtaggttagtttatatttcaaatatttttatttatactatttcctctgttttactcagtaaacattaagttaatcttccgtatcatctaattaaccattatttgtaatgaagacaaattaaatttgtaaaataggagtagaaaaatggttacagatggtggctttagtaagtattgtaaaaatgccagacgctcaaatctgtctgactatttatgcaagttattgtgaatgctttgaaatttgttaatactgcactctttagaggttttgttatttcaggaattttagagaaagagtcaatactcttagtgtttgggttcaggaggacccactttctgctccaggaatgacccaggactggccaatcaaaacactgaaccctctggccatattgattgatttaaagatgggcgagtgacccaagttcatccaattagggtcagtcttgggacttgtgcagaatctgtcagcagacacatgctcttttttgttggtttagacgtacaagactataagccataagctgtggacaatcatctttcttaagaatgaagccagcataaagaagagtacaggtgaaagatgaaagagagagagtgagagagagagagagagagagagaaagagagagagagagagagagagagagagagagagagagagacagggagattaggtcctgatagatcctgatgacatcatgagtgtccaggccaagtcatacttaaagcttcattaactcaagccaataaagtccacctttttgcttaagtcgctatgggctatttgtcactttcaattaattaatactttcaattaatataggtgagatatgttgattgtatctgacccccaagagttacatctctatttgctatggtagttttttttttattattatcaattgtttgctcttctcccaataacagcttgcttccccatccattgctatgtgactggcattgcctacgccgaggaaggagaatacctctcgaacccactgatgtaaactctgaccatgtgacttgttttggtcaataggctgtggaaagcaatgacatatgctgtatccaagcagaagctttaagggctatcacaaggtcctgtcatacttccttttttgttttctgccaagtagctatcccatcttagaatgaatcccagaatggagaaaatatttggagcagagcctcagctgacctacagctaatgagtaccatgaacaagatataaatttattttgttataaactactgatatttgggggtagttgttactgaagcataacctagtaaaagctgactaatatacttgttatctttgtaatgcttgtcaaagttcataactgagtataaatctagagcacctatcatggtgtttataatttatatcctgaaagttaccacaaaagaatttcggacgactgattgcttctcattgttttagtattcgtggcccagttatatgcagtggtggtcaaaaatgtgggctttgtctttgtggtttaatgactggtaagttacctgaacttacgagtctcaatatcctccttataataaaaataataatagtaataataataatgtcttccccatgggatttttgtgtatacagagtgaaacacagtgcaggggacatggtaaaacacttaggaaacagcaactataatttttaccattacagaagaaagtgccctcatggaactttttttaagacatggagtcttgctatggtgcccaggctggagtgcaatggttcttcacaggtacaatcatggtgcactgcagtctcaaactcctgagctcaagtgatccttccacctcagcctcctgagtatctgggactacaggcacatgccaccatgtctggctgaactctttttgatgtttccagaaacaatcccccaatgggtggtagagtccaaggtgagcctagctaacactaagcaccattccctaagaaatagcattctggggaggctgttaagacattactttttaaattgcacgtataccatccaaggaagagtggctggggagaatgctgccgaggaagctggatgggagctgagggaatatattgagaagtgggatagccatttttcctctgaatttctttgcattctaaagctcaatgaaaagagaacaatgcctccagagttggacctcaagtgagaactgaggaggacaccagaatcaagctggtgctgttgaacattcatcttcatttatgagtagcatttggacaatttgttttgctaatgggcgaagtttacattgattgaacttatcatttaatatttttggaaaaggcaataaggggattttatgacaagaatatttgttagggcaattatctcctgaataacaaagagtatgccttttgaatgatttgaatggattgaagcctgcacgtgtgtgtgcatgagagagagagagagacagaaagagaaatctcaaaggataagaatatgagaatagttgtgcaaatatagcatgctcttcaaggtattgagcttagaagtattttctgggaattgttgatagtttcagtcttcctcttttcaacaaggattcatctttctctgttcaggtactgtgctatatgaatatacccatataactttcatagcttagaactctacaacatataactgttaagagttataagagtaaataaacacttagcagacacttattagtatctcttatagaggagaaaactgaggcttacaagtattcactgatttgcagacgggctcacaggcactcattattattcaaagcttatatttatacccaggacttattccttcaatgagtatttatcgaatatctactgtacaccaggaatatttccaacttaataatatcatctaataaatttcctactgtcatgaagcttatgttctatttgggaagataactaagcaaaaaacaatataatttaatatcatgaaaaataaaacaggacagtgtgatataagatgatagtggcacattagaaaggatacttgttaataaaagtcctttgtaaaacaaagacactgagctgagacagaattgataggaagcattccagatgggggaacggtgagtgcaaaggtcctgaggcaggaatcaacttggcagactttacaacaggagacagaaaactggtgtggtgagagtgccctgaacccaggagaaaagggtgtaattggggtccaagagattatagactcttttgggccacagtaaagagtctgaatcttattctaagtgcagtgggaagccattgatccaagcagtagttaagaagttcctgctaggtcctgtgtggacagtggattaggtagaagcacagagtgcatgaaaaacaacagctgaggagaaaggctgttggtttggaccatggctgtaggagaagagatacagagaaatgggtgaatttgggataacttttgcatgggagctgataggagtttgctgttggactagatgtgaaggagaatgataaaacagaaacaaggacagcttctaggtttatgaccgaagtaattaaatcgtgaagctttatactgatgatgcaatccacatctctatagctctccagtaatctctaattgtgtgttctggtgaggaattctctctactgaagtgctatcttattattctatctgcagagagcaggaagacagagagagagagagagagagagatggattctaatagattgcatttgaattcagactcatctgctccaagccttctggtgttaatagctgtggcccgattataggcattggctcagccaatgatagagtgtgttttagtgtccagtcccttagatttaaagaagacagagagtctaacaatactggcctctccggccttcctgttgcccattgctgacctgtgtctgaagcccacttcctggatctggcttcacggcttggtcaagaagactctgtgtacatgcactgacaacatgtgatgacagactgggttccagaaggggatctggaccgtggtcaaggacatctgaacatccccagaggccagaagatgacagcctggccactttggcttcttgccttctacaggcagagtaggccaagccccaggacccagagctgtggctgagctgggtcaccactgtggtttggacagagagcagggtggggtgagctgtccccgggctgctctggagttggcttcagacaagagactaaggtcaggcatgtggtcgaaatcacacgtattcctgggcagaactctcatcgggacttatgaaaatagattttataacgtcagctgcacttggcaatgataatttcctggttgaagatgcgcggaggatccctaggatatatattcttaatgaggacagaaatgtgaactcattgcattgagtgggtcatccttattccttgacacttggtaaagtgtcctatttgggcatagaggagagtttcagtgagtcaggatgctggctgatggttccagtgaagagaattaatgaagaaactacttgcagaggtgtaggatgggccaagggaactaacaaggaatgggagccacctaaaaggctagcaacaagggcaagcaggtactacccctgggcctcaagggcacaaagtgagggcacatagttacctgaacctggtaagaactggaaccacagagaaggcccccccaccccccaagccagggctggagtcacacagagggaagcagtgactgccacagaagttgcccagaagtgggagagagaaaggaaggaacgcccacgctctcttttctgtcatctcccacaggggagggaggaagtagaaaagggaagaggatgaatcaagaagcacaaataaagaatccccaggacaagtgggaaagtcacgctctccacatgacagcattagcattgtctctaaacatgtctaggcacacgcatgtacacacgcccctcctaccaaaaaagaaggccaactttgtatttttaaaatattatcctggaagcagtgtggtgtagtttaagacacaattatatgtttggtgatatatcctatcagtaaaaaaatttaaaaatcaggcaatccaaaatttgcatatttattaatgtataaattgtatatggcaagcttgtccaaccagtggcccaggatggctttgaatacagcccaacacaaatttgtaaactttcctaaaacactataaggtttatgcatggaccttctttttttttttttttttttttagctaatcagctatccttagcgttagtatattttatgtgtggcccaagacaattcttccagtgtggctcagggaagtcaaagattagacatccctggtatatggcatatatgtattaccatattaatatacagtgtacagtataacacactaggtaagggcatggattctgtagctcagcttcttcatagcattgttgtaagaattaaatgaacatctgcagaggccttaggacagtgcctgacatgaggcaagcagaatatgtggtacattatagtataaaacatagctcaacacagaagttttataaggctgaggtaatatcacactgaatgggcaaaaactggaagcattccctttgacaactggcacaagacagggatgccctctctcaccactcctattcaacatagtgttggaagtcctggccagggaaatcaggcaggagaaagaaataaagggtattcaattaggaaaagaggaagtcaaattgtccctgtttgcagatgacatgattgtatatctagaaaaccccactgtctcagcccaaaatcgccttaagctgataagcaacttcagcaaagtctcaggatacaaaatcaatgtgcaaaaatcacaagtattcttatacaccaaaaacagacaaacagagagccaaatcatgagtgaattcccgttcacaattgcttcaaagagaataaaatacctaggaatccaacttacaagggatatgaaggacctcttcagggagaactacaaaccaccactcaatgaaatataagaagacacaaacaaatggaagaacatttcatgctcatgggtaggaagaatcaatatcgtgaaaatggccatactgcccaaggtaatttatagattcaatgccatccccatcaagctaccaatgactttcttcacagaattggaaaaagctactttaaagttcatatggaatcaaaaaagagcctgcattgccaagtcaatcctaacccaaaagaacaaagctggaggcatcacactacctgacttcaaactatactacaaggctacagtaaccaaaacagcataatagtggtaccaaaacagagatatagaccaatggaacagaacagagccctcagaaataataccacacatctacagccatctgatctttgacaaacctgacaaaaacaagcaatggggaaaggattccctatttaataaatggtgctgggaaaactggctagccatatgtagaaagctgaaactggatccctttcttacaccttatacaaaaattaattcaagatggattaaagacttaaatgttagaactaaaaccataaaaaccctagaagaaaacctaggcaataccattcaggacataggcatcggcaaggacttcatgtctaaaacaccaaaagcaatggcaacaaaagccaaaattgacaaatggggtctaattaaactaaagagcttctgcacagcaaaaaaaaaactaccatcggagtgaacaggcaacttacagaatgggagaaaattttcacaacctactcatctgacaaagggctaatatccagaatctacaaagaactcaaacaaatttacaagaaacaaacaaacaaccccatcaaaaagtgggcaaaggatatgaacagacacttctcaagagaagacatttatgcagccaacagacacatgaaaaaatgctcatcatcactggccatcagaaaaatgcaaatcaaaaccacaatgagacagcatctcataccagttagaatagcgatcattaaaaagtcaggaaacaacagatgctggagaggatatggagaaataggaacactttgacactgttggtgggactgtaaactagttcaaccattgtggaagtcagtgtggcgattcctcaaggatctagagctagaaataccatttgacccagccatcccattactgggtatatacccaaaggattataaatcatgctgctataaagacatatgcacacctatgtttattgcagcactattcacaatagcaaagacttggaaccaactcaaatgtccatcaatgatagactggattaagaaaatgtggcacatatataccatggaatactatgcagccataaagaaggatgagttcatgtcctttgtagggacatggatgaagctggaaaccatcattctcagcaaactatcacaaggacaaaaaaccaaacactgcatgttctcactgataggagggaactgaacaaggagaacacttggacacaggaaggggaacatcacacactgtggcctgttgtggggtggggggaggggggagggatagcattaggagatacacctaatgtaaatgaagagttaatgggtgcagcacactaatatggcacatgtattcatatgtaacaatcctgcacgttgtgcacatgtaccctagaacttaaagtataataaaaacaaatagagacataaactttgaatatgcttctccatgccccatcatgcatgcttccatcagggtatatacttcccactttggagatcaccagctaaacagttagtatttgttaccgggcagaccatcccactgcactaccttgagtaaattcacccattacagcctcactgtcctcatctgtaaaatgataacagttactagtatcctggttgttggaggactaaatgcactacatccagtcaaacacttagcccagcacatcagtactcaatacaatgttacatgcgattattgtcataaaaggaatggtcattgtattaaaaccaggaaagagaaaaaaacaaaaattgtccatactcctacaggatcatatacaatcactgtaaaataatattggcatatgtttttttgagaccttcttctaaagcttatacacacacatattttgcataattggatcatactgtacattctgtggtgggtctctttttaatggcagtaaagtataacatcttataggctcagaataatttatttacccagccctattgttggtcatttatattttttccaatattttttcattttaagtaaccccgggatgaatactttttttaacagcttcattgggatatactttacacctcataaaattcacccacttaaagtgtacaattcaatggtttttagtgtattcagagttgtgcaaccatcaccacaatctaagtttggaacatttttgtcattcctaaaagaaacctacaccgagtgtagtcatccccaaaccacccctcccagacccaggcgacctccaatgtacatgatgtttctgtagatttgcctattctgggcatttcatataaatgggatcacaaaatatgtggtcttttgtgtctggcctctttcagttaatgtttgtgaggctcatccacattatagatctaccaacacttcattcctttttattgctgaatattccatggaacagatataccacattttatttatccattcatcagtaatggatatttgggttgtttccaagatgaataatcttataggttaatctttgcacacatcttagttggttcctttgaatatattcctagacatgaaaatgctaggtgaaagatgatacacataatttctaaacttttggatattagacactttcaattaaagctttatttctcacttgagcacactgcttcctttctcatttgaagggtcactgctcttcatcctatcaactacaaaacttttctaatctcttccttgtgatgcctggagatatttgcaatttttaatcttctaaagcaacatccccagggattctatcctcttttggatatcagagactctgatggacaaggacactcccaaaggaaacaaatagtggccagcataagtggcttatgcctataatcccagcattttgggaggctgagaccagaggattgcttgaggcctggagttagagaccagcctgggcaagataggaagaccccatctctacaaaaaattaaaaataaaaaaaataagctgggcatggtagcacatgcctgtagtcccaactacccaggaggttgaggtaggaggatcacttgaacccaggagttcgaggttacagtgagctatgatcgcaccactgccctccagtctggatgacagagcaagaccctatctcaaaaacaaaaaacaaaaagaaaaaggaaacaaaaggaaataaacagtatttacttgtatcattctttaccattttcaactggaagcccccttaagtgtgacattaatgaaagtcagcttgtaagacttgtaagtggcagatagtctctttaaagcatctcactttgtccttgtaagtaggtgtttctactatcaacctcttgaaagtggttaatatccagaaaaataatttcttattcagtaaaattttgacccaaggtttcatagcacctaagaagccaagtatcattaggctcataatcttatttatttacaacatgttacagataaactgactttctccttcttaagaatttgaaggaagtgaaaatttgttttctacatgctgtggattttaatccaacatagctgttaaactcttggggtggcctcctgggtgaaatctactcacacattttctttattatatgaaaggatcctgtggggaaggcagctggtgggtaaacaccaggcttaagccttagtcagtgtgaatcctggataatgtttacaaatagaatggtctctgcagcaaccaactaacagtagataagagagctgcctcatttacagctgcgtttaatctttccaacgcctgaaaaatattcgctgaatgctggtgaataggatggcttatggtgccctcaccttcacccctggacacgcttcctccactgacctttctggtcacaagcaacaaaggtggttaaaaatactccattctttgtacaaagaccatccactgcaaccccaaggcccttaatgttattatccgtggtgctgatggattggccctgatcttcaccccacttcctcttcagaacaacacgcatttatgttgagaagactggcggggactcataagtgttggaattctcttacatgtcaattaggggaggcattttacacaggatatccaatttcaacataacaaccacccacaaagtaggtgctgttatgcccattctaaggatgagaaagtggaggcatagttgtgctgtgcatcctggaacccaagtgtaaaaaaaaaaaaatcttattaaatacagacttcttatgaatgtacttaggaagtgtattaattcctcagagtaaataaaggtaactctactgctaaattctttttttttttctttttgagacaggatctcgttttaccacccaggctggagtgcactggcaacatcattgctcactgcagcctcgacctccctggctcaagcaatcctcctgcctcagcctcctgagtctgggactataggcgggggccaccacacccagctacagctaatttttttggggggggtgggtagaggtggggtctcactatgttgcccaggctgatcctgaactcctgaactcaaacaattctcctgccttggcctcctaatctgctgagattacggggtgagctacagtacctggcatcctactgttaaattcctgcctctcagctggagacagtgcacactgcggtgacgatttattttaatataaatgctgcagtgctgtactttccaaggtgttaatttcagagaaaatgtcccaccaaaaattgggtgggtcatatgatcaataaattttgttaaattaaattgtacaggattcttgagtgtggaccttcatagagattctaatatagggatgtgtattctgaagccccaagatgggcgaagaatcaatactatttttgtggaacaccaattagcctttaatggagctgttttttgtgacacacacaagcagaatgaacttcttaatggccattcatttttggtttgatttttaaataggcagtatatacagacagtaaattttgagtatccagagttattcagtgaaaggtccatctctcttcaacctttgcctctaaaattctctcttaagaaacaactattgatttcaagttctaagatattttaggcatatgcaaccatgcatgcacgtatgtatgtgtgtatatgtgtaagtttgtgtgtgtgtgtgtgtttcagttttgagtcacagtatatatattgttctgtaccttgtatttttacttaatagatgttagaaatcagtccatatccatatatataaggctgtgtcacttttttaatacctacatagtattttacggtatagatgtgttaaatatgtttaaccagtaccatattgatggatatttagaatatttctaatcttttactgctacaaacagtgctgtagggggtacccttgtacatttttctttgcaccatggtgtttcttgtatcagattttgatttttagaaaggggcatcataacataatatgattctgtgaggtcaaaaatggcccaggtttgcagccttctgatggtctggcttgatccagagacagagaagaatttagagtttacagaactaagccctaaaaaaaattgtcagagtctgtttaaaatagagggaaaaataggtttttttttcagaggtaagaaaaattaaggtttttaaaaaatcctatttcttttagaggtaaagaggtttcgggttatatgcatgttcctacgcaaggccatatggaacttaaggcatgaaatctctaagaacagggatttcccacatggataacctttgattcttaactgaaaaagtaactgctttattcaccctggttcagaagcaatagttttgcttcctcactatcttgtactgcatttagtttctgccaaacagcatttcattgactctaaatattaaaagttgttctttctcctgaacatatttctccctcttcttttttgtttcctgaatggcaaaaaataacataataaagggtaacattttacataagaaaaaaataaaaacttttattttattaaacgaggttaatatctagttggaattcaacaacagaacttgatagaaagaagtgctcctatattttgttcaacagctttactgatgatgtcttccacttttaaaaatatcaattttatcaacaggtttcaatcgcataacaggctgggaaaatttccttgaggacaaattactgttgggacaaattacatggcttccaacgtggttgctccagctattatttctttatttcctagtcaatgagaataggggaagggagaaagaaagcatcctcctagcccaaacttagatatatgaacacagctgactacaaagtaggctagggaaagtagtctctaattggtcatccacctgcccagataaagcttggaggaatattctaccattaaaaggataaaaggtaagcaaccaatgggccaaagaagaaatcacaagggaaattttaaaatatcaggtgatttaagaataggttgcattatctggtcctcgtttgggacagtacagagcaacatattatagccacctttcatcataaagtgccatcactctgggtcaggcacaacaacctatgaggtggatccttacaaccacctacaaggtgggtactgctgttgtctccatttcatagacaaggaatctagagcacaggacaatctcaagaccacacagctagaatgttgtagagctagaattcgaacccattgttttaaaaccttattctctagactaggtcttgaattcttttaaacccaaatacatgtaatcacctgttgaggccagaagttttgtctctgctcccatctagctatgtcaagtgatacatggatgatcactgttcacaggcttctgcagcagtggggtttgttctacatttgagcagccctgctccagaatgacatctctccaggccagacggtgaagcaagctctatgacacaggtgatggtttcaaggaaggagagattctgaccattttattacctcccctggaacggaagcgatcgcttgcagtgccatctaactctacgtcttcacttgaggccagttgaacgggcaagtctgttgccaaattccaacagaaacattcatcagaattttcccttaggaatttttgcaaaagctagctgttccctcccgccatgttgtaatatgtagaaatggtcatctagttaggggcacacagaatcaagtatgacaagttatcaatttcccctttctcaaggtgctggaagtgagtcattaagtaaatcttgactatcagggtgtcttcagacctctaaagaagcatttgatgaaagagttctcagaaacgtgggtctaaatttgattctagtcctgagggcatctgttcaattgcatttgccttctgcagctgtataaactcatctactgctggaaaatctcagaaaccttgtagagtcatatgtcattttattgcacttcacagatattaattttttgttttgttgtgttttttacaaactgaaggtttatggcaaccctatatcaagcaaatctattggtgccatttttccaacagcatgtactcactttatgtcactgggtcacattttagtaattttactaaaattttagtaaaatttgatactaaagcgagtatcaaatattgcaatcaagcaagtcacatgattttttgatttcccagtacatataaaagttctgtttacactctactatggagtataaacagagcttctacatgcactgggaaatcaaaaaatcatgtgacgtgcttgattgcaatatttaacactcactttattgaggtggtctggaactgaacctgcagtatctacaaggtatgcttgtgcctcccaaggtctctgtttcctcctgaatattcgtccagaacaattttgtctactttaagacagggttctgggattaaattacataatccctatagaatacttagtatatagtaaactgatagtaataatagcgatttttgttattagctcaaactccacaaaaaattagagagatgaaaatattgtaacataaaacaatagtgtcagaagcagtagccaaataaagatgagaaatgaagtcagtccagaagtctatataaaaactattaagcaatttatcttatggtgatgattcatagacgttttattcttctccttgataatgaattgcctttgtattacttttattatcagacaaaacaataaagcagtttccacttggggagaaagaacttagacgaagttcgggtgtttctgaaattataaatcaaggataaaagcaatttaactttcaaattctcagttttcatgcactctgcaaggaaaggagctcagcccatgagtatacttgtagatcaaaatttacacgtttagggctacagagctctaacaggccaggcaacaagcaagccaaaggtgttgatgaccacagcaggcaggctcacacttactaatactacttgcagccctaaactcccatacactactctataatttccagaccacccacatttacactaacaagtccacatacagggcacaacaagcattctcatgcagttctgtcatcatgcccagttttcatgcctgaccttttctcatacttcagaacattctgacacttcctctctgcctaacttcaaagcagtgagcatgggagaataatttacattcttatagttgaccaataaatctaaccattttttccttgcagaccaatagagcattttatttacatgtggggtcatttataaatagagtactttattaagctcataaagatttctcagaacaaacaccatttttccaagtatgtttaatgcattcttggggttaacattttgttgagattagatatgtcgccctgatcaactgccataaggacatttactgcattaaattttatcaaatacagatcttcaggttcatggtcccagtagttgtataagcatcactgcagaatctatttattttgcatttcattttttttccctaaggcaaatcctctttaaaaccatgttggataagttttttaaaaatctttttaaactgaaaaagaatttataatttttttaatgttcaggttgcctttgtttaaaatgtgccagccactatgctaggccctgaggatacctaggcaaaacacacatagtccctgcctacatggagcttagagtacagacgggaagcagcaagaagaataccatgcctatataatcacacatgcatgtataattaaaaacacaggatgcagtgggcacatgtggtggccatggaaacacaactctccaactgcagggagcatacctgactgacagccccagctgtcgctcctctagatccttcaggccacccccagccaatggctcccattcctatcagacgcagaacttgtctaacgtgcatcttgggctaagaacaccccactggcatcactgaagtgttcttagagctgagtagagtctgagactcttcctatccattccttcttccttccccttctcctttctcaaggatcagacctgcatttgtggtctgaaggctctccctgcctattcttaccccacttacccctgcactgtatcctgcacaggtgttttccctcgtatgtcccttggacatgcttctcagaggacctggactatatacaacttagaagagaggagtacaacctagtctgagggatcagcgaagacatcctggagggggcaataaatgagatgagtacaagtagaaagcaatgatgctaagaggaggcaatgaacattccacatacagaaattagcatgtcaaagatcctctgtcacaggacaaaagaataaagaagagagatttatgttctttgcctagaatacaaagcaagagagagaagaagctgcagaggtaagcaaggaccagataaaaagaagaggaacaagaaaagcatctactctggctcaccatagtgaggcactgcacggggctggagttaagaggaaaaaccctacatacatagacttgggccctacttaatgctttcataataatttatttacttatttggttttaatatcttaataaggaaggcaaacaaagaagaaagccaacactttcttgggttaaccgcataatttcttgggttaatgtagcacttttggtaaagctaaagtattcatatagtacaggctaagctactataacaaagagaccctgaaaatacaatggtttaattgaaataaatctgtattttttctttttacataatggtctaaagagaagcagagaatctagggcaggtggatagttctgctctatagagttacccagggatccatgatgatgggtgagctctgccatttttcaaacatggcttccaacgtggttgctccagatattattatttcctcatttcctagtcaacgagaataggggaagggagaaagaggatcctactggcccaaactcagacacatgaacacagctgattgcaaagtaagctagggaaagtagtctctaactgtgcatcttcccgcccaaataaaacttggaggaatgttccatcattaaaaggataaaaggtaagcaaccaatgggtcaaaaaagacatcacaagggaaatttaaaaatatactgagataagtgaaaatcaaaatattacacaccaaaatttatgacatgcagtgaaagcagtcataagaggagagtttgtagctgtaaatgcatatattaaaaaagaagactgatctcatatcaacaacctaactttataactcaaagaactaggaaaataagaacaaattaaatgcaaagctaaccaaaggaaggaaataataaagattagagcagagataaacaaaatagagagtagaaaatttatagaaaaagagtcaatgaaactgagtattttgaaaaaaatcaacaaatttgataagttcttagatgaactaagaaaaaaagagaacactcaaaaaactagaattagaaaggaaagagatgttagaagcaatgttgtagaaataaaagggattataagagaatacaatgaacaattgtataccaacagattggataatgtagaagaaacataagaattcctagaaacacacaacctatcaagactgaatcatgaagaaatacaaaatctgaacagacccgtaactaataagcagattcaatcagtaatctaaaacctcccaacaaagaaaagcccaggaccagatggcttcactggagaattctgccaaacatttgaaaaagaataacaccaatcctccccaaactcttccaaaaacactgaagaacagtaaacacatccaaacttattttatgaggccagcattaccttaataccaaagccaaagatgctacaagaaaactactgaccaatatccctaaaaaataatgatgaaaaaacttcaacaaaatcctaacaaacaaaattcaacagcatactaaaaggattatatagggcaaccaagtgagatttatttctggaatacaaagatagttcaacatgaaaaaaacaaccaatttataaattactactgtatattacattaacagaataaaggacaaaaaccatggaatcaactcaatcaatgcagaaaaagtacatgaaaagattaaacacccttttatgataaaaatagtcaacaaattagaaataaaaggaaactacttcaacataattaaggccatatatgaaaaatccacagctaacataatactcaatggtgaaagacaaagcatttcctctaagatcaggaacaaaacaaggatcccagcttttgccagttcttttcaacatagtattgaaagtccaagccagagcaattaggcaagaaaaagaaataaaaggcatccaaattggaaagaaggaagtaaaatggtctctgatcacagatgacaaatcttatatgtagataaacctaaagattccaccaaagaatctgttagaattaatgaacaacttcagcaagattgcaggatacaaaatcgatataagaaatcagctgcatttctatacacttacaatgaacaatttgaaaaggaaattagggaaacaatttcatttaccatggcatcaaaaagaataaaatatttaagaataagctaagcaaggaggtgaaagagttgtacactgagaactacaaaacattgctgaaaaaaaaataaagaaataggccaagttcagtggctcatgcctgtaatcccaacactttgggaggccaaggcaggtagaacacttgaggtcaagatttcaagaccagcctggccaatggggtgaaagcctctctactaaaaatataaaacttagccagacgtggtggtgggcacctgttgtcccagctactcaggaggctgaggcaggagaatcacttaaacctgggagacaaaggttacagtgagctgagatcatgccattgcattccagcttgggtgacagagcaagactccatcttaaataaataaataaataaataaataaataaataaataaatggaaagacattctgtgttcacgaattgaaaaacttaatactgttaggatgtccgtgttacccaaaatgatctacagattcaaaacaatccctgtcaaaatcccaatggcattttttgaagaaatagaaaaatccatcctaaaattcctatggattctcaagggacactgaatagccaaaatacttttgaaaaaaatgaacaaagttggaagactcatacttcctgatttaaaaacatattataaaactgcaagaatcaaagctatgtggtactggcataaagacatacaaatagaccaatgggatagagtagaggtcccagaaacaaacattcacacatatggtcaaatgatcttcaacaaggagcctaaatcactcagtggggaaaggtgtcttacatggcaggaacaggagcaagagagagttgggtggggtagggggtgcaacacacttttaaagagatagatctctcaagaactcactatcacgagaacaggaccaaggggctggtgctaaccattcatgagacatccacccccatgatccaatcgtcttccaccaggtaccacctcctacgtcggggattacaattccacatgagatttgggtggggccacagattcaaaccatatcaccagactaaaggaatgagaagtcatgctccaccttcttaagactgcagtatcttcaattattttgaagtcttttgcatgggaaatttgtctattctccccaatttatttacgtatttggtctttcatttgtatcagtatggactcatgggtattttattctttgggttataattcaatactattttatttactttcttgctcaaactgttgcagctttggccattgagatctctttcattaggctcctgtgttcctttgatgtattcccatcattgtggccaaaaataattatcaaaatattaaaaacataatgacgaaatagatatagaatatgtatctaaagatttatttaattaataaagaaaccagaaggatgatagagttcaaaggaagacacaagaaactgacgcatatatagtttctaaatggaaaatataacgccgaaataagattgctaaattagaagcaatgctggttaatgtcatacactgcattaaacctataacttttggagttaacatctctcatgaacaaaatcatttgcatctttggttaagcagaataactgctcccaaaagatagccatgtcttggccggttgcagtggctcatacttgtgctttgtgagggtgacgcaggaggaacattggggctaggagttcaagaccagcctgggcaacaaagagagactccatctctacaaaaaattaaaaaattagccaggtgtggtggtgcatgcctgtagtcccaactactcaggaggctgaggcaggaagattgcttcaacccaggggtttgaggctgtggtgagcaatgatggcattactgcactctactgtgggcaacacagcaagaccctatctctaaaataataataataataaatatttccatgccttaattctggaaactgcagatatatcatttacatgacaaaagaggttttgttgcagatgtgatgaagttaaggatcttaagacggggatgttatttaggtgagcccaatgtaataataagaatcctaataagagaaaggaggaaagagggtcaaagtcaaaaagagattggaagatgttatactgcaactttgaaaatggagaaaggagcccaaagccaaggaatataggcagctcccagaaagtagaaaacacaaaggaacaggttttccccctggaacttccacaaggaatgcaaccctgccaacatcttgattttagcccggtgaaacctggcaaggacttctgagctacagagctataatgcaataaatttgcgcttgtattaaaccattaaacttgtggtaatttgtcatggtagcaataggaaattaatacaatctctaccagagagaagtcattggatcttatcagttttctatgagttaacatttaacactatagaatctggtctctaagcaataattaatcatcagtgaaacaaagttattattccctagagagctggaaaactgctgggtgggcttgatggaacagagctctaacagtgtgttgaacagtcatctttttgctatattcccaaattttcgataacctttcttaacatctctttgctgtgcccatatttctctcagaagcattcacatacttccatacctctcctccctctggagggtagcattgttactgcacattaacccattatttgggggcctttgatagctttggactctttacacatgaggcctttgaaagggcagtatcttaaggatgagatttaatggtcagacaatttaccttgcctttggaaagattcaggtcatatctctgatactaatgctactttctgttaaacatttttaaaaaatccattgacaccaaagtttatacactaactgacattgttcctgaagccagaatctgtaaatgcatatttcttgttttttcaataatatgcaatatgtacaacatactcccttcattccactttttcctctgtgatggctcgcccaaataccaccctatgtcagattgatttgttcagcccaacaaccttgtgaaaaaaagagcaccagtcacataaatagacatcataaagattaagaaataattgaacagagaaaaaaaaattttaactgaaagtagtgttaggatcagagatataacccaaatccttccaaagggaaggaaaattgcctgaccattaagtctcatccttaagatattgacctttcaaaggcttcatgtgtaagcagtccaaaactatcaaaggcccccaaataacggattaatgcacagtgacaatgctaccctccagggacatgctgtgaaaagaaccgggcttcctgactccaatcttctgctttcaaatccaccctgcatgccccacccagcctcttcttcagaaaacacttttccagctcacaacatccttgagcctccttactgccttcagctcaagtgtggaacctcaaatgtctctgttacctatctggctccattcctgctgcacatggtataagaaacccctgctggcctagtgcagtcgttttcatacttaagtgtccatgaacatcacccggagtgtttgcaaaaacagcttgctaggctgcaccacagagtttctgattctgtagagagtaaaactcaagaatctgcatttctaacaagtccccaagagatgctgctgctgctgctgctggtttagacgtcatactttgagaaccacaggaatctgagctctgggctactccttttttaagcgaacttagaataattaaaaagtgacccctagcaaataggagacttttggggtgataaagatattctttatcttgactggtgcagagattacaatgtgtatgcctttgtcaatttcatcaaattatatacttaaagtaggtatactttactgtatatgaataatgctttaataaaaatgatcttaaattttttaaaataaagaaacaatgtattcttatacattggacatagctgatcaatcatcattcagtgatgacttaccgagtcccttcttcccttcttaatgtaaagctaagttctgggaatataaaggtggctaagatgctaagcttgtctggaaatgtctcccattctgatggtgaatactgagaagtatactgccaattataatattacatagtaaatgttagaatagagaaaaggcaagaccatatagaatttggcactagaaatgacagtattctatttctactatccttttcttaaggaactctgtggtccacattgtagcagagaatgtaacacctggtgttatctacccttccaacccctgggccacagctggctggagcaaagattgacccctgaccaagctagaccaacccaacatgtttggaacaaggattttgaaggtgagccagttagagttagctgtggggagctataatgtttaggactgagccctgtgcaagccaaggaaggtaggctgaagagactagcagggaaacaagaccagccccctgcagatctagggcaattcctgataaggttctggttcctctgagacctggatggactctttgcaaagagtgctgggagattcttctgggggcagtggttctcaaatacaaacgtgcagaagcaacatccaggcagcttgtttctgtgttgacacctcagattcccctctgaagaatctgttgagaaggtgtgggcatggcacaagaatggggatgtttaacaggcaccccagtgatcatgatggaagtctgtgggttatattctgagaaacagtatcctccatttctttgtttgtttttaacttcagcccctttgagtgggtgtctggttcttagaatcaaaaagtattaatcaaggcagtgcatattaccaaggtttgggaagtaaaggcaagccattagacaaagtgatatgtgggtcctcagggatgagtgggaattagccaagtggagtgtgaatgtgtgcatggctggggagagcaggggaaagctaggttgtgcaaaggacctctgtcaagagggagtctggtatatctaaggatccaaaattcaatatgaatagagcagcagcatctgtgtgtgtgtggcgggagctggtaggtgggtagagagagaacactgaccaataaccaggaatccccctgttggaaagcagtcatcctcttacttcttcccatgggcaatactctattcctcctcatgcctcagggagcctgctggctttttggctgctatcttctattttctctacctagaccctttccctctctggttagcttccctaatgtttctagaatcaaaaccccacattttaatttttatttgtttttatttccataggttttggggaggaacagttggtagttggttacatgagtaagttctttagtggtatttgtgggattttggtgcacccatcacccgagcagtgtacactgaaaccaatttgtagtcttttatccctcaccccctcccatcttttcccgagtccccaaagtctaccgtataattcttatgcctttgcatcctcatagcttagctcccatttatgagtgagaacatacgatgtttggttttccattcctgagttacttcacttagaataatagtctccaattttgtccaggttgctgagaatgccattaattcattcctttttgtggctgagtagtattccatatatatatatatatatatatatatattccatcatatatatatattccatccatatatatatatgatggaatatatatatatgatggaatatatatatataaaatggactatatatatatgatggaatatatatatgatggaatatatatatgatggaatatatatatatgatggaatatatatatgatggaatatatatatgatggaatatatatatatgatggaatatatatatgatggaatatatatatatgatggaatatatatatatgatggaatatatatatatgatggaatatatatatatgatggaatatatatatatgatggaatatatatatatgatggaatatatatatgatggaatatatatatatgatggaatatatatatatgatggaatatatatatattttttctgtgatatatatatatatcacagaaaagagatttggggtgtataccagatacctcttgggctgcaccctgcaacctctcttctgggctactccctgcctcagctataccacaggtctctctctttctatcctggggcttggcatgggatggctgctggaagccactcagtgtgagggagctaacacccaagaagaaacccttggccaaaaggggacaagagcccatggaaaaatattctttttttcttcctggtgggtagaaaattctaaggtgcattttacatagcatctcaaagcatcctcagtgggactgaggtctggtggccacttcccaatccttgctcctgctccttgagatctcttcccagaataaaccacaggcacccaagctcttagacaagctgacatcaataatgaccaaagggaaggattaaggtcatcagaatattagaaaggcttatttatctaccctggtctacttgaaaatgcatatgggcttgttcaggtctctagtactctaaatttttcactttgctctagatattcccatgagaataacctcagttctgtctggagtgagtttggattttattctgggaattagcacttccaatcctatctggatcttatggggagtttctctgcatgtagcttgatggagtcactactggctttctgtgcctcttacctaatcctctcagggacagtgaggagggaccccagatggtcccccaccctgcatcagggctgctgtccctcccacacagcagatgtgcacccactatgggggtctggccaggccctacgactgaggaaggtactttgacttctgcctctgaggaaatcttcagtgagtctcacaacaaaattaacttcttggcagtctcttctattggtctttgtgttagtttctctggtcctcagaagtcctggcctctttcctcagtctgtatctctctttcttaattgatttctccccaagcatgtttttcctagatcaagccaccatcatcacctgactgaggcatggttgcagctttctagctaacttactaattgcattcatcatttcctaacttagtaaatatcccatgtgacttttattttaaagtgtgagtcaaatcatgtcccctctctgcttaagaaactccattaacttcccattgtacttagaacaaaatacaaatgctcaaccatggcctacaaggccatctttgatttaatcttgcctcactactccctcccctactcaatatgttccagccacacaggcccattctctactcataaaatctaccaagcatgttcctacctctgggcctctgcactcaccataccctcttcctaggaatacccaccccgcagacattcccatggcggggtctttctcagctttctgtctcagctgaaatgtcgctccaaagacaaactttccacaacagctaatccaaagtaacactacctccccacgttgcaccctcttgctcaatcacctgttttttatggtcctcatggtcacacacaattcatgttacatagcagacattcgatgtttcctgaatgaataaatcaatgaatgcaccctttagcaagttgtgaaggccacacatgtttatgggtgctttaactactttgctttttattctaagacatgttctgactcagattcttcggatacagtaaggccttagggtcaaagactgccattttagacatctacccatatactatctagtaagtcatgctactgtccacaaaaccacctcccatatctcagtgggctagcacatcaaaggttgctttctcatcgtttccagatctgatgcaggtcagcttgagggaggagagaaattttgattcataactttttttctagtgagtcagccaagcctgggggtcttagaatcaggccctagatcttctctatccagaagtcagatgagggcaaaaagtcaggaaagtagtgagttattatgggcaagcagttactatgggcaaggcatagaaaaaacatttaacacttctatccacatcatattggtcagaacgcagcctcctcctcccccatactccagcaagagaggctgagcaatgtaatctgtgtgccacccaggaagcaaagaagtggagtttggtgagtattgggccatgtgatagcctattccatcaggcttcagatgacattatttgtcatctgaaactggggtccgtcttgccagtcaagtatgcatgtccaagctaaagcaccactggagacttctgctgttggaaggatgtaatcatgcaacggatgcaaaaataatcccttctcctgaccttctgcacccccatctccagccaacacctcccatgacagaacctaatcagaagccagctaataagggagcctggcaaatgttgcttacagactttgaccctggatcacagtccagcacatagcaaggtgggcctggagatgagaaccaatagctaaataaccagcagagtgtcgagcttattaattcaacagagataatcaagaggttgcaaaccctaggttactccataggttatttttctaaggccttttctaaagattcctcctctgagggaaaaattttcaggaatccattcacatactcagaaaagcaaaatacaagaagtgttagtgcatttaaaagaaaattttctgaccacctggagaggccatataataacaagtgaaaaaaaaaaaaacaactagagaaaaattaagcaccaaaatggcaatggatagaatgatcatatcgtatgattattctgctgggatgctggactctaggcatttgaaaaaggatgaagaaattaatccagcctcataagaggatgacagaagtggttaagtagtcctttagcacagggctttaagccttgaaagctattggaaagctcaatgtaaaataaggttaaggcccattcacacgcataaagctgaaatggtggggaaggctggtggtaggggaggagcttagggcagcactcaggtattggtgtggggtaccatttccagtggaagcgagaccctccctcttctattctgacatcatgagcccatgccgtatggtttcaaagtagcaaattggttgctgaagctccggtcatggtatctgtgttctaaacagcagaaagaggaattggaaaggcaaaagactatgcctcccacctgagtcagctcccaacaacagcccttcctagaagtgtcacagagccatatttagcagtgtgagaggatgggaaatgtggttttaagcagagcacactaccaccctaactaagattggggttctgttaccaagaatgggagaaatggatgtcaggcaggcaactagtagttggccacaaacactaaggatgtggcttcccaggtgagccaggaaaaaatgctgacaatgaagacattcagttcctccctaagcagttggttcccttaccttcacttgccacatttaccaccctacccagggaatccctctgtgagggatcagaaggcaccacccagcagagactgtccacttgatcatcagacatatcctttgccccaactaactggattgcattctttacctaaaataagcaaatgctcaccaccatggtaggtatgtataggaaggaacatatgctcatttaccatagatgaccccccacccttccagaatatagcaaaaccaattctaggcctcagagataacaaatgtaaagtttctaatcctgcctgacttggtcagcaacagctcagtattatgaataattaataatgatacaaataacagtaacagccatctttcactgattgttgaccatgtgccaatcactgtgctgagcatcttatcctagaggcccacttgggagtattaaatgtggaaatgtatcagtctcagaagaggtttagatttgtttcttactctatgtcacccagttgttaagtcacagagttaggatttaatccaaatcttcctgactccaatctccagtgatctttcagttaactccaaattaactaaagctgtcatgtgttgaggctttatatcagttagaatgtaggtgcttggttttaataaagaccaagggagagtggtttagattagtcctgattcaagtccaagtccaaatagaaaacagtctggcagcagctgggggctgggtaatacagctctgctccacacaaaggtaggggaacccatatcccttccatattgatgctctgccatcctatggttaaagatggctctccacacctccttaatctagctcaagggaaggaaggaagaacaagtagaaggtgtttcctttaaatgggaataactcagaagtggcacacacttcctctcacagtcctttaggcagagcttggtcacatggccacaccagtgataaagaaggctaggaaatgtcgcccctaccttgacagccacatgcccagacaaaactaaaaggtgtgggttattcctaaaagtgggagaggaaatggatttgggggacaaaaagcagtctctgccacacttgcagattgcatcacaggaagagaaactggactctttggttcagaggaagagctgggcactgcccaaccaagaccacacaaaatggggaactctgctaatggagagcaggcagaatggaagtgggacagcccaaaactgcaactggggcagtgttcagtaatcatatactagaagaaaaagtgaccatgagagctgaaaggaaaacaagctgttattgtcataagaaaaataaaacaaaagttcttgctaatcctgccacccaagttatacatttatcctcctggctcttggccatgatggagctcacagtcttttttcagactcccctttctcagagcacacaggatgggtagatgttgggtttttggacagcaggaggaggtggctgggtctttgtgctgaaaatacccactctggctcctccctctggacccagatcccaaggtggtagatgttttgatggtacctcagagggatggagtcactgttgaaaagcactgcaggaaacaggccaaagtggtgggctgggcaggcccggcattatcagaagttcataatcaacacatgcagatccactgtatgtaggctttgaggattcacaaaggcccaggctaagccctcaaaagtcttcttgctgttatttgcacacttatagtagattctttataaatggtagcctgaagcctgccactgtacatattgtctctaatctttttttttcttttccttttgagaccgagcctcattctttcacccagtctggagtgcagtggcacaatcacggctcactgcagcctcaacctccctgggctctggtgatcctcccacatcagcctcctgagtagctgggactacagatgtgtgccaccatgcctggctaagttttgtattttttttttttgtagagatggggttttgccatgttgcccaggctagtgtcaaacttctgggctcaatcaatctgcctgtcttggcctctcaaagtgctaggattacaggtgtgagccaccatgctcggcctgtttctaattcttaaaaccaccatagcaggtgctttcggcatccctcccactcctttgtccttaccatttcagagcacagtggcttgcttccaactgccagcacctgaatttctctgctgaggactttcttgtgctgctagagtcctactttgccaagcacgggatacaacatatgcacctacaaattattagaacactccacctcccagaagtagccctcagttaactactctcaggaattggtgtataaataccttggctccctcggatttttcctcagatgggaaaattcagaggtacatgcactccactggttcccagagcctccccagtgtgaacaagctctaatagcttacagtggtagttgaattgataacacactttttcaggggctgcctcccattccctgtctcatttcctgactgcctgactgatgtttcccaggcttcctaaataaactacttgtagtctatctcaggatctgcttctggacgaacttgaataagacaccgctgtggagtaagttatgagccccacacggaggcaacaggctggcaccataaaaatcgcattggctctgcagtcagaatgacccagatttgaattccggcttcatcacttaccagctgtgtggggccgagaaaattgttaggctccggtgcctccattttctggtctattaaatgaggccaattatacctaccttgcaggactggacagctttaaataaaacaattcctctgatttccctaacactgtcccgagaacataacaggcactcaacaggagttagctttcttccctcctgtctccattttacaaataaggaaactgaaactcaggaaggtttcctgacttgcacaaggttaaaaaggtggttaagtgacagatcttggattcaaacacaaatatcttcctggttccaaatctacttaaaacttttccactgcgcctcccatatccacttcagggcctaaatttcctgacttgatacatgaaaccattttaaacttcaaattcccaggtctttctttcctactgtgctctgcagataccacatctggcttctgatcctcagagattcccacattctggtgccattcacaccctttgctatttgtgtcctccgtcctggggcatgggtctctctctctcccccattcagctgtgacacacacttttaatttgggggtaaagattttcacaagttcatctctgggtaaaatacaacatcactaaaaatagatgaaaatgcaggaaaaaaaggattacagggaactcagggacaaataaatgtacatttgaacgttttactcttagacaaaggtgaggagtcctttcctggttcccctttgaagagaacacccagagcccttccggggtggagcgcaaacctgccaagcacctgctgcttcttggtgagtgagtggaggtcccgaaaaggaggaaatacccagtgtttccaaattaagtccctcaacaaatagtgctgttacccaacagtccagccaaaagcaaagcagaggcaaagaccaaaaggaaaaccaaagtcattctgttcaacttactcagatttttgcagttagaaatctagaaagaagctatttttatttccacctttatatttgggatatttttaaaatacaatgctattttgaaatatgtttatattgcaggagcataatctttcagaggttgaactttgaaaggtcccatgtgtgacctcacctacagtacagtgaccaacctgtcctggttttagtactaaaagtcccttgtcccagaaaattacttagtgttgggtaaacagaaatggttggtcacccaattagaatacaaatttgattctcaagtcttcttttttaaaatataaatctccttaggcaggtcaaaacaattcaccagtggtaatttagggttctgatagcttctcacaaaatgccccacaaaatggtcctcactttaagaatccatggggatctcctattaaaggaatcacaaatgcagacactgatagaggcaagatctcaataagtgaagaaagcaatttgcataaaatcttccagtctactctttacttatacaagaagatagaatctcattcttccagaaacccacagcccatttagtccattaccttccctcctttgatagacatgggatggacaaatatctctctgcccaagaaaaactgctcaagtgtgatttttaaaaaagggcaattctcattgggactcaatggcaaggactatgacgactatgggtttccttccctccctccctgcctccctccctcccttccttccttcctaccttccttccttccttttcttccttccttccttcctttctctctctttctttctcgctctctctctttttctttccttttcctttctctctctcttttttttctttttttgagacacagtgtcactctgttacccaggctggagtgcagtggtgcaatcctggcttactgcagccttgactttgtgggctgtggtgatcctcccacctcagcctcctgagtagctgcgactacaggcccatgccaccatgctggattaattttttatatttttagtagagatggggttttgtcatgttgcccaggctgctctcaaatccttgggttcaagagatccacctgccttggcttcccaaagtgctgggactgcaggcgtgagccaccgcacccagcctatggttttcttagtctggattcctccagaagccaaccccaaacaaggattcaagtgtaaggtatttatctgagaggtcatcccaggaaacaatagtaggacagtgcataaatgagacaagaaagataaggccaccaaaaaaaaaaaaaagtactagcctattaagtcacctatcaccatggtgatactcaccatggtggaaactctgggaaaaggtgtacaatatacaccccttagtttcactggatgagcaagggagctggagtatccataggccaaaccctgttcatcactggagggagtggatgctaattcccctgcatttccagcccaccacttccacagtcagagaaagtcctcagacaaaccaatgcaggtgctggcagcgggaagtgaagctggtatgcacgaccatggccagggcaaagatgtagggttggccaccagcaacaccagcagcgtctgctatagtaatcaacacagaacccatgagccaccatagctctgtgctagtccgttgctgccatgtgagaatgcagccagtgttgctagagcttctgaatttttaaaagaaaccaaggatccagattgttttgtggaatttcctgattcgtaattgctgttgattgattcaaatattttaaaaacagtctagggaataaccaagcatgtctataggcagaatgtagcctatgggccattagtttgcacccactactctagtttaacatccttattttatagataaggagaccaaggccctagaggacagcgacttgactcaggggatgctgcaaattaccacttgtctgggatctgcaaccaattcccttaactcccaggccagagctcttcctaaccccactgtgctgcccacactgcccactctctcctctccacacccatcctcaaagggcaggagccttatccctgccctccactgcactcagagcaaaggaagtttcccttccttccatcaaagcactaaatattttgtctcactagaaatggattccttactattcttaatttcacagaagttagatagtgcttattgtgtcctgggcacccttctaagtactttacaaataattactttcattctcaaagcaaccctatgaactaaggattattattttcccagtcttaaagatggacaactgaaatgcagagaggttaagatacttgcctgagttgaagtagtagtggaattaggagacaaattttggcagctgtctccagagccactgattgacaaccactacttgacactgacactcaatcacctacctatttagacttttagaataccctgattggtcctttttcccatgataacaggaattggcaaagcacaggctcatgggccaacatctataccctgcttggtttgtaataaaaagtaaaccggaatacagccacacccattaatttatgtattgtctgcagccattcttgccctacaaagacagaattgaggaggtgcaatacaggccatagggcccacaaagcctattttattgagtgctgtagctttgataagggttgtttgtccccaccaaatcttatattgaaatttaatccctgatgttggaggtgggtcctgatggatagtgtttgtgtcatggggatggatccctcatgaatagattaaggccttcactcaaaggtgaatgagttctcactctattggttttcacaagagctagttgttaaaaagagtctggcatgccccaaccctcacctcttccctcctctctcatcatgtaatctctgcacacaccagttcccattcccttctaccataagtggaaacagcctgtggctctgaccagatgcagcccaatcttggactttccagccatcagaatcatgagtcaaataaaacctctttttttttttttaataaattacccagcctcaggtatacctttatagcaacacaaaatgaactaagacgtttagtatctggccctccacagaaaaggtctgccaacttctgcattacagaattgccacgctttcctctgactgcaagtttcttgattatgctgcttaatcataatgcagaaaatcctataatccctcccaaagccttagcatacacagtgatgaattcacaggttagacttctagaaacggcaaccgtgcagatgtctgggaacccagaaatcagcaaaaatgccttcagaactccacttaacgaaaaacataccaataatttccacaaaataggcacagacctaatctcgggcccttacctgggcaaaggcttttaaagcaaccggacagacagaaatacccaaagaggggcagagaggagaaatagaagaagtataactggcaacaggcatcttgcagttagagagacatggatgcaaatctcaactctaccacttactacttatcccttaaacttcaatttttacctgtaaagtaggaggaataataatgatcatttcttggagtggggtggatggtttagccaagattataatgtatatgaattcttagcatcctgcctgggatttgctaatgactcagaggagctatattattagtaataatggtaactctaaaagaatatggatctgtgactattcacatacaggctctcaatcccacacaattcagctgtcaataacaggattacggcacagaacaaaaagcaatctttatcatgataaccccaagtcaagaaaagatgtagccacatttatatgtaccaagcaaaaaaaaaggaaagaaccatgtgccatgttttcatcaaagaaagtttaagcaaagaataatgtgtgcacaaagaggtaagcttcaattacctggaaaaatcacttaagtgaaacaaatcacttattccttgacaacactatgtaaatgaaactgtacatggggcggaaaaaatgtttgcattgtaggctctgcaagatgacaaagttacatttcccactcatcatttagtgaaagcatctatcgaatagcatgaacctttgctgacaaactgccaatttttaaataccctttatcagcatcattttcatagcttttctctgagatccaaaaaagaccaaagatcagtttccagtatgcttttccaagtgtaatcaagctcagtgctagaaagtacaatgagaaccactcattatctgaactgtttaaagcagctgaatcattgcaaaaacaatttcttcttcttaatatgtttgaatcaaacttttgacctctagtaaactggatgccccattctttcaggcagtaaaagagcagctagactgggaacctggaggtatataaaacactacactactttttttctcttaaaaatacaaattgaattactttaacatagttggagcaaatgaccatgatatgtcctcaatttaagtcttacagcccaactgggatggcgttctgtgttcccagtctaagggcacatggttttcattagtttgtcaggattctgcatttcaatttgcacatttaaataaatgcagttagttcattcgtgatggccccacatacccttatcttttctgatttactgaataagccacactctcttaatgttttgagatttgtctaaatactaaaaggttatttgatatgacaagttacaacaaataccacttttactgcatgacaaataattatactgaaactttccactgatacacttccactgatacactgcttaggaagccttttaagtgcatctatctgacatttaaaaaaaaattaaagtgagactagtgcagctgacacagacaaagtgcagggtgcacacttctggttgttcatagcataaatgtttaaaggtggaaggatctcaagtgtcaatacccatttgacaaatccagagagctaataagcaggtttctggtcagtctgctgccaaggtaggatcagaacttggccttcctggttgttgatccagtgccaatttcagctcccctctctccccagcccctcctttatctgacagaactcgggttgagtattacacttggatgaagcagggccaaagctggccatgcaagctttgtgcctgtcccgcattctggtcacatatgagccttctgctcttttgcaaagactgaattgatgggatgggctcagtcaggtgcaacaagggaagcccgacaacaatcctcagccacatccattgttgggtcccccactgacactgtcggctgttataagcaccagctagaagatggatgctggtatttccagaaagaccttttgaatcaggaggggctgtgacgggccccatgctgtggcaagagcataattatttccaataactgtctgtctaggctacttagtgatttccaaagccaagctcctcctcactgtgacaacacattcagtgtttatttgaggggcagttttacaatgccaaaaattccactctggtaatagtttagtcagcaaggcagaaaggaatgacattttttataaataatgattaaggacaacctatttgataactttggatgcttgttcaggatctgttgtagggggcaatagtctcatttggaacaagatgaaccattagaatcttctgtgaggcaggctcttgggagagaaaggcaagctctcatgctgtgactgtcaaggacaacaaaaagcagagactcttgcaacatggtggcaaagagcacaaactccattctgagtttgaattgcaggtgtgtcacttactagctgtgtgattttggacaagtcacttgcccactccaagcctcagtttccacttctgcagaatgtgggttattgtgggtcattgtggtgatggaatgaaatgctgcttggaaagtacttggcaaatgcctggcacctggcacttataggggctcaataaaaggtagccattatcatcagacaccagttagtggggcttgtgctttgaaaagggaacttattctgatccaacattccatgctgattctctgcgttaatcagattgttgctgaaatctccactttggccttttttgagtctttcctgcaacttctgtccttcctcctacttatcaaatgctctggaactctccacctgctgctgcaaatctttcaggcccaagcgcagtaccatcccatgcaccccctgctaccatgccactgcagcaactccagacagatcaccatacctctcattggtgtctggataggagagttcaccttccatgttcattcacatcccatgttcattcacatctcctcttcctaacatgattacgcatctgggagaccgggatttgccttacatatcctccacagcactcaatacatgcccaagaatcttccaggttccctgatcccttgctacacaaagtgaggtccacagaccagcaccgttggcatcacctggagcttgttagaaatgcagtctcaggccccgtaccagatctactgaatcagaatctgatccccaagtggtttgtgtgcaccaagttcaggaaatatccctctagtccagtatttcccagacttcagtcattcacatcttcccttcataggttttgccattttccagtacaatctacactatgttttacctaatacatatttttacactgacactatttctttctcagcctcatcctaagcaatactattcaatcagcaagggagaaaggaatataatcttttacaagacatgaaggtctaggtgaattttttttctggtacacattaaaataaatagtcaataaggtaaaatgtttctctatctatcatctaaaattaactcatgtaccaccagggatacacctacccactttagtaaacacagctctagactttttgtagctggattagaagacatctaagtccagtgctcctgaactgtatctgtgcctactcagcatggttaccctatggggtgaatgcatttgtcttcaagacagagatggttgtgggaggctgaaaacctgggttctagccctgcaccatcccttaatgacttgtcatgtcacagactctctttggggctcatttttatgggttagctcatctcaaggctcccttccaagtcaaaaaatatgacattataattatgagatcaaaggctttggagtcagaatgacctgaagttaaaattaaagctccattacttgttaatttcattaaatctcagttttcctcatctgtcaaatggacaataagtggacataacatccatctgaaaggatttgtaagaagaaagaaaacaactgaaaaatgcctagcttaaaatgtggcacatagttggtgttcaacaaataatatgaattattattttttcctagcctccacaaagcacaaataataatagctagaattttttttagtatttactccacagcagtcactacatgaaacacttctttatattttgtcatttaatcctccaaataacctgatgaggtaggaattcttataatccccactttatagatgaagaaactgaggcacaaaaaaaggttaagtcacttggtcaaagcacacatttagtaagcagcaaagatagatctgagtgtagatcctctgaagctacaaccagtattcacaacaatgacctgtcctgccttcttataaaatactagtcaacatgcagactttgccaactcaacaaatattatgtgattttggccaagtggcaacctcacaaccagtttccttggctgtacagtgaggggtgttaggagtccccacctcatagggtgcggtgagcattgaatgagggcaccctcatggacatcacagagcaattcccagcacaggtgaattggtaaccatgtgctgctatcgttaccattagttctactattatttgttgagcctttacatctgcacaagattttgtgtgtgtggtgggggtggcgggccagggcagaagaaacaaaagtctttattgataaatagcttacaatgaaataaataaagcagtggtttgctgaagaataaaaatcagggcagtggctcggtctctccgcccctgcctccggccctaggatacagccctctggctagatacgtcagatgaggagaccgtaatgggcagtccagcctttcacgggcacttgggggtctctgtcttcctagacaggtgtgcaggcaccaccttggacccactgcccttagcaggagaagcagccttggtgtttggcccctgggcagctgcccctttaggagccttggtcttggctaccaccttctggtcgaggaagcaatgccattcttgaccttgctgacagtgggttttgaactcttactcccagctttcattttcctgtggtccccagcatctccttggctgctcctgctgcctcgggcctttgccttcctactaagcccgctggcactggaagggacctgcgtggccttgtctggcttaggggtgccttcctagcctcaccgggctgtggcctggtgtccttgcccacactgccttgcttgccggccttctctgtggctgcacctggcttgggaggagccttctgcacctctgctggcctcttcgctgccttcttcaccttgcccgcgttaggaggatcctccttggcctcacttggtttcttggcgtccttccccttggccttttccgctctcctggggaccatcagggggccatctccctgggctggattttcctcttgtgcttgggatctaatttgaagctgccagtggccccccttgcttcggagttgaggggcctggcgaggaggctgcggcacatgccagtggccagcgcctgcttcagcagatacctgaagcggaggacgtccaccgttgggtacttgtgcaggatgtagagcttgacggccaccgccaacgtgccctagcgctactccccagcctgcagcgcctctaccaccgtgcggggggtggggaataggggggatggtgagagggcaggaggcggcatgccaccgggaagctgctgcagctcaggcctggcttttcagattcaggagacctggatgatcctgctgtggaagtcgaggagagtgagatgtcactggtgacactcccaggaggggaggcatcagtagttttatccttcagttatggtaaggacttcctcagtttaatttttttaattttttattttttgagacagagtcttgctctgtcgctcaggctggagtgcaatggcactatcacggctcactgcagcctcaacctcctgggctcaagtgattcttccacctcagccttctgagtacctgggattacaggaatgtgccaccacacccaggtaattttaaaaattttaagtaggaatgaggtcttcctaggttgcctagtctggtcttgaactcttgggctcaaggaatcctcctgccctggcctcccaaagtgttgggattacaggcatgagccactgcaccccaccaggaattctttatcagataatttaatctattaaatagatgcctagtcacggccccctaaaatagtagcctttacacatggggtggccacataatttatcgtccaaactgaaggcatagacattaaccaggattgacccagggaagccagcacgatcgccctgcttctagggcccctctgctgtgagtgaacattgtcctcacagctgtacacactaggccccctttcccactggaaaactgtacgtaaagtgacagaggacaattaaaagcagcacatctctaaggaaaaaataacacagacccaaataaagacctcaaggctgaagagctgcagaatagagcactcatttgccctaggctttaaggaggtgtattcttcaaatactttgctctaagacactacttaaataactgttttcactagattagcatggcaaattgattcaaataaatgtcttccaagatttgcacataaatgaaaacaggatcacgatcacccccttgtaagaggttttgggactgttgtgggtttttaatcaatatatctgcctttttcttctcagtgtcattggaaaataaagtaactactatcaatttgacttgttctgcatcttgatctcataagtcctgatattgaccacgctaaaagtgacagctaaggttttccttatacacatgaaaaatcatattgataatctatttgcctgaatacaattcagctcattttccattatttggggcatcaaaaagaagagaaatcagcctgtgtgcattaggcacttgtaccctgtggtgaacatttattccagactttcttagccttaatttcccccttttcctgcaactgtattcatgtggcagtccagccctttgatgtcctctgtctacatggtctgggtaggactccattgctggggcaaagccctcaacctctgcagaagccacttagcacagatttcctccagccgtgccaactgggcaaatcatagctcattttgaaactttttgttcaacaactggggaaggggagttctttggttgctggacttgaacttgaaactgtgtaaacgagcaagtgctatatggtcgtcttgtcacccaagaaggaccccaatacacagaggaaagaagaaaaaggcagacctgaggaatgaaaagaaatcagatcctgaagtcactgtttagccctaagcaagacgctcttgaagtcagtcctaccgaagtaccttttagtaacctgaacccatatgtaagaaaaaaatatatattgtatatatgcatatacataataccctaattccacttaaaatcgggtttgtaacttattagcaaaatagcactaacagacacatgcatcctgtggcagtacttttcaaactttttgatggctaagaatcacattttatactgcaacccagaatgcacataggagtgactcaaagtctcatgaaattacagaactcttataacatatgatgatgctgacacttgctgtcttgttatacctaaaaaaaattactggtagtaacccactaaatggattttatgaccttcatattgaaaaaacactgtcttatgagattagtttaaaaattgatttcaccaggaagcatgagataaaaaatgacatgataatttcagtaaatccagtcattggggagaataagagatttggctcctaaattacctagagggtttatcaagcatctagcaacagaaaattgttatcttaccacttctctctgactgcccacggcacatatttggcagaagaggagaaaaaaaaatcttactgacttagaaataaatgaattatcctccaaaagtcttccatctaaaacaaataacaactacattgaaaaagggagagatatgtaagtaaaggaagatacatgtaagacctgctgatgagctgagtacattacttatctataggctgatgacagtcatttcagtgagcctcagcactcccgaacatataaaaatagtgcattcatgataagatcagatctctggggcagatttaaagggagagatagagcgagagatcacttgcagtataagcctcaaaccttcacttatgtgtgtaagataactatgaagatttcctgctagaaaattactgcaggctggataaggcagggtgtttttaactgttttccatgtaccctatttgtattgtaagttagccaaaactttctttttgtctgctcaaagcatgcagagtcttgattaaatctgtggaatcaaacggagaactaggattctcaggcttgctgaaactagaggccagcgacaataaacattactgagaaaacttcagctgatttgacacttgggagtggctgtgaagttaactcctcccacacttttctagattaggctcaaatgcaaccatctgcctgtttgaaaagcccattcacttttctgccactaagatagaaatttattaatttcaaaacaaagtgaagtttaatacaggaaaacaggatcgtgatcaccatgatcacttgcaggggaaaaatcttctgagaactttcccatggataatgaaaactaaacctcaaaatacggtatttaggtaattttttcatgttccagcaccatattgtttaaatgcattacacctgcatttctgaatttaagcaaataaaatggttgattaatattacttgcagatgtcacaaagaagtgattaaacttctaccattcagtaagtccttggagttgcctaaatttttctcaaccttttaggaaatgtaagcactgttcaaaaaaggtgtgttcaaacagtgtgtgtgtgtgtgtgtgcgtgttactttttattacaacattttcagattacaaaaaggaagaattggccgggccctgtggctcacgcctgtaatcccagcactttgggaggctgaggcgagtggtggatggtttgaagtcaggaattcaagaccagcccgaccaacatggtgaaacccggtctctactaaaaatacaaaaattagccgggcttggtggcacatgcctgtaatcccagctacaagggaggttgagggaagagaatcgcatgggcctgggaggcagaggttgcggtgagccgcgatcgcgccactgcactccactctgggtgacagagttcgaaggaaaaaaaaaggaagaattgtagaaacaccaatacatccaccacctgtcttgtgacacttaatttagagacaaaaatatatacagagtgcttactgagtgtcaatctctcttaaatatcatctttttaaatttattaaaaatatataggccgggtgccgcggctcacccctgtaatcccagcactttgggaggccgaggcgggcggatcacaaggccaggagatggcgaccagcctggctaacgctgtgaagccccgtctctattaaaaatacaaaaaattagccaggcgtggtggcatgcgcctgtaatcccagctactcgggaggctgaggcaggagactcgcttgaactcgggaggcagaggttgcagtgagccgagatcggccactgcattctagcctgggcgacagagtgagactctgtctctaaaaaaaaaaaaaaaaaaaaaaaatatatatatatatatatatatatacacacacacacacacacacacacacacacacggcagttattgttattgttattattttcttcatactcattaccaccaccactgcagcacatccctttcggaggcactgtcttgttaagagcctggcatctgaaattagatcttacataaaccacagattactggtgggacttccggtaagttacttaacctctctcaagggctaggtttaccacttcatggattatggatgatgccccaaaagtgcctaccaggatgcctggcacacagtaagctctctaaaccaccactcttcacagcatgtgtatgacatatgaaagtgcgtcttgatgaggttaagtaaggcgaagctgcttttcttcccctctagacatttgatttggaaaccccacagatccattccctttaggacgggaaacagcacgtcggggatcgcgctataatcttgtacacatctttcgagttggctagtaaatttctggggcgacattacctaatcttcaaggatcaaccagcttcccggaaagactgctgccatcagcaccctaaggtctttcttcccgaaaggcccagcctctagtcgcagccgtctgggtaccagcaaacacaccaaatcagttcgcgaagttcagaggacttggctctggtatgtttacaagtcctaacagatcgcaggaatgttcaggataattattaccccacccaggagcgcccagcccaaccctctcacatctggaaggaagcggccacacaaaggagagcgagagagagagagagacctcctcctgcggctgctttctcaggcgggagaagatttaatacacgtctcaccccttttgtgaacaagagcaggcactgttcagtatccttcaaagcacaggacatccaatgcaagggaagagtttgtcctctattccaaacgaaatggcatttctcaaagtaggagctaaagattatatttattttttcctccccagatgaaaatgaaaagtgaaatactccacaaaataagaagctattcacatgcacactgcctctccaacataggagcggctaggatctgaaacacctatttgaaaagggcagccaaacgaaacccttagtgtcctctgctaactccagggatttcccccccctcttttcgctgccttttagaagtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaagcgaccaaagcgccgtgccaagtgccccagggactccagcggaggctgcactagacctcgagccccagggcggggttttccgctctcccaaactcctgggacccgcacctccgctgggggtctccaaacgtgcgcgctgcgcccggggcgcaccgggcgcgcccgtggccgcgtcttgcggcctcgccctggcagcacgcttggggagcccggggcggtcgcccacctacctgctccgccacctcctccctgcggcgctccggggctgtagacggctactttattgtctcggctgcgcaccgcgcgggacctggggacccggctctgcgccagtcctgcaagtccactctgcgctgtgccttccccggcggcggctgccttcctcttcttcctcttcctctctgtccaagctccagctcagcacgtgagctacgcagcccgactcccgggctctctgggcagccagcgcctgccgcatcccccggcccgggtctgcaggtcgcccccgccaccgccgctcgccgtgcgtcctcgctttgctccacacttacagctgtgccccgggccgcctttctcgcgtccttccgtcctgcctgcctcctctcgctgtcagccggggctttcggctccctctctccccagcagcccccgcccgccgcctctccgggggctggggcggccgctgccaatgaggctcggctgatgcgctgttccggcccagtcattgtatcgggagggaaggaaggggagggggagagggaggaagggagggggcgccctcggcccccgccgcacggggctgcgggctgggctagccttccccggcagagaaagggcgccggtgccaggaggcgcggagcggtgcctgccaggaggaggggaaagagggggtcaccagcccgcgcctctccatcgctccctccgactcctccaagctctgggcggaacttgattctgcctcaccggcttcaggcatcccaggacctgagtgctgttagaataaagggtatgaggcaccggtggcagagggaggcgcagaatgcacccagccacccaagaggggctggcgaaatgactcctgagatccctgcaaatctgaaaccattgcacttgaagacagaaagaaaaaaaaaaaaaggcgagtctatcccatatcaggcatttatccctaagaacaatttttgttttattatgcgttctttacatgaaactcgggaggctcagagaggttagctcaaaatagctgatgagtgacagggcagagattccaacttgatctggtgctgagtgtaacacagcaaatgggagaggaaggagaggaaaggaggattcttcatgaacgacttcctattgagagtttttatattctcttcaaatgagctgacaaggagagaaccaaaggtgatccgacagggctgggagaaaatatttcccaaacagccttaaatgtatgtcccgtgaccagacttcacttctccatacaccgtgaattaatttttctctacacactatgaattaatttattttaaaaagcaaatccatttttaaaaataattgtctcacaactacacaatcacatagctttggatttttgttgaaaattaaattgatttatccaatatcaatattttaaagactccacagtttctgtgaccgtggttttggcctttcttcctccttctcctccaacttcccctacccgtctttctcccccttcctcccttcctttttgacaggtcaccagcctagaaaaagaatgggggcacggggcatcttgatttcacaggccctggtgtagctgctactgacatgagggagcaagtagcaagcaagatctgaagtagtaaaggttcaagatagcatgttgcggaatattgtatgtgtgcagaatgaggtttaattacatttgcttctgatgttgaatggattgtttgcttttaattaaatagaatatattgaatgaatagctaacatttattgagtggtaattacacgcccggcctccccaccctgtccccaagacttgagctaaataagcacttctcttggcatcatcttattgcgttctcctgggagaatgggagtggactgaaagccccctgtggccagggtctatgttcgccttgttcagcatcaggcacatagcaatggctattcagtgtcagttgagttaagggagccctgttttactaaggaggaacctgaggctctgagaggttagttgacctgcctgatagtatgaaactagaaagtggcagtgcctatctataaatgcaggtctggtaactcgctacccgttgcacaatacaatctattcaacaggtattggagcataaggaccccaggtaggggagtgatgcaatgaataatggtttgcccagtgctcacaaatgccacaatttctccagagagaaaataaatacatgtagcatagtcattagaaaacactacagagtgtagggcaaaatggaacaatgcaggtaaaatgcccagcttaaggctgggcatctaagaagtgtgtggcatttattatgtttggggaaaaaactggatacagactattacatgaaaatgcaatgtaagagatgtcagaaaggtttatctttattggtgagagtagtccagaagaatttccttgaagatgtgggatatttactggattttcttggagcaaaggggctttggcttaaaaatgggggctccaggtttgttctatgtgggtttgaagcccagcttttcaaaatactcagcctttctaggcttcattttctttttctgttaaacagggttaataataatgcattacttacaggggtattgtaaggattaaattagttaatatgtggaaagcatttggaatagtgcctcatgcatgataaatgcttaataaatactagctattattattaaaggacagaggctgatttctttccaaattccatcttctgaaaaataaatatttatagaataaatatttatagaataaatatttatagaataaatatttatggaatatttatggaaaacagcaaaattaaaaccacaacacaattgaacctgcaaaaactttttttcctttattttatcctaatatagaattatcaacctggctgcatattagagttctggggatgttttttctttatttgtttgtttgttttcaatactggaaacaattatattagaatctctgggggtggagtttgggcatcaggattttcttaaagctttgtaggtgaaatcattatacagtagggattggaatcaccgaaatgtccataggatgtccgtaggaactacctgaaacctactcatggactacgtatttggattctgtattatagacttggctgcaggaaccacatccagagggaaaacaacacatcctttactttttgtgtgactagtaaatacctaactctaggataggtactatgccaaaacaaacaaacaaacacacaaaaaactgcaacaaacaagataaaggaaatgaggtttgtcattcagaagctcataatttagttgttgtgatgagacaaatatacatggacaaagtgacagcaaggaggatgaagaggaaacaattctgtcttgaaatatataatttccaggtgaaaaatcagggcccacacactgctgtatatataataaaatagttttgatgcaagagggtgttagaaattccccagacccccatttcaagccctcagtcttatacagtatgaaggagtgtgacatgagattcagctattgaattaataagaacatgtatcataaatattttattttctaaatttaaagttatttttatatttatttatttatatatctgtactaagtatagatatatgcttattggagaagttgtttttttttttttgttttttaagatggggtctcactctgtcacccaggctggagtgcagtggcgccatctcagctcactgcagcctctaccttccaggttcaagcaattctctcacctcagcctccccagcagctgggattacaggggtgtgccaccttgcccagctaatttttgcatttttagtacagacagggtttcaccatgttggccagactggtctcgaactcctgatctcaggtgatcctcccaccttgtcctcctaaagtgctgggattacaggcatgagccactgcacccagccgagaagtttttgacaatataagaaatacataaagtagaaatgaaaaattatttgcaagttcactactctgaataagcatctttgacatacatagtccagacttttaaaaatgtacatgcaaacacaaaacatacaagtcatctattatattgatatgccataatttattcacccaagccaattagttatctttgatttttatttttcttttatgtacaattttaaaaccaaggttaaaaggaggtcatatcattcctacagcactatcattttcttcagagtgtttctgcctttcaaagatttcctgctggttattcaaatatgggataagagcatatataccgcttgcatattttatagctaaaggcttgtgagtgggcagacgttcattaatttgtaacaagaacccgtgctcatgttcattaagtgttttgcacatgtggtctcattttattagtgaccctgtgaagtaatcaccctttttcactccattctacacatgagaaaattaacccagacaggtgaaatgacttgctcatggtcctataactagcaagtcagtagctacaatttgatcccaggtctctttgacccagcgggaatgaaggtctagcccgccatgccaggagacacatggtacttttgttgtgaatataatgacttgggtagatctcagtgatttctggattttcaacagactaaaaaaaattgaatcacaataatattgaacatgtaaaaaaaaccatacttgttgctactcagggtcaattgttgtgttttctttctaaagcactctttagataactaagaacagccatccattgatatacttcaagatattttgctacttcttaaagcgtaccattgcagcatatatttctgtgtgagccctagatatactctgcaccttgacgacacaacacactgtaatcaacaaaaaggaggcccattatttcatacctccatgggatgttcatcatcactgatgcctcatctttctatttaagcccagggccttgagatgaaattaaagcttttttttcactaacctaaccaaggctgatgtgttttatgctcaaatgtagcacaaaattattaggtcattatctccaatctttgaatatgtaaataaacataaaataaggctttttcaaagtgtactaattatgataccctgaaattaaaacaaaataagaaaacttgaataattatgtttaaacatagacagaaagatcattggttaaatcacaggaaattgtgtttctgtggattaaaggtcaaatattggcaacttcatggggttcaacctaacatgaagctgttgctgatttagctgtgactatgaacgtgtgtcatgaggctaactgtggttgcacttgcttcccgattatggaagtaatataattgaatgagaaccttgtgatcatgcatacataactgtctttcgagggcacaccactaagcacttcttatatgtgaaaatgctttttaataatgttcttttggcacttagccagctaaaatgccttggcgagaggccggtgccacagtccagctccatcgtggatagcctgagggctggcagttcagtggaatcttaaatcagagtattcagagactatcaaatttccttccaaaaagcaaggacactccacaggaactaaaacaaatgctcttttttttttttttgtagccatgttacctaatcacaaggatcccaaactgattagagtaaataatttggtaattatattgggaaagactccttttcactggagaggttgcaaactgccatgggttttggtttgtatagtgttttctaagttgctagtgattaaaaattggagatttccacataaacatctggatttgtgtgtgggtgtgcctgagtgtatttagagggaagattccaaatgcaacctacaccatttgatgttattccattatttctaaaaatagattttaatttttagaaatttatagaaaaagtgccaattttctataaacataagtccctttaaaaattagacccccttttcataattctaggattatttcatcaaaaatgcattattttctttaaaaatgaataaaacagggaaacaaaagtcccatgaactcatcagggttttcctggcaactccagacgtgaatagaagagctcttccagtttgattgtggccttcacacagttttcttatgcctgtttcagtttaggtattctgttgactttctctaacacctttttctcttagtatcaagaaattatacaacttgaaggaatttagaaaacttttggtctgagggttacaagttcaaatgcttaggtcaggcaacaactcatgtgcagagggtcagatgtatgtcaatagggaatagtggcgactacggcaattggagagcacgtgccctgtctacaggtgcccccacccccactcagtaacaatctattgttgagacaacagtgttgccagaattgcttttcaagagaggccagaaatgtggatttttatgaatatctcttgattataaaatgttgacggctaatttgaagccatttttaaatacatacgaacaagccatttttaaataaatacaagcaaaaccatatctactggccccatatgacttaagagcctccagtttgtggctgctgatagattccaacctcttcattgcgcagatcaggaaactgaggcccagagagtgaatgtgatttgcctaagagtaaaaagtaatagtacaggaggtagaaccttgtctacttggcttctatcctagggcttttccaatacaaacatctgcttctatttgcttgctaagatttaaatgatgttcctaattacatgatttcaaacattgtacattgttaaaaaataacaatattcattggctttggagcacacaatttacaataagtggtttttcagccacatgatcacatagtctaaattgcttctaacatttataaggccaacataattctacttccattcatctactaagaaaactttattcatctctacttccctatacttcttctcccttcaactggttactaaatctggccaaatgtggagaaaaagtaaaatatttaagaagaaccaggttgactactctaccatgaataagaactaagtggggagaaaaagaaaaatacacttgtgaaccagtgactgtaaaaactaagccatgcatttaaaatgtttcagggcagtttgcttattttgccaaagcaaacaaaatacacacagtaatcttgtaagaacctgagcacacttcagcaaagaagtggagataatttttctaagagtttcggtaactgaaaacttccattatatgtctgagattgtttttattttttctttttcagaaaaatttaaaaacagaatagttcagaatagatgataacaaacttccctacagctactattcaggattgtccattgtcctttgtttttcatcggacaaaataaaaaactttacagaaaagctgaagttccctttgttccttattaccaactttattcttatttccaactccccagaagtaaccattatcatgaagtttgtatcaatccttccaaatttttgcatggatatacatacccatgaatatgatatagttttgttatttacatttttaaatgtacatacatggtatcatactatatataacgtaccagagcctgtgtgtttcatctaataacagcctatcaaaaatctatccatctgacctaaatcagatcaagtaaaaaaataagtaaataaataaataaaaattaaaaatctatccaagttgatgaatatggacctagttcattccttttagccactttatgatattttatattttatttgttcatgtcagtagatggctgctaggccattttcaatatatgagtcatttgattttaaaatatttaaagtaggaactaattttccagaaaaggttgacaatcagtattaagccagtagtttattacactatccaaagtgtaaggagaaagatattctatactttcttctagacccaggactcctggccctctagtatgtcaggcagttcattggccccattgtatggaaaatttgttatgaatgataattttctgaaaagagggttgatagctcttatgagattaaaatctatctgtgccaacccccaaaataaagaataactatttttaaatgtcttccactcaccatgggaaataatcatagtgattacttctgcagttctgctttttttccacgatttttgaatgaattgccatcttttattttggcttacaattaaattaaattcaacagttaagcaatgaaaatgcactgaatatcagtacatgggacaagtgccagtagcagggacacgaacaagtcaagaaaagccctgtgtttcactaacacaaaagtctggtgagaaaggtaatgtcaaagccaatgtagagtttctcaaaagggtggctctattgacacttttcctggataacgatttttgctgttggggctgtcctatgcatgatgggatgtttcacagcacccctggcctctgcctactagatgcagtagcctctactcacaagtcgtgacaaccaaaaatatctccaagctctctcaaatgtttcccaggaggcaaatctacccggctcagaaccactagcttaatatgatgagcaatgccaaagagaagtatgggtttcagtctgtaaaatgcttccttgaatgagcagtctgtgcaaaacagaggcataagttcatgcaggggaggaaacactgattggagtactcacagaaggatgttcttgtcttggcaatgccacaaattattttatgaccttggtcaagttattcaatctctgtacaacaggatggttggatacatctagctctaaaattctacagtatccttgacgtctgagtccttggtgaattatcagaaagggtgtgagggactaatatttggaagctgctgctattttgggaaaaataaacacagaaaagtgctctgctaagtataccatgtcatccaaagcaacctttttattagaaaacatagcttctggatacatttgccacattgcttctttttaaatgatcttgccaattgatttcctcattataaagcaatcttgtagactctattaacaggaattgctggctgtttatctctcttgcaaagttggtcttcaagaaatggggccagatttataatcaatgacattttttaagagttctttctcttagccacagaacacatacggccaacgaaagcttctctagacaactcaatcaatgtgatcttgggtgaattgtcctgaaaaatacagtaatgccagttccactaacaatatatctttgatttctgctgtgtcagtgatgatatgggcacaagttcatttgtgcctaaataaataccagaaacaggaatcattaaagcaactgcttaatagctctggcttttagttcttaatcttatcaggattccaaacggacagaaaggagatttggcactgaacattctcaaactctcccctgtggtaacttattgtatatgctgccatgctatccctgcctgaaagccatttccctcaggtctttgcttggctgactctttcttttcatttagggaccagcacaaagttcacttcttcagagagtattgccctgcccaccctgaagaaactaaccgtccacattgtctaccttaattgtttaggtttttattgactgccttcccttaccataaaataagctccatacacatcaggggcttttttgactatcgttcattgctgtatcatcagcacctgaacagaattgacacccagtagagattcactaagtacttcttggaattaaatgctgccccttccctctttgcttagctaactcctattaatcactgggacctcagttcagatagcatggcctcaggaaaatctttcctggtgatccaaggcctgttaaatcgcccaatacactctggataatagcataaatctctttctcctcttgacactttcttggttctcattcagggctgactttgtcccccagggaacatttgacaatatctggagaaatgttggtggacacaactggggaggaggagtgcagtggttactactgtcacccagtgggtagaggccagaaatactgtcatacatacgatcatgcacacaagggcctctcaacaacaaggaattatccagccccacgtgtcagtactcctgaagttgagaaaccctaccctaaacagattggcaattttatattcatttgtgtaattctttgcttaatgtctgtctcccctactagactataaaataatgactagaacttgggatttaaaatccatgaaactttatccagccactcaactattaggaccaccaggcagctcacttagctgttggctttgccagtttctagatggagttaataatgacttacattagaaatagtccaaatattagttctgtttggtaggaacaaagcacagtggatatttaacaatttaaccatgcataacgaaatccaagaagcaaaccccaaaatgcaaagagtgaagtactggagaatattcaagtattaatatacaaaatgctcaaccataggaacacatgaaagaattttgctgtggccttataagtaggacctatggctttgggtaatggcggaggagaaagtaaattgactctataaacacctgagacaaaatatatataaaaacagcaacgaggcatcccctccatctgagagaagaataaagttcaataaggaaggagatcgaatgttcatatccacctaggatgaagaaacatttgtgcactggtcataagaaagctttattagaaaatggcagctctttgataccggtaatgagaggcaaaatcttcttccccttaaactaatatttgatgggtctaaagaggatggtcttgtttatgtgttataccactaaatggatcaaaacaaagtaagtaatattcatgtgtccttaagattgcttcctaaattttcaatatgaattcaaaatatccaaggattcattgcttgattctatgcttttaatgaaaggattctgtcttaagttgctggaggcctgatgtagcatagactggcagctcttgtacttcactgaaacatgtacatcaccaagagattgtaatacatgttttgaattggatttaaagaaaaaaaagatttagttgaattctcactgcctttagagttatccacaaagacctccttactggcttcctttagggattcaaaaggcttaaaatttctgtccttcttcacaaatgcaataacgtgaagtgagagaccgtaaggaaacagatggtaaaagaaactttgtttattttctttttatttttgattttaatcttttcaagtttccaaggacttaaaacagatgtttgtgacctgcttttattttttttcaagctagtaaagaaaagctgacctcaacattctagggagaaatctgtttaatcagtagttaagatttgatctactgagttcccagataattttttaatcattcagaataaatcatgacatacacttttaaacagtcatctttactatgtgaccctcttctgaaaggaaggacatcctgtaaaaatgcacagtactagtcttgaagtagatttcaactattcactttagtgccaattgctagagaaggttctatttataacctctagaatccagatgacatcttttatcctttataactacacttaaaggaacagaaataagagttttcttttgacactcactctcccacccctggacctcaaacctctggctgtaatttcccggggatattccatttcttatcagtggttctcacccagggacaagtttgtccccacaagacatttgacaaagcctagagatatttttttcttgtcacaagtgactgggtggtgcatgtgctactgacatttagtgagtggaggccagagatgctactaaacatcgtacactgcatagggcagacatccgaaacaaaaaaaatatctggccaaatatctcaaaaatgccaaggttgagaatccctgatctatgatttttatcactagcattaacggaatcagatgtgtttgtgcttgacagacagttttcagtagagtatttttagaacaaaattagcctttactttcttatctttcaggcaagttaaaatattaatgggaaaatcaatgattccctcaattaagcctcccagcatcaagactccattattgacctttcaaattaactcttctattttgggacctgggaaaaccatataattctagctagcgaaggttccaccggaagagttatccaaggaaatccggggcttgcaccctctgtgggacttcagagaaaaggctattgattttctgtagcattttatttttaaaaaagagtgacacattggtgtgggaagtttttattctatataaaaatgccaaaataagtaagtgctgtctcagaggtatcattgagggcccaaccttcttagagctgtgctgtccctaaatgtgtgggccaaagggaaggaagcccaaggcgcctaccttgtggggttacctaataatgttctgcctactggatgtgttcaataaatgcacacaggtcagttttttttagattggattttcccagaagcacactctgagtggagaattgggttctcccatgaaaaactgctgagggaatggggtaagtaggacaggaaggggaacaaggtcaggcaaggatgtcacctcgagtcaacccccagcagcagcctgaccttcaggggagctctggagcatagactacacctcagtttactcacctggaggcaaaggagctgggtttttatactttcacaccagtctgtcagcggcttccctgggtgatgggaggatactctcaggcacttttggctttccatccagagaaggagctcaatccatcctctgaagagggtcccacaggggaggaatcagcagcagagcaagggacactggtggtcaaagggatctgagggggatctgcagtttctactgcttcatagtcttgaaatgtggcagggcacgcagtttgtggactgtaaaacattcattcattcagtcgatcattccttcaacaaatacttgttgaatttccaccgtgcgccatgaactgtgcaatgagctggagatatatggtgcacacaaagtgtgaacagcaaacgagctatggcaatctagtgctggagccaggagtgaagcctgctacaggagggacacctactcagcctgggagatatgattctggaggaggcaacagtaagtttgagaatcaaaagataagccagagttagcccagtacaaatatctagaggtagcagggcaatgaagattctcctactccttcctatggaccaaggtggacaacatcctggatgacactttgggaactaaagatagtggaagaataagaagcaaaattgtagtgttgttcaaattgtgagcccttaagcaaatgctcataggctctttcctctctggagccagagacatcattgcagtattttctgggggcaccattttttggaacttgtcccagcatgtgtaccaatgaagaccagtaagctctttgagagctgttagcttgaagggctgggactagctggcaccatgggtttcagtattattagtgtggaatattgccagaggtgagaggtcttaggcagaaataagaagacaaatagattccacctaacctgccactctcaacttaccaaatgaatggtgtttatgggcacctagcacaggagccaggtcctaaggactctctgctatggctggccagtaactctcagtcactgagtcccaaggaaggggatggagtggctgtgagcagcaggagacacagaggagttaggaacaatggctttttaccaactagtatagaagtacagtcatccttcagtatccgtggaggattccatgactccctgaggataccaaaatccacagatgctcaagtctccgatataaaatggtatagtatttgcatataatgtatgcacatccttccatatacagtatttaaaattatctttagattacttgtaataattaatacaatgtaaatgctatgcaaatagttgaatactgtgttgtttagggagaataataacaaggagaaaagtctgtgcatgttcattagggacacaacatccattttcttccccaaatatttttgatccttggttgattgaattcgttcatgtggaacccacagatatggagggccaactgtgtttcactatatttaaaatgagcaggctccatgtatcagctgaatattatgtgaatgaagggagatggatatgtttttaagttttaatttatgtagtcatttaatccatacaattatgtatgacttttccattccctgctttggatagacatggtttcagtgaatattttatttttatctgaattataagaaaagtcataagtgtaacaatcatgttacatacataacaacaacatgtacatgtagcagtagagttgcatacataacataaatgtaacaaagaggaacaatagggactggtgggaactgtggcaaactggagaagtgtgcctgacctaatgggtgcaactgctactcagctgaagccagctgggaaccatgtgggaatgcaggcccactattgccaacagttctgatttttccaggggagccagaaactccaatttttaaaagatttctctggattttgaaatgttgacagccaattcaaaaaaatttttttaacactatgtgaaccaaacaaaatatatctatgggccagatttgatttatggaccaccagtttgcaaggctcttggtctctaaaggctaaatttgtgtcggtcttactgctattccccctctctcccaccacctgttctttcaattcctagaattcccatgggctggtggactggagtagccagttccctgtagttgagaccatcctttgtttcttacagtcatagttagagctgacacaggtgccaggagacattttagctgtgtatttgaatggtggagatgattaaatctgtttatgttgacattcttgagaaggatggtcaggttggtggaggtttcacagctaagctcaagacaaggacagtcaatcatgtttatttcacaaaactggaaaacttacgtttgaagttctcaggaatggtaaagaaaaacaaagaaacaaaaacccccaagtgactgataagtagcaatctagcttgctacctaccttggtttatcaaccttctctatcagatatttctctctgaaataatgataggtcatctctgctctaggtatggggaccacaacttgcttcaaagttggcattcagagaaacaagaattgaaataaaatggaatcacatcacatgtgtgctgaatgtactcaaactcaactacgtgaccttggccaaaagagaaataccctttaatttattccttctcctttccacctttcaaactagactctggcctccactgcttcaggacaagaaaacccacagccaaattgtaaaaagaaacaaagaaattaatccttggtttttggtcttccaggagtctgagctctgttgatttaagggaaggtaatgaatcttaaagggaaattttgaatacatgtggggttttttcctcttttctgactgtaaaagcagatttcttagaagatgaaatttattgataattattgaaataagtatagtcataatagctattatttattgagtgccttctatgtgtcaagcactgagctaaacagattagtatttaacactcataaatattagcttctttaatctttccagcaattctacagttccaggcactacaattattcccattttacagatcaggagacacaggcccacatataataaccagtctaaggtcccatggctattaagtgacagagtcaagattcaaactcaattcatctgacttaaaagcttatgttctttagtgggaatattgagatttatccccttaccagtggtggtgaggattcattactagtttaataattataagaagtccttactaaaaacagtgtgccaggcaatgaacacatgatgaggtacagtcctgctaccggagtcttcagacagattgaaaaaacagagatctaaataaatgattaaagtacaaaatgagagctatgatagaggtatccccagaagaagagctctgagtttcttttctgtgtgtattgttgtcaattccagccctcagccattagaacagttggaatctcccagttaactccgcaaatttctgagtaaagaacattcactggtggctggacatagtggctcacgcatataatcccaacactttgggaggccgaggcaggtggaccacctgaggtcaggagttcaaaacaagcgcggccaacatggtgaaatcccatctctactaaaaatacaaaaattaaccaggcgtggtggcaggctcctgtggtcccagctactcaggaggctgaggcaggaaaattgcttgaacctgggaggcagaggttgcagtgagctgagatcacgccattgcactccagcctgggcgatttcgtctcaaaaaaattatatatatatatatatatatatatatatatatattcacttatatatatatattcacatatatatatattttttcattgtcaagctatacctctgtccaagtcagatagcatctactcacccttcttaattagttttcctgagcttgttaataatcttgaagtctgcaacatttaatatctaattgttctgacatcatccacagagatttcctcctggggcaggatttcctaatgtcctcacagtgcgatttatatttttgttacagagaaggctgccaagcattaggcaattgtcaaacaccaacaggctgtagggacaatggttcttctttctctttggagtccagccaatggcccaacaaaatgaagcaagcctggaaggaatgtaccatcgaagccactacagaagcataaagctaagcactgacatcttcccatgcatttcagggcattaggcttagattataccaggctaagaagatgaagattgatgtttggctgcaaaacaagaatttattactaactgctatggtctgaatgtttttgtctcctcaaatatgtcaaaatcctaaccaccaaggtgatggtattggagacagggcctttgggaggtaattagatcatgagggtagagcccttatgattgggattaatgcccatataaaagagaccccagagaactagccactccttctcaccatgtgaggacacaactaggaggtaccatctatgaaccaggaagcaagccctcaccaggcactgaatttgccagcaccttgatcttagacttcccagccttgagaaccataagaaataaatttctgctgtttataaactgcctagtcgatgatattctgttactgtaccccaaatttacactgaccaaacataaatgtaagcaaaagttatccttctatctggcatatttgctgagaatattttcttctcttgatttttacaaatactttgcaaggtagtattgcaaggaagaacagcaatgctgctatattccttggagaatatggttccctggtaagtaatatctccagaggaattgctgaagtttttggtctgttgtaaaacagtcttcataaagacctggaagcaagactgtaaaacatagaaggtaggcatgcctctgggcttctgatgacactcagtgctccatagaattaccctgttaaatctccgtgtatcttattaacatttattataatagctataatttattggcatctactctatgccaggcactgaacaatgagatttatatccattatcactaatcaaaaggtgagacacaactgacggaactcaattcatgttgtgagtctctttaagacatgcatcttcaatgggaatatcatctccaaagatgtgaaaattggtgtagggtgatagtgagggggaggacttactctttttatgtataaaacacagatatacatagagaactcaaacagacacatggtatatttgtggtattaaagttttatgtggtgaggggaagtaattaggcaaaaagtgcctaagaaggctcagtgtgtggtgataacgaaaaaaaagttgagaaacactgctttaagagatagtcaactcttaatttttttgttgaattttataatatttacttcctttttttttttttttttttttttttttttgatatggagtctcgctctgtcacccaggcttgagtgcagtggtgtgatctcggctcactgcaaactccgcctcccgggctcacaccattctcctgcctcagcctcccgtgtagctgggactacaggcacccaccaccacgcccggctaattttttttgtgtgtgtatttttagtagagacggggtttcactgtgttagccagaatggtctcgatctcctgacttcatgatccgcccacctcggcttcccaaagtgctgccaccgcttgagccaccacgccccgccataatatttactttctaatgtgagaaattttttagctattttgatgattaccaggtaaatcatgactcgaaaatttcaatttgtatagctgatttcatgtactcttgtgtaggttctttcatgttttgaaattcttaaagagtatttccttccttgggtccacaggaattttcaacagatttggggcacattccaccatgtatggagttctgcttccctaccatgtaattcatgctccctgatgctgtgctcatggataattcctacaaccactaggggaggaagatgttatggttctcctttttacagataaggaaacaaacattgtgaaaggttgagacattcatttcctcatgatcttgcagctggtttgtgtggacttgggattaaaatccagttctggaacagcctaaagtccatgcatatttgatccactattccagagttctcaaaatggtgctccatgggccagatacagtccacagacatgacttttgtgtgtgtatgtgttgttttgtttttgttaacttagtgtacttaaaatatttaaatttgctgccaatacttaaaaattaagagatctttacaggaacaagtctagatttacaacttttctttgaaagcttaggggctgtgggcttccatcctacatgggaacaattgactgaaactaaggagtggatacttttcaaaacagggtttgcacactccaatttgcctaagtccctgccccttcctactgccttacacccaaaaccccttcattcaaacgtcctatatatatgactcccagaatgtagtgtttctgtttccttcgacttccaatgttttctaaatcctgtgtgtctcttcagtatctttccttctcactcatccatgcaataattttaaagtgaattatgagtccactttaatttactactttattctttctgattttctagatctctcaagcagagcaactttatcagtgatatttaataaaatgaaaccaattttctttttcttctttcagtagccatgttatatttcacctgaaaatccttctaattcattgcttatttccttagggtctccatttctgaaattcatatgctgctaagccttaaaatattcagtctttccaagcctgtagttttgagctacactgcaagggcatatcaattttacttcacatcagagttttgattagtgattatgtaaggacttttttttccccttgaccttttatgggttaaacagagcctatgggtctatataaagctctttccttcttgaattctttccttgcaagtatctttattttgacttgtggtacttggtagattaagtgcttggaaaagaagtggtctgcctgccaattcaggaagaagaaggaaacattcaaaaacttgatcagggaggaggaggaaacactcaaggagtataatttgttggggcattccagtctgtcaacagctccatcgctatgaagacatgagaatccaagaaataaacacaaagcaaagaccacagtagataagaggaggcatttccatcctggaagcaaatgtctgtgtcctcacatggtggttttatattgttccattcgttactgtggaatgcacttttcaccgacaacatctggctctctaacaacgatgtaagtcactgaagaacacacaaacactatcacaaaactaacagctgtattttgatacatccaacctaaccctttcttttgtgtcattgctttaaacattttatttgtgtgtaaatctgcttttaaataaaaacatcatagaatatagaatttaacattttttgccccaatttattataaatgtattcattgtagtgttctctcacttattcattggatccatagttcattcatttacatattcatgcattctgcaaacatttaatgagttttttaatcttccactgtaaagcttttacaaatatacatgctagggccccaggctcagacattctgatttgtttggtctacaatgggagccagtaatcagtatttttaaaaagatttctaggtatttctactgttataaaccagtgtttaacaagaaacatggcatagagtattttttccaacagaagtgattatttgaaacattatagtggcagatttttgtattaagagttgacctgccttggcataaatgataataatatgctttgataactaataatgataacaattaacatttactgagtgccataagtactgagctaggtacttcatacttaatactttatgtaatttctacatcagccatgtaaaccagatatttttatctttgttttgtgttgaggaaaaaatattcagaaaatgtacttaacatgacacagatagaagtagtttaactattggggtttgaagtccatatttctaactccaagttatggtctttctactctgcacactcattcagaactttggttttgacatccgatattcataagcgtaactaatacttttttcatagagcatcttaggcacatgacctcattccacagtgctgttcacacagagaagttaatcatggcagagtggaggcactggggttccacagaagagagtgaagcaatgaaaaacactcagctagttctgcctagaatttgagttacaaatcctgggctttttctactgtgccatgcttctttgtttctttttcatgttctgattcagaagtttagggaggtaatgactgccttggccctctcagtgagcaatagagccggtaacactatgctttggccacagctgattggctcaaagatggacatctgtcccaggttgacccaatcacattcattctctctctttctgacttcccaccggtctctctcccaggtatttagaatcagcacttgaaaagattggtcagttctacctgaaggtgttgagcctgtatggcgatgtatatcagcaacggatgaactcacctgaggatggtttcttaggggccaggaaaacagataatggaactgatgttcatgaagcaatagagatatctggtgaaccccaaaagagagacaagcacaaagagtagctcctttgacttctgctgactctatacataccatttattcttcattgtgatgcctgatcttaattcatgcccttgggttttgtgagcaacctttgacttgatacaacaaactcctatttatttgagcaaattgagtaagtttcccatgctttaaaacaaacaacccttgactaaactaatgaccatgttttagaacgcatataaagtttatcattttgggcacccttagagtgagttacattttactcccaaataatctagttactctatcaaactggactatttagactgccagtcacagaaactgaaatcaaaccagcttaagcgaaaaagggaaatttatttggctgttgtaattgaaatatccaggccttgctttaggcacagccagatctggtgacctaaatgaggaaactgcttctctccctctctcgagaacattttcctctctgggagcttcattcgcaggcagccacctaggggaaaatatggtcaccagtgtttccttgtacgcatcctattgatttaccaatcccagtagaaagagggggcctctttccaattagtgccagggaaagatccaagcatgattttcattgactcacactgagatctcggcccatcactgaaccaatcattatggtccaagagatgaggctcctcattggctgggagtttggcatgtctccacctagagctagaaatggcatctctttcttctgaatggcaaggactgagcgaattgtggttttccaataggaaggcttggggtttattcctggaggggattctgggcaagcaaaagagagcctgttcattaacttgttaattttccaacctcctccctttttcagcagtttgctttcttatctaaataatttttaaaacctaattcattattacattctatattattattatacagatagacagagagggtctcacactgtctcccaggctaggatgcagtggcacaatcaatcagagctcactgtagccttgatctcttgggctcaagtggttctcctgccttggccccccaaagtgctgggatgacgggcacatgccaccacactggcctacattcttaatttttgttgttattttttgttcttcttaaggaattaactgatggtatcatacaggttctttgttagccttcttgtttattccacctgcttatttattttaaagtggtatattttttaaaaattatgctttaagtaagtcatactatctttgtatgaggtagttattacattcactgggaaaataattctaacatgaatccaaatataataattccagcccttgactcagtcaccaatccagattgttctaatatcctttgtggtactctttaaacttttcttacaaataccaatgcatgaatcccatgagtctataaacatcggattcacaagtaatttcaggaacccagagagaaatttggggtggggggagaacatttcatccattctttcttttaactctatggaaaactctataactttgtaaaatcatcctaattgtcaaatccaaaggacattttttcagtccttaagacgtttggaagattttgctgctctggaaatatttgttgatccacttttccttcttgaaattcttcacttggctgggcaccgtggctcacacctgttatcccagcgttttggaaggccaaggaaggagaactgcttgaggccaggaatttgagaccagtctggacaacatagtaaggctctgtctctaaaaaacagaaaaaattagctgggcctggtggtgcatgcctgtagttccaggtaaggctgaggtggcaggattgctcgcccaggagtttgaggctgcagtgagctatgattgcacaactgcacttcagcctaggcaacaacaagaccctgtctctataaaataatacaaattttaaaagttaaaaaacagaaattcattaattctttcgcttccctaaaaaaagtatgcctggttctcctacctctctgctcactcatttgctgtctcttttgtgatctctttgtccttctcttacactttctttttctttcttttatttatttattttttttttttgagatggaattttgctcttgtcacccaagctggagtgcaatggtgtgatcttggctcactgaaacctccgcctcgcaggttcaagtgattctcctgcctcagcttcccgagtagctgagattacaggtgcacaccaccacacccagctaattttcatatttttggtagagccagggtttcaccacgttggtcaggctgtctcgaactcctgacctcaggtgatccacccacctcagcctcccaaagtgctggggttacagttgtgagccaccgcgcctggccctcttacactttaattactgtggtcctccagacactgcccttggccttctgccctcctcaccttgcccacacactcactcaatccgatgttctcatccacttgcatatttccagtccacatctgcttactgatgcctcttaagactagaactcagcctgacctttcttcagagcatttcagatttatagacgcaatagctgacagacgtcatgcacgtgtccccacacatttccaaggtaacacatccataattgaccttgagatcttccccagatatccacttccactttctctctaccattgccttaacgcagatactttttatctttcaccacagcttcctccagctgtctccctggctacagtcctatttcctaagctcactcccaagctcatgtccctccatggatccctagcaccttcaggaaatattctagtccaggggtgggaaaacattttcttaaaggaccagatagtaaatagttcaggttttgtaggccaagaggcaaaatagaggatataatggaggtacttacgcaaacatgtaaaagacagctacttaaggttgggcgcggtggctcacgcctgtaatcccaacattttgggaggccaagatggctggatcacttaaaatcaggagctcaaaaccagcctggccagcatggtaaaactgtgtctctactaaaaatacaaaaaattagctgggcgtgttggtatgcacctgtaatcccagttacttgggaagctgaggcaggagaattgcttgaacctgggaggtggaggttgcagtgagccgagatcatgccactgcactccagcctgggagaaagagcaaaacgtcatctcaaaaaaaaaaaaaaaagtagctacttaaaaaggaaaaagccatttttaactcatgtacagaaaccagttgtgggccagatttggtctgtaggccctaatttgccatctcctcacaggatgcatatagtcctgcatgatccaggctctgttcttctctattctcattctcaccactcactttacacggcagcaaagctgcatggcttatggggtcatactccatgctgtttcctgcctcccagccttccttatgctgcttcctctgcctggtgtgcttcctctttccccaactcccctgctagactaactcgcacccgtttgttgttactcagctcaggaaccttttccttttggaagaattcccactctctcctgggtaacctggaggctccctcctgagctcccacaattccttgcacctattcctatcatcctcacatggtagtgcaactacctgtttcaatgtctgcatcaagtaccaaactgtgattccttgatgagcagaactggatcttagtcatcctatatcctcaggggttagcacagggattggcccaaagcacacacccagtaaatgcctattggcacttgattatggctcaatctattctttagtagaggaagagtattgtgtcataaataagttctttgaaatacctgtacagcagcttaaccgcctacagtgtcaatggcctatttctaactcagggagatctattcaattttaatagtttgaaagtcatttgtggatagctagatcctttgggtggtggatggctctaataataccaagggcacagattcaatagctatttagtagagagtgctttgctctcctgagtgaccacaggctatatctccagcccagctggctgtttttcagattcctgccatttgtcacaaagagcggtagactctagacacagacatccatcacccatggccggaaaaaaattgttcaaatcacacacctttgattagaaaatagaacacactcctgtggaaaatgaacagcatataaagagaatgtttaatatacagaatagtataaaaaacaataaatagagaagtagagaaaataattcagccatcatttcaccaacagaaggaaaccactgttaaaatgtgaacactactcttttttctataattttcatccttgctatgattctatttatgcaccttagcttccagatttctctccctattcaatattatatctagagcattcctccaggctcctatcattctttgtgttattttaaattattgcttattaatagctgatcagatggctaaactgtgacttacaccatcattgctcatttgctggaaagatttgtggcatctagaacaaaataacgtaatgtaaaagtctccctttgtcctaaccctccaattcaggttcaaatgttagtcaaatttatttcttttcatacctaaagaaggaagatagcatggagaattggaatttggactgaaacaaatgagataatttcatttctccttttgttttgtagatgagaaaactgagatgcagagaatttatgacttatcctggaggccactaccaggacaagaattttactacaaacaattcagaattctctccaagaattgtggttcagggccatgctgactcagggagagaaatgaagcaacggagattgtgactgtctttccttttcagcatatcactgacaagtatgtgctttttatatttctaattgcagaaggtcatccctgcgggttcaatggtatctcctgtattcccttctggaagcaaaccagcaagtggaaaaaaattatattctttgtacaaatggatgaaaataaacatgtatgcaaatatcttatttattcaacttatatatgggaacagaaatactcccattaaacccagctcattagtacatagattttgtcatattttaacagtgagtgaaactcacaaatgcattaaatgatcttttctgaaaagaatctttagacagagaatagcatgagtgagaaggctggagcacttgtgagcggaatgcaggattgtagcattcaagtcctatttgagaatcacaagcatagaaggaagaataaaaaatagcaactcccatatactacttgccaacataatgctcatgtttatttgtcttggccatcaggtttttctggggaacatgaccatatgcttcgctttctaggagcataagcatttctatttaatacactagctagggagcaaaagatggctttacagcatatttaattctatccttgactttgaaatgaaaatggatgtcagtttcccctaccccatcaagctgttttccaaatgttaaactcttctgtctttcatcagacctcttcctacctcatctgtcaatgtccttttatcttcacaaatattttctactcaaattagattaaaataaacttctttctgtcttacctgctgagttccccacagtaatactttcttagttcttagaaacctgtctactcagaggttagacctacaagcagaaggcctcagaagaattcccaaggaagatagcatcagtcctgttgtcctagggaggcttcatcgaaagagagagagaagtgttccactcactttccatcagcatcttttgaggaagggaggacacgatttattcattccaaataacagggattctttagctttgcaagtgcagaagccttaattcccatgacctcttgtgtaattttcccataagggagccagagagaggaggaagcattcaagaatcaagctatgataaagccaagccagcagtcctaatttattgagcatttcctgtatgccactcactgctaaatttttcacactctttatctcactcggatcttcataaaaatcttagagttaaagctattagtattgtcttcttgtacactagaagactgaaggtcagagtgattaaaacacttgtccaaattcacataggtagaaagtgacacacctagaattcaaatccagatgtcattggatctcagagcctgtgcctttagctacaacgtaatctgtcttcctaggaaagtgtccatggatgatgctggggcaagaaatggcaaccaggtgggaacttgaaacaaagagtagagtttgtgggaataagagacaaaaggaaactgcagagattacctgggaaagtggaaagtggtcgcctgagctggtgtgggtggagtgggttgaggaacataatctccaaatggccctgcccctccggctttacattggcttcactcatgctgagtgcctgctattcttaaacgatccctccattgtcgtctctgtctagattctctccagtctcatgtcacattcgctctcccacactaactcccaccatcctgtgctttgggttccttgaatatgctctgtgttctcccctttttaccaggactgttctctctgactggaatcttctttgtccttcctcccttagcctgattaacttcacctgggatgccacgttgcatcctcaggacaagtgtagatgctagaaccaggttgcctggattcagtttccgaatctacttttgctgtgtgtgtgtgaccttggctaaaggatttaacttctctgtttcctcaactaaaaggctgtcgtgaggaggaatgagttcaaacatgtgaagtgcccagcacagtgcccagcagagttcagagctcatggggcattagctatcattgttcctcatcccccaaaccttagctgaccctcatctgggaatctttcctgatcctgctgagctgaagctacgtggcactctatggggcattctgacatggcacctacatccctgccttacaaaggtctgcatcctcatccatctcttctgatggactttaagctccttgaggacaggaaccacatggatcctgttttctactgctctttattatacctccagtgaagtacttagcactggttgctctcgataaataactgtagctttgcctgccccccaagttcttacatttgatttttaattcctgatcttcagtgccaattgcagggtcaatttgctccatcaggtatcaagttcccaagaagagatctaccattcatcacttttgtttgggaaatgctgctttgggatcatttttcttgagtgttaattttgcaagcagtgtcttctaggtaacccatcatgggccattgtgacccaaaggtaacccatttggaccactatgacccaaagatccccctaaacactcatgttcttggcttacatgacctgaaggagaagaagagtcctaaaactaggcaaaggaaactgatatacatcgttcttatttaaaactttattacaggaatttcaaacatatttcaaagtaagtagattagtatcctgaattgctgtgtaccaatatcccagcttcaacaattaccaactcagccaatcttgttttatctatatcttcattgacttatccccttctatcattttggtgcaaattatgtttaatgtgtcatttatttctttataattgatgacattgaggtttggaaaggtcaagtaattttggaaaagttaaggtcctcagtaatttccattgattcattcactcaaacaaacatgtgtgtatctatgtgtcaggcactggcaagtgaaaagtagtgaaccagatgtacagaatctctgctttcatgtcttcttggggtagaaagatgactggatcagatgagaaatagttgaacaaatataatgaaggagaaaattttagataatgagtaagtgctgagaggacaacaaaagagagaatgcatagagattgaggtttgggtggtgctatggcttgcatgtatcccctccaaaagcatattttggaaacttaatgcccaatgcaaatagtgttgggaggtggggcctaatgggtagtgtttaggttgtgagggttccagcctcataaatggattcatgcggattataaaagagcttgaggttgtatcttcttttctctctctctggccttcaccatgggatgacacagcaagaagaccctcacaggatgtggtcacttgattttggacttcccggcctccacaaatgtgagccaaataaattactcttctttataaattacccagtcttaggtactctgctatagcagaacaaacaggactaagacaagtggtaagggaaggtctctcagaagagggggcatttgagctgagctctcaataaagacaagtgagccatgagaagattttaaagcaggaaatttcagacaaagggaacaagtgcagagattccaaggtgggaatcagctagaatatctgagaaaaaaagaagaaccaagtggctgaaatgtgctaaatgataattttcaaaaaaggataaaatcatgactcatgcagatttaacataaacacttgttaaggaattaatttaatttaatttattcatcagtgagagatcatagcagatgttataaatgtttcaaaagagaagtcacaacagcacaaatttatatggagttaaggaatattcaagtgaatgtgtaaacagagacaaaactagtttcttcaggtgtggtggaaagcccattgaatttctaaagaacagtatacatttgcatatctagaggcaagagttatttggcattgccaaattacagagctgtaaaatagctttcatataatctgaatctacctgattcagattctatgaatgtcttctagagtctagatattgtatagtgctcatggaagcacaaattattccctccaatctgattgagaaggataataataggagatgagatagatgtagttagggcccagatcctacatgggctccagacccccttaagaactttcaattttgtttgaagtttccaggaaaccataggaggactttaaagccaaagagaggcaccctcttcttcacccattggacaaggtccactttggctgctgggtgaagatcaaactgctgtgggggatggatttaatcaatgactaaattgtattattaacatataattttcaaaaaagggtaaaatcctgatgctcatacaaatatttaaagaaagcacttgttaaagattttattgaattcattaatcactgaggaaactggcagttgacccagtgagaggcaaggatggcttgcaggtagcagtgaagatagagagaagagggattcaggatcacttgtagagttagagctgaaagaactggttcttgttttacctagagtcttgttgctaactgatacgcagaaagaaacaaaccttgaacctccagaactggaaaaagtgggtaaggaagagaagaccttagccttgtaaagagggtcaggtgaattagcaagaaaaagcagagctagaggctgcaggcacctagttttgagaaagggagtgaaacagaaggcaaacgacactgaggcctgaaatctgcaccaagttaactgtacaatgtgccattgtggctggtaataatccttgcctatactgaactgctagtctggaaatgccctcacacttagtgtgaatagtgaatttggatctgcaggggaaatgggacaagaaggtacctgcctgtaagagaaaggggttatagcagaggttacaatcctcaagggttcaccggtaggtggaaatacagcccctcactccttgctcatcactacatcaccccgtgatccaataatttacccaatataagtggcaggagaaggccaattatgggagtcttgtttgggggctgcctgaagggacttcttccattacgattactgtgaccttgtttgatagatgtgaaaatcaagtcctaaaaaggctaaaagagctgccgaatgccacaaagaagtggcgttgtcactggaaaccagagtctcactcaacagtactcgtctcactgcactgtacagccctagttctaccatgccaattcgttcagaacaagatcagactcaactttctgtatcagcactatccaaaagcacttgctgcaatgatagaaatgtataattatgctgtctgatacattagctgatagccacatgtagcaattgagtacttgaaatatattactgagactgaggaactgaatttttaatttaatttaaatgtaaatagacacatgtggctggctaatagctactctctaggaccatgaagttttctaccacagcaaactgtacatttcttaatagggcttcattgtggacatttgtcaattcatttttgcttgaacacctttcctaggtttcagctcctggccttgaacagtcctcccacctcagcctgccaagtagctgggattacaggcctgagccaccatacctggcaacaagagtatgttcttttattattattattattattattattattattatactttaagttctagggtacatgtgcacaacgttcaggtttgttacatatgtatacatgtgccatgttggtgtgctgcacccattaactcatcatttacattaggtatatctcctaatgctatccctcccccctccccccaccccacaacaggccacagtgtgtgatgttccccttcctgtgtccaagtgttctcattgttcaattcccacctatgagtgagaacatgcggtgtttggttttttgtccttgtgatagtttgctgagagtgatggtttccagcttcatccatgtccctacaaaggacatgaacccatccttctttatggctgcatagtattccatggtgtatatgtgccacattttcttaatccagtctatcattgatggacatttgagttggttccaagtctttgctattgtgaatagtgccgcaataaacatacgtgtgcatgtgtctttataggagcatgatttataatcctttgggtatatacccaataataggatggctgggtcaaatggtatttctagttctagatccttgaggaatcgccacactgtcttccacaatggttgaactagtttacattcccaccaacagtgtaaaagtgttcctatttctccacatcctctccagcacctgttgtttcctgactttaacgatcgccattctaactggtgtgagatgatatctcatagtggttttgatttgcatttctctgatggccagtgatgatgagcattttttcatgtgtctgttggctgcataaatgtcctcttttcagaagtgtctgttcatatcctttgcccactttttgatggggttgtttgtttgtttcttgtaaatttgtttgagttctttatagattctggttattagccctttgtcagatgagtagatcgcaaaaattttctcccattctgtaggttgcctgttcactctgatggtagtttcttttgctgtgcagaagctctttagtttaattagatcccatttgtcaattttggcttctgttgccattgcttttggtgttttagacatgaagtccttgctcatgcctatgtcctgaatggtattgcctaggttttcttctagggtttttatggttttaggtctaacatataagtctttaatccatcttgaattaatttttgtataaagtgtaaggaagagatccagtttcagctttctacatatggctagccagttttcccagcaccatttattaaatagggaatcctttcctcatttcttgtttttgtcaggtttgtcaaagatcagatggttttagatgtgtgatattatttctgagggctctgttctgttccattggtctatatctctgttttggtaccagtaccatgctgttttggttactgtagccttgtagtatagtttgaagtcaggtagcatgatgcctccagctgtgttcttttggcttaggattgacttggcaatgcgggatcttttttggttccatatgaactttaaagtagttttttccaattctgtgaagaaagtcattggtagcttgatggggatggctttgaatctataaattaccttgggcagtatggccattttcacgatattgattcttcctacccatgagcatggaatgttcttccatttctttgtatcctcttttatttcactgagcagtggtttgtagttctccttgaagaggtccttcacgtcccttgtaagttggattcctagatattttattctctttgaggcaattgtgaatgggagttcactcatgatttggctgtctgtctgttattgttgtgtaagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgatttctctggccagaacttccaacactatgttgaataggagtggtgagagagggcatccctgtcttgtgccagttgtcaaagggaatgcttccagtttttgcccattcagtatgatattggctgtgggtttgtcatagatagctcttattattttgagatatgtcccatcaatacctaatttatagagagtttttagcatgaagggttgttgaattttgtcaaaggccttttctgcatctattgagataatcatgtggtttttgtctttggttctgtttatatgctggattatgtttattgatttgcatatattgaaccagccttgcatcccagggatgaagcccacttgatcacggtggataagcttcttgatgttctgctggatttggtttgccagtattttactgaggatttttgcatcaatgttcatcaaggatattggtctaaaattctcttttttggttgtgtctctgcccggctttggtatcaggatgatgctggcctcataaaatgagtgagggaggattccctctttttctattgattggaatagtttcagaaggaatggtaccagttcctccttgtacctctgttagaattcggctgtgaatccctctggtcctggactctttttggttagtaagctattgattattgccacaatttcagagcctgttattggtctattcagagattcaacttctacctggtttagtcttgggagggtgtatgcgtccaggaatttatccatttcttctagatgttctagtttatgtgtgtagtagtgtttatagtattctctgatggtagtttgtatttcagagggatcggtggtgatatcccctttatcattttttattgcatctatttgattttctctcttttcttctttattagtcttgctagtggtctatcaattttgttgatcttttcaaaaaaccagctccaggattcattgattttttgaagggtttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccgtctacccactgctttaaatgtgtcccagaggttctggtatgttgtgtctttgttctcgttggtttcaaagaacatctttatttctgccttcatttcgccctgcttcggctcacgctcagtgggctgcacccactgtactgcacccactgtccaacaagccccagtgagattaacccggtaccccagttggaaatgcagaaatcacccatcttctgcgtccctcacgctgggagctgtagactggatctgttcctatttggccatcttggaaccgcccccaggagtatgttctacaatagctacaagtagctaaaatttctagtatgcttattttacactagccaataggctaagccctctgtgtatattatcttaattaagttttataatgattcagttttgtttttctctttattttataggtaagaaaactgcagcttaataaaatctagtgtgttgcactgggtcacgtagttaataaagagtggtggcaggatttgagtgtaattctctttggctccaaaccccatgcgtggttctgttcaaactatttcactgcttttaatatgcagaatcttcctgagagaggtgggagaaataaactagatttctgccccaaaatagacccaaggacaaaaaacaaacaaaaaaaccccaaacatacttttcttcaagtcggtagtttaacacttacaattgaatagttccatcttcctatgaattttttttcaaaattctgagacccaactcacttttccctacaattcctttgttgcaaattgttttaggattctcacttaactgtcacaacaaagctttgtagtaataaaattgcttcagctaattttttattttattttttgagacagagtctcgctctgtcacccaggctggagtgcagtggcactatctcggctcactgctgcctccacctcctgggttcaagtgattctcctgactcagcctcccgagtagttgggactacagatgcccgccaccacggctggctatttttgcattttcggtagagatagagtttcatcatgttgaccagcctggtctcaaactcctgatttcaggtgatccaccagccttggcctcccaaattgttgggattacaggcatgacccaccgcaccctgccagctgtttttaatgaaattttcttaatttatgttttaaatgttggtgtaatacaacaaataaaagccttcatttcctctcctaacatcaattgcttctcccacaggaaacaccaaaatagctaggtatgtttatctctagacattgatacatttataaacagatgtacattctatatagagtttttaatcatttgatttatacagatggaattatagtatgcctactgctctgttccttcacttgttcttttatctcatcatggatatctttccacggtggtatatatacagccatctcattctttttaacaacccaggttattttgcaaagcagaatttaaatggtcattataatatatcatattctccttttcccctgctggctaagcactcacaccaggctcataaaaagaatgctgggtctgaagttctttaaaatgagcactagtctatttccccttctgatataactgttggaaagtgatttttctcttgcttatatttcattctctggagtgtttcatttgttcctgcctggagctaatcttcagtgtaaaggaagcttttttgccacccattattccatttaaaaacaaacaaacaacaacaacaaaaaaaacaattgggtttcccaaaaggatagaccagcaatgtcttctaacaaactccttcaaaatgatcctgtctgcaaccacatttgtcaataagagaattataaggggaatggagaatttaatatgcgttgggacctcccctccttccagttttgtgtgtgtaggagactgtaatgaagaagccgattagtatttaatgccctaatctgtacaatgctctccttgatagagctttaattatttagaaggtcttgaaggcagccaatgtacttaatacactgcacagggaaacgtgcaaatcacccgagtaagggaaattgcaagtcagaggaaaatggtcagctcccagtcagagctgaccaagtcctccacaacaagactcgatttccagctggatcatttcactaggcagcagcactgaagcttttagcttgtatgtgcaaagggctttaaaaagtcatgtacatcctaagcatttaattttaaaggtccccatgggagggtggcctctgtgagcttgactaaactgaaatgttttggttcaacaaggaagagagacaatggggagggatcagaatccaagcttttggaaagccctccaggttttgtcttcagggaccaaactggctgaggctttctgtcacggttccagaatgaataacgcacacaactaattaagagtagtcttgaataattaacatctgtgcaaccagacagctttgcctcgggaccattaagaagcaaatccaaaagtgaatggtacacagtcagcaatggtttctgcaggagatatgcaccccccacctcaagacacaattctgagaagcatttcatgaggttcttcaaaaggtcccaggggacctgcaatggtcacccagagcagcagcaggtgacccccactgggctttacagtgtccctgtctcctactatgtctctctcccgtctctcactccctaggatcacttcccacataaatcacttacacacacacacacacacacacacacacacacacacacacacacactgaatggcacggtttggaagcagatgatgcttgacagattctgcttggaaggaggtaggggagaggaggtggcatagaggagggaaaagatctccataattgatatcaacagagttgaaattaaagttgggatagagcaaaacagaatgaatgaattcaggctaaagatccactgtaatataaatcttctacttatcagattagattaattagaatgatgtacagttcaacacagacttaatttttatgtcatcctgttttatctcccctttgtttcaaaattagccatacttttttgcttacacagaaacatacataaaatataaaacaaatatgtaaatataaaatatatataatatatgaaaataatgctacaatatatatttctgcttaagtgtgaaaagataacaaggagttggtgtctgtggtttcctctgatgtcaaagtcagaaaatgggtcccctacagataaaacttaaaagaggctcatttttgtattacaaactcttttgtatatgttcaattttgtatcatatgcatacattacctaagcaaaaaagaaagttcattttaaaaacatgcttttggcagtaataatctaggattcctcctcttccagccccctccttagcaatagtttggtgtatatccttctaaatcaatggttctcaacctggctgtgtactgaaatttgtgtgtgagaatgtgtaatgtgtgtttgcgtataagtatatacattatgtatgatcaatatatagttgtatgttgtttgctggtctttttttttttttttacttcttttggttacacagtaatcaattttaggtttgattcttgctgagtcttatcgctgattctaaatttgccctttccatagtaatgcataacaggataaatatattttcatatatatataatatatttatctctctttacatatatatgtgtgtttatgtatatgtatgtgagtgtgtgtgtgtgtgtatatatatatatataaatagtaaatagtttacattgtttcaaactaatacaagccaaagaaaggtattttatttgagaatactgagatgtctcatggaagttaaagttagctgctaaaataaacaccaaattcacaatgacctgacaaaggaaatgtttgtttgtcactcatttcacaggttagttgagtctttgccaggtgaccttccacaaagtgattcaggaacttagacttattctagctaatggctccactgagccttgaatcttctgctggatcctgttccctggccagtcaatgaacacagagagagaatgagctgggtagggcttgtggaagaattaaggtaccccgtctggaagcagcacatcacttctgtccatagtccatcagctgggactcagtcacatggcattactcaactgcaggggaggctggcaatgtggtatagcaatgtgcccagggagaagaggagagcttgggtactggcaagttccagaagcccatcataagcaggaagtgtgggctggcctaaacaaacacacggccaatgcttaacaaccccagcaactgggccttctctcatcctctctctctggtactgcatcatgtgtctttgcttctccctgaacaactaaatacatcattcttctctcccctcccctctttctcttcctctacctctccaggtacacttaagagaatgtctgcggtttgtctgccagacagtgtctactctcaaaataattatctaattttagtacttctgacaccacctaagggttcagtttgcaatgagagcctgttagggatttggacttggtgggggaacgcttctttgaggagtaacacttaagctgaaatctgatgaatgaggtgggagaaaggggaggggtcagggtggggcgagacaggcgaatgatggagaaccccaggcagaggaaacagaattctttacactggttgccaaggagaggtaaatggtgtcacccaggcagtatgtgatggggtctacggcaaacagaaacttgttgaccatcatgagaattttctgttctttccctcatgacaaggaaaattaatctcttttctttaaatatttattttttagaatagggaccactctagctcttaggctttttcttaaaaaaattgctagggtagcataattgatggggcagagtggttttggctactgtagtcatagggattggactatacctgtttggctatagtcataggaattggaaaacctggtcatgaccaggctatgtgataatgtatgataaccacatagccccctcttcttcagattagcttatccatgccatcaggaatgttaaatgaagtcacttagagttaaaagtctggaaatttttttatcatgtataattgccggaaaattgataaatgcagcaattatcaggcaaagattgagctgaaacatgcctattaaaaggatgctaagatttagtttatagtgtgttttatatagctagctcctcattggttgaaacattagtggcattgaatctctgtgcaacaatcactacaactcatatttatttattgtggatggaaagtcagtgggcagaaatgtgttgttaatgatgcgttggcatggcatttctgaaattatgaaacatagcctgaaatattaaaatatcctcttatcaagtgcaaagttaaatttaaaaaaattgttctactacatgagtgtcaatttcttcatactgatagaaatagtacagacttagtacaaaactaaagtgaaatgctatccaggactaaataaaccctaactaacttttagactatttgggcaagtatgcaataagaaaaatagacataattatcaatattttacagacgggaactgaattaactataaatatcttacaaaataaaagagctttaaattatcatgaaaattatgttgtaatagtcttgctctttgctctctgacaataattttttatgtgaaatcctaactgtagtgtttactaggtatatgaccttaggtaatttatttaatctttctgagcctcagttttgtcatctgtaaagtgtatatcttaattaggacagattctataaacttgttttgaagattaattgagatactttatctaaagcacttagcataattcctagcacttaatataagtcagtactcaataaaaagtagttattatctatagtagaattttactacaaaccttcggaaacacagcttccaagtgttcactcaataaaatatagttttgaaataccactagatatttggaggtagatacacaaagaaatacaaatgttattgtccctacctttgaaaatttatagtgcttttgtagggaataagactaagtgaggttaaataccctatgaggaaataggggattaatgataaactgatgtcatagacctgtgtttcttgattttagactttgtttaaagaaaagtgttatatcaggcactcagggttaacttaaattatttttactgtaatgctatttacatatagtatgcacaaagacaaatgcatgttataaactccttcttgctctaaggtacctatgaaacaaaagaaaataaagaaattaaatacaagctacaaaatcattaaaattcaaatatacagcatttatttaacatttttaataatgttgtttcctgaaaccaaatggtgttttagagatttttggtttgggaggtggggaggtagcaggtgtcagacagggctttctggtaaaggtggaatttaagatagcaaaggtgaagaggaataatatgtgcaagttctccttaggaagtaagttggctgcctggcaacctgagtaggtggtttgttagataattttgatgaaaggaaggaaaaaattaagataagtgaaagttgcaaagttaagaaaatttcttacaaactaggggatatctgtgcttgtttaaagatacaaagaaggaaacaactgaggaaaagccaggaggggagagtgtgtcagtatcactgtagtgctgatcttctcatctatcctgccccttctccttctctttcctcccttgacaaactccttctaccctactccaccttcttcactgtgattggtctacagaggggtctatgagcttagtttagccaatcaggttgtttctcctgagattttgaaactggagcagtgaaccagtattaaaaggaatctgacattgtcatcttatggtgccatcccagaggaaagaaccacagcttctactgccaaggtctttaccaggtcttgatttttcaactcttttgggtaaatcagtctttgcctagcttagccagaatcacattaaatgcaaccaaaagagcattaactgatacataagaagggggctgtacatgttgatataaagacccacactttttgggttgggggcactaagggaagcataaaggataagtgttagtcacagatagacaggcagatgaaggggttcagattaaatgacctcaagcttctcaacaaagtaagaagttggattgtctgccaagcataaggtggtggaatgtgattataaaaagtgtttaacatttgaagacattttaatcttcttagcttatggtacagaatctatgtagtgcgtgatctgacactgttaagaaggtgtttgactaaactaattgctagtcactggaatttagggttagaagaaggaagaagttggatcttatgtgtgtcagggaatgggtagagacaatcttaaacagtgtggtaacagagctaagcattatctggagaaaaggtgagggcagaaggcccccctgcagtagcccaaccaaagagagaatttgataagttttgaaacagctagggaataccaagtgttgcaggagtgagggaaatggggaaatactggtctgagagtacaaatatgcagttaaagatgaataggttctggattctaatgtacagcatggtgactggttaataatttgttgtgtacttcaaatttgctacaagggtagatcttgagtattcttgccacacaaaaaagtaactatgtgaggtcatgaatgtgttaattggcttgattgtggtaataactgcacaatgtttactgatatcaaagcatcatgtcatacatacatacaccttaaacatatacaattgttatatttcatataccttaataaaactgaggaaaaggaataattaatgaatggagatttattctgtgtttttgctgagtggtatgtgattaaatttccctccacagtctttcctagaaaagcttctataagtgtcccaccatgcttttctgcttggagtcagtagccatttatttgtgcagggaaagcaaggaaggatagagtaaaagaggtggacaagatgcaactctcatagggttacgcaaccaatttcttgggaaccaacaagagacaataaaatgttttcaagtaagaatctgcaatagaaaaagttgttagtgtccaaggacttgctctgacaattctgttttgaggaacctgcaatcaacagacaagatgcatacaaaaatggagatggtataaaagaataaggaggtcaattaaatcctttttccaaaaaacaactataaagttggacaaaattgtcaaaaacaatcattttggggctctagaaatcaaccaaatagaaaaaacaaatggagaatcatatattcgtgaaagactgcacaatttcaggtaagaactgtaggagtctatggttttcttgcctatagccacccccacaccacaccctaagttgctcagtacagtagttttatcagacagaattaaccatgaaaactagtagctttgttggtggaggatgctaacttgatttagaacagagaatggaaaacctgttcccaatggcaaaggagataagcttacagctctctgaggctgattgtggtcctgattgggatgagtggtagatcaaaagattaataagaactttatagggagatgagttagctattgaaaagcttaataagcattccacaagtccctgattttgtggtagcctatgtatttgtaaaattgataaccaagagagctcagtagaaaggaaatacttgagcagacttgaaaaatgcccaaattttgaatgctttcctgaaactatcacattaccaccagctgagagtgggagccttatgggctcaaggtgtttgagcacaagcaccaaccaatcattggttgaccactagtctatatagatacacactaaaacataaaagttaaagaaaaactgagaaaagacatcacaggctgcaaattggggtgacagtctggttctgtagattaagtacagttaagttacttaaaacaacaataaataaaaaaacaaataaatatcacttgaggaaaaaatgctataaaatgttatctaaaatatccagttttcaataaaaaattataagagctggaaaaccaggagagtgggatctatattcaaggaaaaaaactagtcagtagaaactgcttctgtgtggacccacatgttggatttaacagaaaagacttcaaagaagctattataaatatattcaagtaattgggaaaaaaaacatgtttaaagaacaataacaacaaaacatgatggccatgactgaacaaatagggaatattaataaagaaatagaatttattaaaaagagccaaatgaaaatactaaagttgaaaaatacaagaatcaaaatgaatatttcactagatgggctagttattagtagaactgagatgacaaaagaatcagtgaacttgaagatagatcaatgaaactgattcaatatgaaggatacaaagaaaaaaacattagagaaaaaattaaaaacagtactaccatatgaactagcaattccacttctgagtatatgtccaaaggtaatgaaatcaatatgtcaaagagatatctgcacccccatgcccattatagctttattcacaatagccaagacatagaatcaacctaagagtccatcaacagatgaatgaagaaaatgtgttatatatacacagtggaattctggaagtatgtatatatgtatgagtatgatctcacttataggtggaaaataaagtcaaactcttagaagcagagagtagaatagtggttaccagaggcagggagcagtgagaggatgtgctattctgaagatgttgattaaaggttacatagtttcagttagacaaaacaataagttcaggagatctattgtacaatgtggtgactataattaataataatgtatcatatacttgaaaattgccaagagtgtagataagagaatagaatctagccacaaataaaaataattacactccatgatcaagtggaatttactataggaatgcaaggttggtttaacattagagtgcagtatggggtctgccaccagcttgattcagcttgatgaaaacattagctatcagtgttcttgatggcaagcaagagtaaccagttctgatgtacttaggcaaagaagaaaatcactggagagataggtaactcactgaattaatagggcagaatcagatacaggaaacaggctcaaaaccccagggaggccaggcgtggtggctcatgcctgaaatcccagcactttgggaggctgaggcaggtggatcatgaggtcaagagatggagaccatcctggccaacttggtgaaaccctgtctctactaaaaatacaaaaattagctgggcatggtggtgcacatctgttgtcccagctacttgggaggtcgaggtaggagaatggcttgaacccaggagatggacgttacagtgagctgagaccgcaccactgcattgcagcctggtgactgagcaagactccatctcaaaaaaaaaaaaaaaaaaaaaaacaaaaaaaccctcaaggggatgtgtggccagaactgcagtcaaaattaggctacaggatcaatttgagtagcctgctgcttgtgcctctactgatgttaaaactgacttagatccccaagtgcctaaattctgctgctgctttcgtaagagtcagtattaactgtcacattactggctcctgagtcaaatgccagagagggagctgttgactggttgcgattaggtcaatggactttgctccagccattgcagcagtgtgaagccattgaagagtgtgaagacagaaattctcaagactttgagctaaaaacattgaggcaacagaagccatgctttcaagtttgaaaaatgcaaaagaaagaagcatcttcccccacttatacaccaaacaggctattggaattattaggaaaataacggccattttatttaaaaagttgaaagcattacactctgtgcccttccctcaccttcttccttccagggaagattgagcaattctgtgaaatagcatttcacctatatatttctagggtcacaaagacaatttaaacaaaatggtttacaaagatgtactctactcctttggggctagttttgtatgacaatactcaccacataagttcttgagacattaatgtttactgctttactgctgaagagaagtatggtgctgaattcaatttttgctattttatacttagtctttttccactttcccactctccccacacccagatccttttaggatttatacattattgaaacagaaagtcttctaggatgattaaatttttcactgataaccctgaatggtggtgacccctttcacagctatacacagagtgttttgtacagtttgttttgtttcagctatagaaagtttactcaattatcttttccaggattacttccatttaaaatattctggctctttcctttggagtacctattaatgattaggtacaatttccattccaaatctattgaattgtcttattgtctttgtcctttactgctgagactgaaagaacatctcaacttcatcttctacatcagtgatttaattctcaatagtgactatttgtctcttttttatcctatataaaaattttaatcctgccattgcaattttgattttcctattatcactccttagcccatcaatctcattttcattccattttattttcatttcactttgattcccttatggcagccttttttgtcatatagaggtcatatctttttgtattcaattatggacatcaagcgtttttctgattttcccctgtttttgtgcataatcatttttggaagatagctctgaatctttagggtaatactttttttcctttttatgccatatttcttcacagattcctgttggattccccccaccccattcattcatatagaagaatgagagtccatctaatctcttgtttgttaaccatgtttgcaccaacatggtgcaagaattgacaattaattcatactttgtcctcttggttgcatgtgctattcattaatgagtgttttaaaggaggctatttttatgtgtgaagcagtcaaaaaaaaaaacaactaacctaagagataaccttggaaaataatgtcgggtgtatagttcccatctttattctcaagatcttgcataaattcattgagtgcagctctgttgatctgttgtgatcttactctattaccactaggtagtattttatgaaatacatgaaaaatctacaatttccagcaagtaccagaggcatgtcctttgtcttctcttgttattcctctcagcttcctgtccatttgatttctgggagctttggtctcttattagatgtaacaaaagagagaacggcctggggtgggagggagtgaaaatgaatggaaggaagacagcaccatgacgacttcaaaaataaacacctgtagtataggggacatatgtgtgatttacaagtaagtctaatctggtattttggaggggtctgacagataaaggctcttccacttcctattaattaggcattacagtcagcagaaaggtatgcaacatattagctctaggttgaccatcagccctagtttggcttatagctctggggtttcaccatgtatcatggcttcctatgtattctaatggaaagtgtgagagtgtgcatcaaaagctgctaatcagatgctattctaaaccagaagccacaggggaaaactgtaaatgagcactcacccaaatgatgatgaatgtcaagttagtggagtctgaaagcaggagatcttatttattgtataaaagcagaaaaatgatcttttctaattaaacaagggtctcagcttcacagtgtttattgttagagaaaaactaaaattcgatctatgatggtgcttttaaaatgaaagaaacctcatttttgatttgtattttactatgctgcagctctcctataaattagaaatgatcatgacactgtgagaatttattaacaccataaatatggtgagattattttataatagtgttactcagttctcctctataaatgcttatcttcaataattctgattctctagaggagaaaaagcctgactctagcacctcacactttaatgaatttatggtacatatatttttaagatggtcaacatttctttcttttccctatgaaagcatataataaagtcataaactgttcttaatcacatagtgtcttttttatagtcaaatgttgcatttcacagattagtgtccaattttctttgaacctttcatgattttaacagaaacaccatttttaaatgcttattttaaagtcagcagacataaacaggtcctgtgacaggcaaaaagacactttttttctgggattatgtgaaagtgactgggttgcacatgctattaacatatgaggtttttaaaggaggctcttttttatgtaagaaggagtctcaaaaaagtacacagtaccattgtgaaaataacagcctttacacttgtcaagggaaataaagaggcatcaggctgctatttttcaaattatgcaggattgatttagtgtagactgccaccgaacattcttcataaacctgctatgttaaaatgtaaattcttaattcaataattttcctccaagctcctcccacccttgctttgtctttatttctccaattctttgtaggagattagaggacacattattcgtgggtcgggaggaattcaatgaatcatgaagaaaagataatttataaaggcaagtcactatctcatgttcaatatgcgtaaataataatgatgtattgtcatgatacaatgatctgttttctatttacagctcttgtcctgggaaaaattaagtgccacataatttccatgtaaaaagatcaatttatgagccacttgtctatcagaggtgagcatcatttggaagcaatgagtatgccagtgaattgcattgtttctttcttttggaaacaatacaagctcaaactgttgacatccactcctgctctttgacaaaaaagagcaaatggtttcaagagtgaacactaagttatttatggcaaagcacagttgtttttggccacagtatgttggtttggctttataatgtttctaaaaaggtatatatacatttgtccaaagtgtatatgtctaaaattatgtgatgccagtggcacaactgatgacactgatgacatggtttttatttaatgttttataaagcaatttgcttctgggtacttttagaagctacagcatcagtgttgtctagttaacttttttggttgaatcttttgtcaactaagccaaggaaggttttttaaattgaggtataatatgcatacagcaacatgcacaaattctaagcagatagcttggtgaatgtttacatatatctatggccattgtaacaactaaccagatcaagatacaagcatttccagccactcagaaggctccttcacacctctgcccaagatgtgaccaatactttaattactttcactaaataatcatctttcttatatctgaacttataaatggaatttacaatatgaactcttatgtctaccttcccatagaagccagtcataagaatgatttcactcaattattctttggattaggctaaattgctagtttctctggttttttagaggtccaatagcagtgtcattttagaaataacaattgccttttcctcataaggttttgggtggagttttgtcctctttggagaaggaacattcattcacttatttatttattcgttcatttacagaatatgtattaagcatctaccacgtgccatgggaagtgctggtgtaaccaggaagatgaagaaaaaaatgcacatggtaaccaaccccaggggtttacagtccaatgagggagaccgacaaaacaccaagcaaatgtagaagtggtggtcagtgacttcaagtaaaagtaaaggagatggatgtgatgaaagacagtaacagaagttatatttcagacaggttgttcagggagggcctctgaggaagtgatatttcagtggaagcctggagggtgagaagatgatgggtaggtggagagttgggagaagaacaatcaaagccaaaggaacagcgtgggcacgcctgaggctgaagagcacccgcatggagaaacccaaaaggctgatgtgcccactggatagtgaaggagggagaagaaggtgtgagatgaaattggagaatggggaaaggcagtaacctaaaggactgcccacagtttgtacttgaaaacttcacattgatttcaatcctgaacgtcttgtgatctggagttcccattggatttttggttataatgagtcagtgcatcaagagtaccttgaggccgttactggggtgggccttaaatgagcacacagagatgctatacacatagtgagtatgtatgtatagagacgggatctcattctgttgtccaggcttgagtacagtggtgcaatcatagctcactgcagcctccatctcctgggctcatgcagctctcctgccttaacctctcaagtagctgggactacaggcatgtgccaccattcttggctcgtttttttttttattttttgtagagatgggggtctcactatgatgcccaggctggtctcaaactcctgggttcaagtgatccttccactcccaaagtgttgagattgcaggcaagagccactatgcctagttccaaaattgagtattatgactcttattttgaggtatctaagagaagaattgaagaaaaatgatttcagacccaagtcagggccatcacactgggatggaatttaggaattctgataccaattcaaactctaggatatcaatttaggtccaagtactttttattttgaagtagtggccagacaagtattttattactgaccttgtttggaattgtcagagcatggtcctaaaaaaaaaaaaaaaaaaaaaaaaaaaggtagaaagacttgggttgattttactattgtttcaaaattctctgcagaaaatgcaccctttattgcgtatatccaggcttcatgtacttactttgatacatctatcttctgaaacattgattttgggaaattgttattttagccatgaaagtagtttaaaatttagaggctgaggagaaagaacgctttattatcccaaattcacaaattctggaatttcatggtaaaatatataattaaatataaaggaaaattataaattctcactaaaatcaaattgaatactcattccacttctcatgagatggtaatgaggtggtataatgttggtgtaaaatatttataaaaattaattgtgctagataaaaagtttcactgctagtactatggtgttttgaaccatatggtattgcttagagcagcggttctcaaactttttggtctcaggactcctttacactctaatattgagaaccccctccaaagggcttgccatagaaaattctggaaattggccaggtgcagtggcttacgcttgtaatcccagcactttggaaggccaagctgggtggatcgctagaggccagaagtgcaagaccagcctgagcaacatagcaactcccatctttactaaaaataaaaaattagctgggcatggtggcacacatctgtagtctcagctactggagaggcatgagaattccatgaacctgggaggtggaggctgcagtgagttgagattgcaccactgcactccagcctgggtgacagagcaagactttctcaaaaaaaaataaaataaaattcagaaattacgatctcatattccattagtcatacagaagctcacagtccattagacatcagagaaatgacatcatcacgcttcatgaagcctctggaaaactccactgtactccataagagcatgagaatagaagaggcaaataatgaaaagggctttgatttttcaaatccttagaaagagtcttgggggaccctgaagggttcccatatcacacactgagaattgctgacatagaggtggataatatgagctttagcaaatgaagtttatcgcccagctgcatcattactggaattctttgaaagtgatatctttagctgttaaatggtcacaataatagttacctcacttgtttatgatgagggaaatacggtaaattatggacagtacatcaactatgagtctttggattacacactacagaaaacccaaccaaacttagcttaataaaaaggagcacatttcatggctccctcttcttaaaaaggcaagaggagctactgtttgatctagactttgtggggtcatgagggatctagctctgtgtctcgtcctcctctgagtcttggctttgtccccacaatgacttccctcatcacacaacaatggctgcagaatttccaggccacccatcctcataccacaccctccagctgaaaggaacttatctcttttagtggtttccatgaaagagagaggcagcttcttttcccagtatctggatccatgctcatttccaaatgaacatgtttaattcacatatttatttccatatcaatcaccatgtgtgttggcaggagggaggaagaaacgcatttatttgagggcatttgaaactcatccccagaactaagggtgaagtcaatcttacccaaaccttgtgactgccaatatggagtgctgattcccccaaaggaaaactggatggattgggtgctagaaaagagagatagagtctaggagaagacaaacggccacaatagtatgtaaagaatctagcatataatagctgtgcagaaatgaagatacctttctccctcaatctgagaaatcctttcatggccctcacttctgggatcacttccctagtgaacagcatgaaacctctctgaccatataattatgagggttgactggcgtgggggagatacttgactcaatcaaatcaagcctggctgcatagactgtccatctcaataaacataattttatgctgtgaggcattttgtagtctaatagtgctgaaacggccaaagagaatgactctaaagggaaatgaaagctgcactaaagaacaaatagcctgtcggtggaggggggaaatgtgagttcagatgtttctgtatgccaggctgagattctgacaattaaatgctgaagatgaaaatgctagagttcaacttccataaataagccatggctccagggaagacctgggctcctgagtcaaaggaggccatattttccaatcagtatcactctttagaaaaattactaactgagttgcttttctttaaagcagcattcattttggtctgaagatttcaacccttaaaaggtgcacactagtaaatggcattattttgacacgtcacatgaatatcaccatgaattacaaaacattagaaatatcagagttaatatgatgtttctaaatattattatttatccacaaacataaagaggagtgtgaggccttttacctgctgtgtttctcttttcaagtttattttaggaatttttattggtaacccttgacattttcttcttgccagcagttttattcaaagtctggcacattctgtttcacttctttttaagagaagaaagaaaatgcctttaacaagagactcaaaagttggctgggtgaaaactctgccttcttgtttaatggctcccactcccactatcctttacaatatacacgattccatagacagctgcacacaactattaaattagaaaatctaaaaagaattaatccagccatccattgattgggtcagcgttaacttattgcaagttttcctttcttttttttttttttgagacagaggcttgctctgttgcccaggctgctggagtgcagtggtgcgatcttgactcactgcaacctctgtctcccaggttcaggtgattctcctgcctcagcctcctgagtagctgggatcacaggcatgtgccaccatgcctggctaatttatttatttttttgtatttttagtagagacggggtttcaccatgttggccaggctggtctcaaacttctggcctcaagttatccgcccacctcagcctcccaaagtgctggaatcacaggcttgagccacagtgcctgtcctataactgttttgggaccaatgttataagtatttcttttcatgatagaaatttggaaaatattgtacagtttaaataagacctacccataattctacacagtagaaatgaccattgatcttactagacattgtttagtgcgctttgttcatgtaacattatattgttaagattttatgaattcaatagaaaacacttaaaaaattaatgcaagtaattaggtcaccaagtccttgtactaaaacttgacaatataagggagagaataaaggatttatcctgtttcctgtataaactatatttcagtataatcaaatagccttgatcaatttgtgaaaattgtttatagaagaattctagcaaaaatgtcgaaagaataatatgattttttaaattaccattttgtgctccctaatgaaacaataccatcaggagataaaacacttagatagaagtttggatggatcaggcttttgcccacctgaacctactgatcactgttagcctactaagaatggaacaaccagacatgtgccaagatgtgatgcaatatgaaaaacacaacaccacccttgaaatgttcttgttttacaaagggaaatccttgccgggtgtgatagctcacacctgtaataccagcactttgggaggccaagccaggtggatcatttgaggccaggggttcaagaccagtttgggcaagatgacaaaaccctgtctctactaaaaatacaaaaattagctgggcatggggatgcatgtctgtaatcccagctactcaggaggcagaggttgcagagagctgggatcgcaccactgcactccagcctgggcgacagagcgagactctgtctcaaataaataaataaataaataaggaaatccacaaccactagactggccaaaattaaaatgactgacattacaaaatgttggtgaggatggggatgtggaggaactacaagtctcataccttgttggtgggaatgtaagtgaatcaaacatgttggagaacagtttggcagtttgttataaaatgtaatgcatacttaccatacaatctagtaatttcattagaaaagaaaagaaacatgttcaaagatctattcacaaatgttcataacagctttatctgtaatagcacaaaactgaaaacaaactaaatgcccaaaataaatcattcgtggcatattcatacaatgccaacaattgccattacttggcaattaaaagagaagattactgataaataccgtaacttagatgaatctcaaaggcattatcttagtgaaagaagccaaatacagaagagaatatacaatatggtttcattaaaagaaattctaggccaagcgcagtggctcacacctgtaatcccagaactttgggaggccaaggcaggtggatcacttgaggtcagaagtttgagaccagcctggccaaaatggtgaaaccctgtctctactgaaaatacgaaacttagccaggcatggtggtgcgcatctgcagtctcagctactcgggaggatgaggcaagggaattgcttgaacccaggaggtggaggttgcagtgagctgagactgctgcattgcactctagcctgggcaacaaagtgagactctatctcaaaaaaaaaaaaaaaaaaaaaaaaaaaagaaagaaagaaagaaattctagaattttcagaaaatataaaatatgcaacaatttgcacagctatcagcaatgtttggaagtccccatcttggtacccacatcatcattgagaattatcagtttctagggtaaaaatggcttctccttgttttaaaacatgcatgcctttgtttcacagtaaaattgagtctttttcattttcataagttttgtttatttttgctttttattaacttttttcttggaaattactgttcagctacctttttctaattttctattgctgccattttttttccttattgacttataagagttctgtatagattaagtatataaatacttcgtcatatttatggtattttttctcagtttgtttgcctttttatttacgttttgaagagcagagtctttttctgttttgttataatggtcaaatttattgttctctttcttcaacatttagttcatgcttttatctccataggcagaaatacaacaatatttgctcaaattttcttgccattttttataattttattttatataaaagtttacattaatctggatttactctggtatttggtgtcaggtctgaattttcctcattcttttttgtatgtcaacaatttcacaacactttgttttttctttttctttttcttgtctaatactatcttgctctgtcacccaggctggagtgcagtggcaaaatcctaactcactgtagcctctaattgctggcctcaagtgatcctccagcctcagtcactcaagtaactgggaccacaggagtgcaccaccatgcccagctaatttttttttttttaagagacaaagtaggctgggcgcagtgggtcatgcctgtaatcccagcacttggggaggccgaggtgggcggatcacttgaggtcaggagtttgagaccaccctggccaacatggtgaaatcccgtctctactaaaaacacaaaaattagccaggcatggtggtgggtgcctataatcccagctacttgggaggctgaggcaggagaattgctagaaccaggtaggaagaggttgcagtgagccaagattacggcattgcactccagcctgggagacagagtgagactctgtatcaaaaaaaaaaaaaaaaaaaaaggagacaagtcttgctatgttgccaggctagtctcaaactcttggcctcaagcattgttcttgccttggtctcccaaagcacggcattacaggtcatattttaatatttaatgtgacttctatttctatccacttatttttgagagttttttggcttttatcatccacttaattctccaaacgcttattgactttgttctgtttgccaggtactgtgctaagaagtggagataaaaatctggaagggcagacagcctttaatgttttgtttagaaatgtatgaatgccatagcagcagaaaataactaaaatagctaacacttagtgcttcccatgggccaggcactatttaagtgttttacatatattaacacatttaatcctcaaaaaaattatctgagctaggttctattctattcttctttatttatgtcgaaaattggacacaaagggtaacttgcccaaggctgaacagctagttagcaggagagcccagattcgaaactgggtattttaaaaaattgaaaccctcttactttgctagtgggaatgaaaaatagtgcaacggctatgggagacattttgacaggtcctcaaaaagttaaagatagaattaccatatgacccagaaatttcactcctaggtatgtacccaaaagtactgaaaatatgcattcagatacttgtacacaaatattcatagcagaattattcacaatagtcaaaaggtggaaacaactcaaatgtccatcgatcgataaatacataaacataatatagaacacccacacaatggaaggttttacagcaaccttcagcaaaagtaatgtagtactcatacatgctacagcatatgtgaaacttgaaaacatgccaagtggaagagccagacacaaaaaccagtcacatatagttccatttctatcaaatatctagaagaggtaaattcatgaaaacaaaagacagtttaatgattgtcagggaataaggggaggagggaatgggaactgacttgttaatgggtatagaatttcctttgggagtattgaaaatgttttggaacttgatcgagctgatgattgcctaacattgtgaatgtgctaagtgtcactgaattgtacaccttaaaatagttagttttatgttatatgatttttttcctcaataaaaaagggggtttggttttcttactgagtttttgcttttaaccacccactgtactgctatatacaatacagagaagtaaaccaaatcttatccaatcctgagggtgaggaatagctttacagaggagctgatacatgagctgggtatggaagaatgcgtaggggtcgaccagacagattttgtgtgtgtgtgtgtgtgtgtgtgtgtgtgagagagagagagagagagagaggtggggattctagataggtaaaacagcttgtgaaaattcatgggctcaaaacagaggaagtgaaggcagtttggtgacaatggaatatagggctttagtggaaaagagggtagtgttagggatgaggttaaagactgatattaatttaacacatatttatcaattgcacatttccataggccaaagattggaaatttctagagctctttttggatagcaacaaaaattcatgttggcttaggatacttattattacagtggtgtccaaatatatttaactgctgaactccaatatataaagatgtttgcttatgaatctctcattgtagtctttgaaccgactctagataaccttgaacatattttttacacaggtattcatttacttttcatgccgctaaatacatagcaacttaatttttacttacctgtggcactcattgaccatatccccttggtgttgaacatttctgggcctgttggcccctcaacttctaaatgccaatggctgagtttccttgtctgttttttccctttatcacaagaatgcacactttccgcgtgcagagcaggtcagaaatgctagggaattataactctcagaagtagccatcaacaaatgatggttaggaattgatggacacatacatcagctccctctctccctggatggaataactctgaggtgcatgttcaacacagtcttccagaatcccagacagaatgaagctccagatgcttacagtagtaacttgctcgataatttcccctttatttgcttcatttactccattgtcttacttccctgcccctacttgccttcaaatctttgtgagacaaagggtttgctctgggagaaactcaaattaagatactcacagatttcagtccaaagtcacttcctcagtacatcagtcagaacctagttaggaaaagagaatccacttaggtatttcaaatacaggagatttaatacaaggaactggttaccaagagagaaggaatgatacctagatttcagaagctatttttccctctggctggaaaccagtagcctacattggagaacaaatagacaaataacactcagggaagtattttctgacccccagacaaggtaaaaacaaacaaaacaaaaaaccccgagaacctcctactgtctgctttcatagcacccaattgctttagtttaactcttatttctgtgacaatttgattaatgtctatcatcctcactagattacaaatccaagagtacaagctcactaaatatctggttgaaggaatgactaaataagtggtgtgccagaaccagcttgtaccagctcatgaaagccagttatgcaattctctttctaactctatgttcagtgatatcaggttggtagtttaaaattagccgttatgagagtatttataccacagaaatcagcgaacattacaaataggagcttctctatttgaagaactcagttgtgaaacatttatcggtataccactaagtgaatcctatttaacaatgcaagataacacaatgtatccatttccatagctccatgattatgactttcatggaaggtcttagcctctgtctatatttgtgcaaagagaggaagaaattttcaaggagtttttctcttaggcacgtaccttcaaggacatctggtatagacttcttctattgcattgtttagcaaaaagaaagaagaatcagaaagggcaagttagattggcaacatgctcatcccttccagcattcatgtacacatgagttctgacccctcagcctgttcagcaaatgcaagatgcagagacgccgccgaccaagctgtctttcaaacctctgccaccccaggtgcttgcggatgtgactgtaatctttctccagattcaatattttaatatggacataattttgtacataggaaagtaaactcttttcatgggatgcccaggttctaccctgtagccttaactaagcacctacaaatactgcatagaaaattgtagcttcacctactagaagattgatattacttttatgggaaagggaggtttgtgagcagatgctcacaaagactgctctttgaacaagtcattgcaattaggttgtagaaaactatactaggatgcaagaaaaatggtttaatgtatattaaatttaaaagtagcatcttttacaacatttcctatcatttcatttcttattatttcatgtttgcacaccggcgcaaaagcaacgatgggccaaactgctgggtcttggtgggaaacaagacagagatacccaactgtcctagtacccatgatattcttcactgccacacatttacaggtacaaataatagtaatacaaaataaaaataataaatgatgattccactgaagtgtgtttgatgcagcaagttattagccttattaagtaccaaccctcaattttctgtgtgacaaaacgagaagtacgtacgaagcgtttttgctaacttttgaagtactatagttgtcttgaggaaaagcacttgtgcaattgtttgagttgtgagctaaactaactgctttttttcatgggacatgatctctgtttcataaaactacttttcatgggattgttattcaatctaggacatttgttggaccattttcttgaaaatgagtaaagtgaaacggttactacaaagaaaacaacggacaggatttattgccaatgataaaaatcaagctttccagtgaaaatgtgaatgttggaaatttttataagtactactgttagcttgacaccatgagtttgactccgtgagtttttccaatgagattggtggtaatattaacatatgtgtttttggtattttaatgaaatgtgcagtatttaggagatcagcacaattcaataaaccaatattttccaaatgattggctagatggtgttacaatatcatatgtggctgaaagatccatttaaagtaaaagttagaccaatggattttagtgacacagaatacaaaaagttcattgataagattccacattgaacctagcctttaataaactatcacttgtcttcctatgatgatggcagagtgagagcaagcccagtagcccacaaccaccatgtttgcatcatgcctcctaaaactctattgacacaataaatcacacagcagagcctcaagtcagagggtgggagtgagtgctacagagttacacagcaaagggcatagaaacagggtagggtgatgaacctaggccatttttgcaatcaaccagagctataaagatgactatggaatctctcattctgtgctaggtggtttacatcaattaggccaaatcctgaaaatagccctaaaatgtggttatttgtgtaactaaaagttcttgattgcaagtgaccagaatcctcacacaaactagttgaagcagaagtgaatttatgggttacttaattgggaggtgaaccagttaaggttgcttagcatgtctaagttatgggatggctgaatctaggggctgacatgaagtttttgatgctctctctccatagcattcagctttgattttgcctgtatgttggatcttttctgcagatgacatgttctctgaagccctgagagttgctctcagcaattcaaggtttacatagtcctctcagtttgcaatcccagagaaagatggggcatctttcccaatggatttgttcacaaagtccattggtggctctccatgacctggaaatggttataagttgatgtttgtaaaggagtcctaaagccaagaggttggagaactgcagaactagatcatcactaacattccttccagttctaaaaattctaaaattattctagtatcatttgttatctcctggttgaattgtagtagattttatatttggaaatagtagaatctgaatcattacagcatattttatttattatgttgcataaaatgctcccacacaaggtgctacgtactcttggaagcaggctgcaggaggagataacacagcagagatttcttctaaccttaacatgttcataaagaagaaatagcaaaaccaaaaaatttatcttccgatagaactgtattgccaataggattacattttgcgtagaaatccttaattcgccaattgattttttatgtatctctctaatttatctgtcccaaaaggaaatctagcttaaggaggataaatacacaggttcaatttttgggccaaattcagccaactggagcagctgccagaattgccagactgtgaaggatcttgaggacagagagaaatgtgtgttgatcagagacgtgtgccatgcttaatttagcttgccttcgccttcaagatctaactaaaaaaacagacgtcttttatatgcctataagaaacatcattggaagggggtctaaggattttatgagtcacgtagaaggaactacacaaaagataatttgacagtttaagcagaaataagcagcacttattgaactaactttttaaagtaaaccaaaaagccacaaataccttgttcatccattcaatagacatttattagaagcctcctttagtcaggtactatagccaggttcttgggaaaccaagatttctaaaatttgctccattgtcccctgacaccatacagcctaagctcaaacagcctaaaacgttctgggtttttttgtttttttgtttttttgtaaaagagacaaccctggtgttacgtaaggttttaagggcatgttgtaggttattgctactaagcaatgaacctgacccaacagaatcaatattatagaattgtctaacccaaaagcaacattttaacacccacagtagctttctgttccaagactctgtgcatatttttggcataggctctgaaggaaattgtgtgtatactttcaattacctttataggtacaaattatcatttgctgctttctctaatgagaatatgacttatgtttccttgcctaaaatgagacccattgtagtctatagtaaacatgtggctggatgggttaacattagctcttaagctctgacagcttttattcttctgttttgacatgtctcacgcctgcacgttacaaacagaaggaatacccgtggtagtcttcacaccactcatgcagtatgtgatggatggtttctacactgtaattaatatgttggatcctcactcattaatgtggcaaagaaaaaatagtaacccatatttgacagttgcgatctgactagccaacctaattgtgctggaagggaataactggtgacattgttcatgatgaagtctttacttcccaagtcatggttgttatatggcatgcattatctcaccttggagtggtcttgcagaacctcattgcaaaatcctaaaaatgcacaataaaagatttccagaatgttctccattgagccagctgtgtttaactttgtagcactgctcagctatcacagggacaggtatataagtaagcagcaggaaagataacaatccattggaataacaaagaacttgactcttgaattgtattttctgctaaaacttccccagtggtctttgtgtctgggatgctatgtgcttagaggaaagatcatgggctttgcaattaagcagatgtggattcaaatcctggttcctcatttactatgtgctctcaggcaggattattaacctgcataaggctagtccctcatctataaaattgtgatactgatgcttacctcttagtcataaaggtttaataaaatactaaatattctgtgcttagcatcaagctggtgctcatttgatgttttttccttcctcttggatctaaaccatcttgtagaacttccatattaagggacatttttatcagttcactaaccttttattgttctttcaatatcttaaataaccaaaggctagttatttttattaacacaagtgcaggatgtaacactgaaacggaacatttcttttctttcttttttttttttttttgagacggagtctcactctgtcacccaggctggagtgcagtggcacgatctcggctcactgcaagctccgcctcccggcttcacaccattctcctgcttcagcttcccgagtagctgggactacaggcgccagccaccacgcccacctaattttttgtatttttagtaaagacagggtttcaccctgttagccaggatggtctcgatctcctgacctcgtgatctgcccgcctcagcctcccaaagtgctaggattacaggtgtgagccactgcgcccagctatcatttttaactctgttatgtttaacattatatccatgatgattgtttttcctctcttttgcccctctgctcttttaaatagacaagcactcaagaagtagctatttatttctcaccttttctgccagtggggtgacttattctgtgctcaattgagacagaaaagaacgaatatttgttccttccttctacccagtttataagactcatctgtcttctggtcattgactccagctgctgctatgagccattgctggacagagtggcagaggttttagaacccacagaggacatgaagaccattcatttttttcttctagttctttcacatagccatgtccaattttactctggcagaacgtggtgttgctgggatgggccatgtggtgtttctctgacaggggtccaccaactgtcagctctggctggtgctcatctctcagaaaggccaaaagagtcatttcgggcaaaggcactggggatgtctattcttcatggacattgcgtgtccaagtttctccttagcctaagcaacagaaatttcgtcctctgttttccccaaataagctaagctccaaagtatctcagactcaagagagattactgtggctggatgtgaccaatggccactctggggaggagagggaggggaaagaggatggcttgtaaaatgtctcagcagccattgggaacatgagggtagctcagatgcattcaatagcaattcttcttggtctccttcagtgagtatgaggtggggagggggattttcctggtactcctggcacataggaacataacctaaaactccttaaattgtctaatcagttggtcatgtttcagcaaaaaaaattcttaagttgtgcaattagttgtttatattttggcaaaaggaatccatgggaaaaaaagctgttcccagggaattttatttctctccccttactgaattggaaagtagggtatttaaagtttctttacattttaataagcataattttgtttttcaagtgctcattgggcttcagaaaatgtgtattattactgctataggcaagcagccctgtgtagtagaaagagtgaagactttaaagccagaaagattatgattcaaattgtggttcttggccatttactttgttgcttgttgccttggcaaatccttccacctctcagatcctatttcttaagattctatttcttcatctacaaaatggggacaacagtactcaagtgatttacatcatttgcatatcttatccagggtcctttcctttgagtatcaactccacacacttttcataaaacttgggaagagttaaccccatgattggtcagaagattacctgatcttgaccagagtcctcatcttcctggccacggacattagttcaggaatagacatatgatctaggccaggccaatgagagtctgtcaagtgacttttctgcaaaatgcatgggtaaaatgcctgctgttctgatatggcaagtaggatgatgaactcattcacatctgcctggggttttcttggttttagcattgactgtccccccatctcaggaaacttctcaatcttaggatggttggtcactgatatggtttggctgtgtccccacccaaatctcctcttcaattttaactcccacaattcccatgtgtcctgggagggatccaataagaggtcattgaatcatgggggcagatcgttcttgtgctgttcttgaaataatgagtaagtctcacaagatctgatggttttaaaaagaggaattcccctgcacaagctctctctctcttttcctgccaccacccatgtaaaacatgacttgctcctccttgccatctgccatgattgtggggctcccagccatgtggaagtgtaagtccattaaacctctttttcttcccagtcttgggtatgtctttatcagcagtgtgaaaacagactaatacagtaaattgggactagtagagtggggcgctgctgaaaagatatccaaaaatgtggaagcgactttggaaatgggtaacaggcagaggttggaacagtttggagagctcaaaagacaggaaaatgcgggaaagtttggaacgccctagagacttgttgaatgactttgaccaaaatgctgataatgatatggacaatgaaatccaggctgaggtggtctcaaatggacacgaggaacttgttgggaactggagcaaaggagactcatgttttagcaaagagactggcagcattttgcccctgccctagagagttgtggaatttgaacttgagagagttgatttagggtatctggcagaagaaattcgtaagcagcaaagcattcaagaggtgactttggtgctgttaaaggcattcagttttaaaagggaaacagaggataaaagttcagaatatttgcagcctgacaacatgatagaaaagaaaattcctttttctgaggagaaattcaagctgtctgcagaaattggcataagtaacaaggagccaatgttaatccccaagacaatggggaaaatgtctccagggcatgtcagaggtcttcacagcagcccctcccatcacaggcctggaggtctaggaacaaaaagttattgtgttggctgtgctgtgtgcagccaagggacttggtccctgtgctgtgtgcagccaagggacttggtgctctgcatcccagccactccagctgaaagggaccaatgtagagcttgggccatggcttcagagggtggaagccctaagctttgacagcttccacatggtattgagcatgtgagtgcacagaagtcaagaactagggtttgggaacctccacctagatttcagaagatgcatggaaatgccaggatgcccaggcagatgtttgctgcaggggcagggccctcatggataatatctgctagggcagtgtggaagggaaatgtggagttggagcccccacacagagtccccactggggcactgcctagtggagctgttagaagaggatcactgtactccagaccgcagaacggtagatccactgacacctcgcactgtgtgcttggaaaagcctcagacattcaatgccagcctttgaaggcagctgaaagggaggctgtaccctgcaaagccacaagggtggagttgcccaagaccataggaagccacctcttgcatcagcatgacctggatttgagacatggagtcaaagtagatcattttgaagctttaaaatttgactgccccactggattttggatttgcatgggccctgtagcccctttgttttggccaattgttcccatttggaatggctgtatttacccaatgcctgtactcccattgtatctaggaagtaactaacttgttttttattttagagattcataggtggaagggacttgccttgtctcagctgagactttggactgtggacttttgagttaatgctgaaatgagttaagactttggggaactgttgggcagtcatgactggttttgaaatgtgagcacatgagatttgggaggggccaggaatggaatgatacagtttggctgtgtccccacccaaatctcatcttgaattgtaactcccacaattcctatgtgtcctgggagggaaccagtgggaggtaattgaatcatgcggacgggtctttctcacgctgttcttgcaatagtgaataagtctcatgagatctgatggttctaaaaagagaagtttccctgcacaagttctttgcccaccaccatccatgtaagacatgattttctcctccttgccttctgccaagattgtgaggcctccccacaatccattaagcctcttttttttttccccagtcttgggtatgtctttatcagcagtgtgaaaacagactaatacagtcaccttcatttcaagctgtggggataatttaaacctggagttgcttttaggggctttgtggaaaatgttgtctccagaatggatctgtcacacaggggaagcaaaattgagacatggagagacatagaacatcaaagatcccatctgggttcgtatatccagccatgctgtagctcagacatgttaagtaacctttactggtttactttccagttaaatagacttttgcttgacattgtttgtatgggcactctgtcacttgcagtcaagaatccttattatcacagtattgggttattgtcaagatttaacctgctttatgcaaagcatctagcagaagctccaagatcatcatcatagctctggttaatggcaaaggtggtctcaaattgtcatgcctcatgcctccctgtatccatgccctgtactgcatggatacattgtagtgattttctactctgacttgtttcttttgtgtaatgggatattagcaaacatgatgcttgggagactgaacctgctccgactcactccatcttccatcaccgtgagaaggatgtgcctaggctagtctgttggctactgaaacccacagagcagggccgatcagccaacagtaagcagaatgccactgtcaaaagacaaaatgacaacaaatttagttatagatctagttggcttttatttgagattcatgaatccagatggcagaaggagagctctcaatgggctgtggcagaacaatggtttttgtaaggtggggacaaggaaacaaaacaatagaaagaaacctgattgagtgacatcaggttactcgaggttattttttgttaagggttaaagcagagggggattccttagttacaacgtaaaatgtattcctcactgtgaatcatggtgaacaagctgtaaagccactacaaaaaattagctattcctgctgttatatctaaatgcttttaattagctaaattttgtctatggcaaattaatttctctcccattcctcacctactcaccactagttcttcctccagtaattaaagaatgatttcctgatctcactacaacagagatggtgatgttctcactgtcttgttggagttatcatatttcagatatatacggtcaatggaacctgccttttctcctttgaagagacaggaaatcttgtctttttttgatcccaggagattcctttgcactgaatgaatattctccaatacacccagtcagatccacaaacataagccaggcagggtaactccaccccacaaagaccagatatgagctggggatttggacttttaaattgaattgaagttttttggttgtatttaccctcgagaggactctggtggcttaaacatgataatcagtcaggaatctctgtaactaaaatttatataaagttgtccacacactgagggggtcattaaaatcagtgttgtgattgatagaaatgaagagccatttctgcacttgattttgtccgtttactctctgttaaatagtgccaaccaagcagaaaggataggaaaagatgtgaaaggtagaagaattataacataaataattgtctacaatcttggtgtctgctattccctggaccctatagccagcactttttgttttgttgatactgaatcttcttgtgtagctgggcctatttgataactatatttttaagttccatttagaccagtataatgcatatatgatagaaaatgtagaatattgtcaggatgatgtctgcgtatggcatcttcatgtggaaagcaatcaggaagctaaattaaaggaaattgcccttcctcctatgagaaagtgttttgacatttacactgacagttacataatgaaaccctggtgttttggtgatgatccaggcggtacccagctctgcaggcacttcagttgtgattacctaagaggattattcctcctgctctcctctgtgtggtgatgagattgtcttccattccagtgcacatcttctattggtttctcaactttcacaagaggatgctgaaaggactctacccccagttgggtttcccctgagtcctttgactctgaatccacccagaagtggaacagttgctttctaatccagcagttagaatctcatttagtattgtctttctgctttctaaaaagtggaattgtgtttcgtgcaggggttaagaaaagttatgtaaagtcaaaatccccttgaaaaatccctgaagttgatcataaaatacattgtctttatatccattattaaggccaacagtttttcttccagccctgaaacagatggctggttctgtggttgacaccagatgaagtagttggcttgcattgaagggccatgttgtttgagaaatacatcattttatacaaccgaatcacacctcgggacaacaagattctcactctctgaggggaacgagggaaatgaaagcaaccgaaggacacagctttatgtccacctacctcaggcttattattgtgacttgcatatccatttagtgaattgctcactgctttaacattgtttactttctcatctttctctggtccagtggagccacaagactccactggcatagaaattttggcagcctacttaaagggaattagaaaactcaaaacagcacgaaacaagtcacagacagttacaacactgtcacctctacagcacaacctcatcttacagtgtctaaacaagtctccagttagcacccttcttactttatcatccctctgtcatattgcagttcggatgggactatcatcagccctaaccgtgctctcttatatgctcaagaaacaaatttctcacttagtttttatccagcccagccttcatttaccagtggtactggtaaataggccctttgaggaaaacataaaacacttatttgtagagtttgctgattcgcacagtgtaaattctttcaaggctgattttatgctgccaatatgaagctacagaacatgaacttagaaacagcagaatccactctcgagctggctcctttcatctggtcttgcagtagataggacttgcctctacagagtgccctatgatccattaggctcagtattcaattgctataactgcatataatatacattctagatcaagcttgtccaacctgcggcgcatgggctacatgcagcccaggacagctttgaatgtgtcccaacacaaatttgtaaactttcttaaaacattatgagatttttttgtggttcgtttttttttttagctcatcagctattgttagcgttagtgtattttatgtgtggcccaagacaattctgctccttccaatgtggcccagggaagccaaaagattggacattcctgttctagtactggagacaatttcaccgcacatctatgaaagtttttttcggcacatgcgtgtggtgtgatacactggctgagagtcatggccctaggcagttgccagggaatataaccaattgctcttccaaatattctaaaatcttctttggatcaagccttaatggcagacaccaggttacctgctgttgctaatagtcttactccatgaggccaacagtttatacggtgggaaagctctccaaaacagtctgatgaaacatgactgcatgaattgtatgaatgctgttgaggtggttgttcctggaatgaggaagtatctactctcctcatgaagatcaggcaaggagattttcatctgttctcaatatccggaatggttatgctactgagaatttcttttttaaatgctattaatcctgatttttttaattgatcaggttctgttttttttcaatggcagccaggaaataaggcctcaaatttttagtctactcttaataaatgtgtcaggtcattatggcatcctttcttaacttcactgttacttcttatttcaggcattcattcattcaataaagatttgagtatgtatgtgtcagattccaccctacagacttgagatgctctttaaaatgctagacgacgagttagtgggtgcagcgcaccagcatggcacaggtatacataagtaactaacctgcacaatgtgcacatgtaccctaaaacttaaagtataataaaaaaaaaaagaaatcagttagaagctgaaaaaaaataaaaaataaaaaaataaaatgcttcctatcccctgataattttggactagtaaaatgaagcattgaataagtgatcatgcaaataaacgtataattctgaatgatgctaagtactctaaagaaaaaactcagcatgttaacttaaatagggttgtcactttatgccactgtccttatttctcttctttcatctgcattttatactgtcccatcatgtgtgttttatgtacacttgtaaatgaatagttttaagggttttttccctgaaaaaatgaattaatgaccacataaccaaagatacgtttttccattaaggctatagcagtagttttcatttaaggacaaaacggtatcttggaaatttgacatacattatagattacaataaaaataagtaataataactagtagtcaccacacttaccatgtacttatttttgctttttgattttattgttatttttaatcgacacatactaatggtacatcagtgtgatattttgatacatgtatacaatgtgtgatgattaaaatagggtaatgagcatactcatcacctcaaactttattatttctttatgttgagaatattcaaaatctgctcttctagatatttgaaaatatacaacaaattgttgttaatgatataattatcattctccagtgctataaacactagaactgattcctcctatttagctatatttttgtatctgttaaccaaaatttggctaccccttccatctttagtaatcactagtccactctctacttctgagatcaactttttagctttcacatatggatgaaaacatgtagtattgatctttctgtgtctggtttatttcacttaacataatgtctttcaagctcatgttgctgtgaattacagaatttcattcatttttatggctaaatagtattcaattgtgtatataccacattttcattattcattcatttgttaatgaatgaatcaacttaagttaattctatatcttggctattgtgaatagtgctacaataaacatgggactgcagctatctctttaacatacttatttcatttcctttagatatatacatagtagtggaattgctggatcatatggtagttctgtttttagatttttgaagaacctccatactgttttccatagtagttgtactaatttacattcctaccaagagccacgtactagaccttgttttaaacatgtcacaggtgttagtagttggtgtgctgtattttctgactccctctccaggattggtacattctgatagctcttagtggtcagctctcaccaggaatttcccttggtgagaggaagctgccttgctgaaggttgagtgccttacagggacagcctgtgtccaaagactggtgcataaaacagtataacgttgtggtacccatcataacttgggacaaattgaaagggccattagagttccagaactgaagtactcttgtaattatatcacagctccatttcttttttgcctaatcttgctgccctccctccctagaagagctgatcctgtgaacacaccctaataaacttcctgcctctaaccttttcagaacctatctctccaggaacacaacctaagatggataattctcatgtaactctcaaattattaccctgtttcacaaatgaagaaactgagatattatggagctgggtgtgggttcaattgcacacaggcaacatggttactgtactggaagggtatctaatgatgcccactgcggttgcgatttgatactatctttagcctttggcaataatgttatgcttttgcttttgtttgactatttctaggaacaagaaactcactattttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccggctagttttttgtatttttagtagagacggggtttcaccattttagctgggatggtctcgatctcctgacctcgtgatccgcccgcctcggcctcccaaagtgctgggattacaggcgtgagccaccgcgcccggccgaaactcactatttaataaaagtagatttcattgttagtcagatctaacgattaggacatttttgtttttgtcagaataagacaaattctgtctttctttaactcctgcccattgttgtagctcctgcatttttgcatgatgcaataaaattccccaaatatttcaagaaaatcatggttcatttatgcttgcctccagtctaggacagtgctactcaaagtgtggtccctggaccagtggtattagcatcaccagcaatcttgctagaaatgcaaattcttgggcccacccaagacctactgtagcagaatatctgggagtgtgctctagagctgtgtgtttgcaagagtcccccaggtaatttttaggcaagccatcagaagcatgtttgagaggcattctttgaggccatgcagtgcccaatagcctatgcatgagttattttgggttctgaaaatattcaggagttggttctcttccctttgggaagaaccacagccaagcattccaaaactgcttgtttgtagcctgcttacaaacttgcctttcgaattgatttcaatcttcccagcttccaatcagtggaatcatccaccatatttttaccctagagactgatctaagaagtgatagtggtgggtaactactaatcactcacttgtgtatacagatggtagctgtttggatctatcaaaaattatggttcttcagtgatctttctgctgtgtctctttgtttaatcctaaaaaatacacagtgaaggagctcccaacaccactttgataaacaattatttgatagtctgcattgttagactatgttagactttaaactacttcttatcaagtgggaaattaaatgtgttgagctcttactaggtgactggctctgtgctcaagtttgacaggtgctatcacattcaactctcacaatgaccatgaggaaactgaagcttaaagagattttgttattttctaaggttacaaagctgaaaaaaggcagacctaggagttgaagcaggtctgttttcctgagcccatgccttccaacacagtgtgatagttctctagttttaggtgttgtattagttatctaatgcagagtaacaaatgacaacacatttagcagattaaaacaatacatatttattattttacagtttctgtaggtcagtaattcaggcagtttcattgcactctctgatttagggtctcagcagcttgcaatccaggtgtcaccttggaaagcgttctcatctggaggctcaactggggaaagatcctcttccaacctccctcacattgttgtcagtattcatctcctgtaggtctgagatgctgattttcttgctgattatcagtctagggaatgcccacctttccttgccttgtagacttctccaagcccctcaaaagggagagtctcttcctctagtctgctgaaacagtcctatataatgtaatgtattcatgagagtactatcccatccctttgtactattctgttggttggaagcaactcacaggtcctgcccacactaaggggatggaattacacaaaagtggacaccacaaggtaggaaattactgggagttactgtagggcctactcatactaatgtgcattaaaagatcattcttataataattgtttaagatccagatttctggccctcaatcccagaaattctgagtcatgaattgtatggtgggcccaagagccagcatttctaataagtactcatggataattatgctcctagtagacaggaggagccacatgtagaaaaacaaggccataaacttgtcccattgcaccgaaagcaatttacccatttattttgccttcttacagcagggagtttcaaagaagctgattactatttattaaaaatcatcccactaaatctttgcctttgtctttcttgggaaataaaccttgctttcaagtttgaccgttggcaattaatgccaatctactcagttacttgctctgttgatatctctccaggctcattttgcctgagacctgcatcccatatatctgctagtattttctgctctaggaaaaatgtttaaatttgacaattctttctaggctagtgttctaaagctaatggagagataaattagagtagccaaccaaccttccttgccaagaactgagggattcttagggatataggactttctagtgctaaaactcagaaagcccaggtatactgagacaatgggtcacacttccgttgtttgtagcaaaaagaagaatttaaggtgaaagcaaacaagctcgagtttgtttatgactttcagtgcttgcttcaatagtgtttcttcagcgtttatgacttttaatgcttgcttccgtggtgactttcaccagcataatccttggtaactctgttaggctgaaaaataatggtccccaaaatatctacaccctaatcctggaacttgtgttaaccttatttggaaaaagggacttcccagatgtgaccaaattagggtcaaaaagtgaggaggttatcctggtttatacaggtagaccctcaaaaatttccttacaacagagaggcaggcagaaaaaaattatgcacacaaaagaggaggagacaacattactgtgaaggcaaagattagatttatgtgtccacaaatcaaggaatgtgagtggccaccaaaagcagcaagagacaaggaaaagattctccctgagagtctccaaaagaagcatgatcctgctgaaaacttgattttagcccagtgatattgattttggatttgtgatctacagaactgtgagagaatacacttctgtcattttaaaccataaagtttctgctagtttctcatagcagccataggaaatgaatacagttaccctaccaagtttcccttgctccctagatttcagttggagactttggttgcaaggaacagaaaaactctggctaacctaagcaaacaaacaacttgttaaacaaacaaacaagcaaaatggaaatatatgggatgattttgaaggaaatactgaagatttagtcttggaaaaggaatcagggaagaaacaaatgggcaatctgtgtgggaagtggccaacacagtgtatcaactcagctgctctcagtctctggttcattttgctcaggaatcaaaatccaaaataagacagcatatcggcatggtctatctgtgataaagggagggtgagacaccttgatccacaattcctgtgtgactgtatccaatgacgaaaaggatttcactggagccagaatcagatgttgtatctggaagaacagacaaggaaaaaaaccagcagatatctgctatacttcgttcttaagtgtggttccaacaaccgtcagcaccagtaccacctgggaacttgcaagaaatgtctattcttggtccccatctcatacctatagaatcaggaagtctagggttgtgtccagaaatctgcgtttcaacaaggtgtttcaaacacctccaggtgattctgaggtaagttgaagtttgagaaccatcgattggattcattgattgcttgttttgatctaattactacgtttaataaacctttcctcctctctttgttttccttctactatcctagtttcaaaaaagcctttagtacctcttgcctagatgatttctaattggtctgtctgctctggccttaaatgccacaaactgacttcccatgcaagtttcagagtaaactatataaaatacatatatgaccatttactcccctaattaaaattccttagtgatttccctatattttcatcaggaattcatcaggagaactgccactacaaggtaaagggctctggggccctaaataaacttgaaagacaatataaaccacaaagactgcaactcctaggtgagtcctagtgctgaactgagcccagagacagtggactgacaggggatggtgacagatgaactactgagacacaggccaggatggctaagggaatgctggcatctcctttcccctaaccctaggctacacagcttgtggctccaaaagagacctcttcccactgcttgaggagaggagagggaagaatggagaggactttgtcttgcatcttggataccagctcagctacagcaggatagggcagcagtcagagttgtgaggccccctttccaggtcctagctcctggatgacatttctggacacaccctgggccagaaggaaacctgctcctttggaggaaagaacccaattttggcaggtatcatcacctgctaatttaagagcccttgggccttgaatagccagcagtgatatccaggtactacaccaagggccttggatgagactctgaaacttgctggcttcagatgagactcagcacattcccagctgtgctgtctatggggtgagactccttccacttaagaaaagcagagggaaaagtaaaagggactttgttgtgcacattaggtaccagctcagccacagtgggagagagcatgaagtgggctcttgggtccccaattccaggacttggctcttggatggcatttctggacctgccctggggtagaggggagcccatttccctgaagggtgagtctcagggaaggcagcgttcaccacaagctgactgaagagtgcttgggccctatggaaacattggcagtagtctggcagtatttcccatgggcctatgatggtggtagccatggagtgaagctcctctgcctttggaaaggggagagaagagtggaaaggactgtgtcttgtgatttgtgtgccagctcagccacagtacaatagaacacaaggtaggcttctaaggtttttgactctagtccctggctcctggacctgcccagggcctgggggacctcaggtaggaaaaggaaagacaaaggcctggttggctttgctacctgctaattgtagagacccaggtttttcagcaaacataggctgtagccagggagtagttacagtaggctttggcaagacccagtgttgtgttggcttcaggttgacccaacgcaatcctagtggtggtcgtggtggccacaggggtgcttgtgtcactccatcccccagctccaggtggcttagaacagagacttcattggattgggagaaattaagggaagagaacaagagtcttttcctgttaatacagagaattcttccagatcttgtccaagaccatcaaggcagcacttctatgaatctgcaggaaccacagtgttactaggcttggggtacttcctaaagcagatacagcttagatcacagcactcgagttctttcaaatatctgggaagtcttcccaagaagaacaagtacaaagaccagactgagaagactgcaatggatacctaactcttcaatgcccagacacccagacaccgaagaacatctactagcatcaacaccatccagagaaacataacctcaccaaataaactaaataaggcaccagggactaatcctggagaaacagagatatgtgatctttcagacagagaattcaaaatagctgtgttgagtacacttaaagaaattcaagaaaacacagagaaataattaagaattctatcagataaatttaacaagaaaattgaaataataaagagactcaagcagaaattctggagctgaaaatgcaagtggaatactgaagaaatgcatcagagtattttaataggagtatttatcaagcagaataaataggtgagctttaagacagactatttgaaaacacatagtcagaagtacaaaggaaaaaaagaataaaaagcaatgaacatgtctacaggatctaaaaaatagcctcaaaaagggaaatctaagaacaattggccttaaagaggggtagagaaagagataggagtagaaagtttattcaaagggctaataacacagaacttcccaaatctggagaaagatataaatatccaagtacaagaaggttatagaacaccaagcggattaaactcaaagaagattacctaaaggtatttaataatcaaactcccaaaggtcaaagataaagaaagggttatttaaaaaagcagcaagagaaaagaaataagtaacatacaatggagctccaatatgtctggcggcagatttttcagtggaaacattagaggccaggagagagtgacattatatatttaaagtactgaaggaaaaaaacttttgccctaaaatagaatatctggcaaaaacatccttcaaacatgaaggaaaaatagagactttccaagacaaacaaagactgaggaatttcatcaatatcagacctgtcctacaagaaatactaaaaagaaaacttcaatgagaaagaaaagtattttaatgagcaataaatcagctgaaggtacaaaactctgttatagtaagtacagagacaaacacagaatgttataactctgtaactgtgacatgtaaactactcttaagatgaagactaaatgatgaaccaatcaaaaataattacaatttttcaagatatggacactataataagatataaatagtaacaacacaaagttagaaacagagaaacaaggttaaggtgtagagtcttctttagttttctttttgcttgtttgtttgttcatgcaaacagtatttagttgttataagcttaaaattatggtctataaaatagtatttgtaagcctcatggtaacctcaaactaaaaaatatacaatggatacataaaaaatagaaagcaagaaactaaattatatcaccagagaaaatcatatttactaaaaggaagacaagaaggaaagaaggaggaggagatcacaaaacaaccagaaaacaaatgaaatggcagcagtaagtccttactcatcaataataacatttaatgcaaacggcctaaactctccaatcaaaagacagagagtggctgaataaataaaaaaatcaagacctagggatctgttgcccataagaaacatacttcacccataaagacagatagactgaaaataaagggaggaaaaaagatattccatgccagttgaaacaaaaaatgagcaggaatagctatacttttatcaggcaaaataaatagacaaaaactataagaaaagacaaaggaggtcactacataataataaaggggtcaattcaggaagacgatataactattttaagtatatatgcacccaacactggagcacccagctatataaagcaaatatgattagagctaaagagagagatgcgtcccaaacaataataggtagagatttcaacatctcactttcagcattggacagatctcccagacagaaaatcaacaaagaaaaattgaacctaatctgcactatagattaaatacatctaatagatatttgcagaacattttattcaatggctatagaatacacattcctttcctcagcacatgaatcattctcaaggatagaacatatatgaggttacaaaataagccttaaaacattcaaaaaaattgaaataatattaagcatcttctctgaccacaatggaagaaaactagaaagcaataacaagaggaattttggaaactacacaaatacacgaagattaaacaatacgctcctgaacaaccagtgcatcaatgaagaaattaagaaggaaattgtgcaatttctggaaacaactgataatggaaatacaacataccaaaacctatgggatatagcaaaagcagtactaagaggaaagtttatagctattaagtgcctacatcaaaaaagaagaaaaacctcaaataaacaacctaaagatgtatcttaaaaactagaaaagcaagagcaaaccaaacccaaaattagtagaagaaaaataataaaaatcagagcagaaataaatgaaattgcaacaaagaaaacaatacatcaaatcaataaaacaaaaagttggtttttcaaaaagttaaacaaaattgacaaacctttagtcagactaagaaataaagagaggagatccaagaaaataaaatcagagatgaaaaaggagacattacaagtgatactacagaatttccaaggatcattagtggctacaatgaacaactatataccaataagctggaaaatctagaagaaatggataaacttctagacacatacaacctaccaaaattgaatcatgaggagatccaaaacctgaacagaccaataataagtaatgagatttaagacgtaacaaaagtttcccactaaagaaaagcccaagagccaacggcttcactgctgaattctaccaaacatttgaacaggaacaaataccaatcctactcaaactattccaaaaaatagggaagaaggaaaaacttccaaactcattctaggaagcctaatattaaaaagatcattcattatgaccaagtgggatttaaccctgggatgcaaggatggttcaacctatgcaaatcaatcaatgtgatacatcatgtcaacagaatgaagaacaaaaactatatgattatttcaattgatgcagaaaaagcatttgataaaattcaacatcacttcatgataaaaaccctcaaaaaactgggtatagaaggaacatatctcaaaataataaaggccatatgtgacagacccatagctagtatcatactgaaaagggaaaaacctgaaaccctttgctctaagatctggaatgtgacaaggatgtccatggtcattactattactcagcatagtactggaagtcctagctagagcaatcagacaagagaaagatgtaaagggcatctaaattggaaaggaagaagtcaaattattcttgtttgcaggtgatattatcatttgacaaaacctaaagactccacaagaaaaatattagacctgataaacaaattcagtaaagttgcaggatacaaaatcaacatacaaaaatcagcagcatttatatatgccaacagtgaacaatctgaaaaagaaatttaaaaagtaatcccattcacaacagccaaaaataaaattaaatacataggaattaacttaagcaaagaagtgaaagatctctataatataaagtataaagcactgatgaaagaaatttaagaggacactgaaaaatggaaggatatttcatgtcaatgaattaaatgaatccaattgttaaaatgtccatactacccaaagcaatctacagaatcaatgcaatccctatcaaaataccaatgacattcttcacagaaatagaaaaaaatatcctaaaatttaaatggaacaaaatacccagaatagccaaagctattctaagtaaaaagaacaaaactagaggaatcacattacctgacttcaaattatactacagagctatagtaactaaaacagcatggtactggcataaaaacagacatgttgactaatggaacagaatagagaacccagaaactaatccacacacctcgtgaactcatttgtgacaaaggtaccaagaacatacactgggaaaaagacagtctctttgataaatgatcctgggaaaactgcatatctacacagagaaaaataaaactggactcctatgtcttgctatatccaaaaatcaaatcaaaatgaattaaagacttaactctaacacctcaaactacgaaactactaaaagaaaacattgaggaacctctctaaaacattggttactcaaaatttcttgaataacagtccacaagcacaggtaaccaaagcaaaaatggacaattgggatgacatcaagttaaaaagctttcgtatggcaaaggatacaatcaacaaagtgaagagacaacccacaaaatgaaaggaagtacttgcaaactacccattcggcaaggaattaataaccagaatatataaagaactcaaacaactctataggaaaaaaaatctaataatccaatttaaaaatggacagaagatctgaatagacatttcacaaaagaagacataaatggcagacaggcatatgaaaaggtgctcaacatcactgatcatcagagaaatgcaaatcaaaactacagtgagacatcatctcaccccagttaaaatggcttatatccaaaagacaggcaataacaaatactggtgaggatgtgcagaaaaggaaacctttatacacgctgggtgggaatataaattagtacaatcactatggagaatggtttagaggttcctcaaagaagtaaaatagagctactatatgattcagcaatgctactgctaggtatatacccaaaagaaaacaaattagtagatcaaagagatatctgcactctcatgtttgttgcagcactcttcacagtagccaaaatttggaagtaacttaagtgtcatcaacaaataaatggaaaaagaaaatgtggtagttgtcacaatggtgctattcagccataaaaaagaatgagatcctgccatttgcaacggcatggatggaactggaggtcattatgctaactgaaataagccaagcacggaaagacaaatatcgcgtgctctcacttatttgtggaatctaaaaatcaaaacaattgaactcaaggagacagagagtagaggcttttcccagcagctgggaagggtagtgcggagtggcgggagtggggatcgttaataggtataaaaaatagaaaataatgaataatacatggtatttgatagcacaacagggtaatcacagtcaataataattaattgtacatttttagataactaagagtataatcggatagtttttaaccaaaagaataagtgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaagaataagtgcacttgaggaaatggataccccatttttcgtgatgtgattattgtgcattgcatgcttatatcaaaacatctaatgtaccccataaatatatacacctactatgttcccacaaaaattaaaataaatagtagcttaaaaaatggtacagatcaatatgtatcttactcttttgtgcacatgcattatgaacagcatattcagcaactagacaatggcttgaatcttagaaaacctcagcgttcctaattttcttatcatttcgcgttcctttcttactttgtaatgcgatccaagtgtcagatttagaatacacagttattatttacctttgcaacattttacaaagtgagttggtattaacttttttttattatttcatgaaatttctagacataatgtggccagaatatggaagttaattaaatgttgcctatggaataaagtttgaatagaagctttgtaaaaaaaaaaaaaaaaatagcagagtagtagtgaagaactgctcatagatgcttctgggactcttttgagtatggatgaactccaagatctggctgaatttcatttaaatagcagagaaaacactctattttctagacagacttgccataactggcagaagctgtaagatttttaagtgtctttggcaaagttcccaaaaaggcaagtgcttaaactttcccagaaatcgtgcatgtgaataaaatcatagccaaacctgaaaacattagacataagctttttacaccaaagggattcaagtgtgaattgtcttcatccttctatctttcctgtagacagacaccctagtaatttttctactagcagagcaaataatgttatttagcagtagaaattaatacgaggattgctttgttatttatttatttatttatttatttacaacctgtgcttttcagttaagaatctgccatttaacaacaaaggttgctttactgaaaatttaggggatcgaagtaaagattaatgaagctataaggaaataatctctcatatacagaatgtgagaccttcaacaaaacaactcatttggtttcttcagaaggtcaatgtcattttaaaaacgggtggaagaaactggcctagaatgaagatataacactcaaacacaaagcatgaaccttgattcgtgtttgaaaaacagccataaaaagcattttgggaagaattcaggaaattcagttttaatagaaactgggtgttagatgacacaaggaaattgaagatatccttattcttaggagatgcaagctgaaggttttcttggtgaagcatgcgctgcctgcaatttacttcgaaacaatccagctacggagaggaaaacagtgaggaaaagagggcaatgaagaaaggaagggaaatgacaaaaaaaaaaatgttaaaagttgttaatctctgtgatgagtaaataggtgttcattgtgttattttttttcaacttttgtgaatgtttgaaatcacttgatcttagccaaaaggctgagaagcgatactgaatgtttgaaaatcaataataatttgtgaaaaaaagagagcagagactttggagctgagtctgcctcctagctctgccacttactagcttaagttattacagttctttgaactttggttttctcatttgtaaagagaggataataatttatattccataagattgttacaaaaagtatataaaatgacactgtaaagcatagctgtgttttacacatctacttcactgttacctatcattgtcattgtaataattacaaagattattaccattacctatgactaagtaattaataccttttattataggtattattacctatcatctgttttaaaggtacaattttggtttttcaaagcactttcataaatattctctttaaaattcaccctaaattagctgggcatggtggcgggtgcctgtaatcccagccactcaggaggctgaggcaggagaatgactcgaacttgggaggcagaggttgcagtgagccgagatcgtgtcattgcattccagcctgagtgacaagagagaaactctgtgtcaaaaaataataagaagaaataaaataaaattcacaccaatcctgcattaggaggaaaaatgttcatattttctacttactattacctaaaactttctatgtattaaacttattatactaaaattattgtgaatatttgtgcactagaatgaaacaaaaactatttacagcattacttttcaaaaataaccacctactctttaaaatatacctgtgagaaatgctttgaaaatatagtatgtattttatttttttttgttcattgaacctggtttcatttttgaaaatttttttaattgtctcaacttttattttaggttcagggaatacatgtacaggtttgttacatgggtaaattgtatgtcacctgggtttgatgtataaatgattttgtcacccaagtaatgagcataatacccaataggtagttttttgaccctcactctcctcccaccctccagcccccattaagtaggccctggtgtctattgtttcccaatttgtgttcatgtgtactcagtgtttagttcccacttaccagtgagaatgtggtatttggttttctgttcctgtgttagttcgcttaggataatgacctccagctttatccatgttgctacaaacgacatgattttgtttttttttttgaatggttgcatagtattccatgatgtatatgtaccgtatttcctttatccaatccagcactgatgggcagctaggttgattccatgtctttagtattgtgaatagtgctgcaataaacatacacatgcatgtgtctttctctttattattattattatacttttaagttgtagggttcatgtgcacaacatgcaggtttgttacataggtatacatgtgccacgttggtgtgctgcacccatgaactcgtcatttacatttggtatttctcccagtgctatccctcccccagtgccctaccccctgacgggccccagtgtgtgacgttccctgccctgtgtccatgtgttctcattgttcatttcccacctatgagtgagaacatgtggtgtttggttttctctccttgtgatagtttgctgagaacgatggtttccagcttcatctatgtccctacaaaggacatgaactcatccttttttatagctgcatagtattccatggtgtatatgtgctacatttccttaatccagcctatgactgatggacatttgggttggttcgaagtctttgctattgtgaatagtgccacaataaacatacatgtgcatgtgtctttatagtagcatgacttataatcctttgggtatatacccagtaatgggatcactgggtcaaatggtatttctagttctagatccttgaggaatcaccacactgtcttccacaatggttgaactaatttatactctcaccaacagtgtaaaagtgttcctatttctccacaccctctccagtatctgctgtttcctgactttttaatgattgcccttctaactggtgtgagatggtatctcattgtggtttggatttgcatttctgtgatgaccagtgatgatgagcactttttcatgtgtctgttggctgtataaatgtcttcttttgagaagtgtctgttgatatcctttgtccacttcttgatggggttgtttgtttttttcttgtaaatttgtttaagttctttgtagattctggatattagcccttgtcagatggatagattgcaaaaattttctcccattttataggttgcctgttcactctcatagtagtttcttttgctgtgcagaagctctttagtttaattagatcccatttgtctattttggcttttgttaccattgctttggtgttttagtcatgaagtctttgcccatgcctatgtcctgaatggtattgcttagggtttattctagggtttttatggttttaggtcttacatttaagtctttaatccatcctgagttaatttttgtataaggtgtaaggaagggatcccatttcagctttctacagatggccagccagttttcccagcaccatttattaaatagggaatcctttccccatttcttgtttttgttaggtttgtcaaagatcagatggttatagatgtctgctgttatttccgaggcctctgttctgtaccattggtctatatctctgttttggtaccagtaccatgctgttttggttactgtaaccttgtagtatagtttgaagtcaggtagcgtgatgcctccagctttgttctttttgcttaggattgtcttgacaatgtgggctcttttttggttccatatgaactttaaagtagttttttcaacttctgtgaagaaagtcattggtagcttgatggggatagcattgaatctataaattaccttgggcagtatggccattttcacgatattgattcttcctatccatgagcatggaatgttcttccatttgtttgtgtcctcttttatttcattgcagtggtttgtagttctccttgaagaggtccttcacatccctggtaagttggattcctaggtattttattctctttgtagcaattgtgaatgggagtttactcatgatttggctctctgtttgtcttttattggtgtataggaatgcttgtgatttttgcacattgattttgtatcctgagactttgctgaagttgcttatcagcttaaggagattttgggctgagacaatggggctttctaaatacacaatcatgtcatctgcaaacagggacaatttgacttcctcttttcctaattgagtaccctttatttcgttctcttgcctgactgccctggccagaacttccaacactatgttgaataggagtggtgagagagggcatccttgtcttgttccagttttcaaagggaatgcttccagtttttgccgtttcagtatgatattgactgtgggtttgtcataaatagctcttattgttttgagttacagtccatcaatacctagtttcttgagagttttagaacgaagggctgttgaattttgtcaaaggccttttctgcatctattgagataatcatgtagtttttgtcgttggttctgtttatgtgatagataattgatttgcatatgttgaaccagccttgcatcgcaggcatgaagctggcttgattgtgttagataagctttttgatgtgctgctggattcggttggccagtattttattgaggattttgcatcgatgttcatcagggatattagtctaaaattctctttttttgttgtgtctctgccaggctttggtatcaggataatgctggcctcataaaatgagttgaggaggattccctctttttctattgactggaatagtttcagaaggaatggtaccagctcctctttgtacctctggtagaatttggctgtgaatctgtctggtcctggacttttttggctggcaggctattaattactgcctcaatttcagaacctgttattggtctattcagagattcagcttcttcctggtttagttttgggagtgtgtacatgtccaggaatttatccatttcttctagatgttctagtttatttgtgtaggagtgtttatagtattctctgatggtagtttgtatttctgtgggatcagtggtgatatcccctttatcattttttttgtgtctctttgattcatctttttttctttattagtcttgctagcaatctatctattttgttgatcttttcaaaaaaccagctcctggattcattgattttttgaagggtttttttgtgtctctatctccttcagttctgctctgatcttagttatttcttgccttctgctaggttttgaatttgtttgctcttgcttctctagttcttttaattgtggtgttagggagtcaattttaggtctttcctcctttctcttgtgggcatttagtgctataaatttccctctacacactgctttaaatgtatcccagtgattctggtacattgcgtctttgttctcattggtttcaaagaacatctttatttctgccttcatttcgtttgtacccagtagtcgttcaggagcaggttgtttagtttccgtgtagttgtgcggtttttaatgagtttcttaatcctaagttctaatttgattgcactgtggtctgagagacagtttgttgtgatttttgttcttttacatttgctgaggagtgctttacttctaattatgtggtcaattttagaataagtgtgatgtgttgctgagaagaatgcatattctgttgatttggggtggagagttctgtagatgtctattagacccacttggtgcagagctgagttcaagtcctggatatccttgttaaccttctgtctcattgatctgtctaatattgacagtggggtgttaaagtctcccattattattgtgtgggagtctaagtctctttataggtctctgagtacttgctttatgaattggatgcttatatatttaggatcgttagctcttcttgctgcattggtccctttaccattacgtaatggccttctttgtgtctttagatctttgttggtttaaagtctgttttatcagagactatgagtgcaacccctgcttttttttactttccatttgcttggtagatcttcctccatccctttattttgagcctgtgtgtgtctctgcacatgagctgggtctcctgaatacagcacactgatggatcttgactgtttattcaatttgccagtctttgtcttttaactggggcatttaaccaatttacatttaaggttaatattgttatgtgtgaatttgatcctgtcattatgatgttagctggttattttgcccgttgattgatgcagtttcttcatagcatcgatggtctttacaatttggcgtgtttttgtagtggctggtactggttgttcctttccatgtttagtgcttccttcaggagctcttgtaaggcaggcctggtagtgacaaaatctctcagcatttccttgtctataaaggattttatttctccttcacttatgaagcttagtttggctgaatatgaaattctgggttgaaaattctcttctttaagaatgttgaatataggcccccactctcttctggcttgtagggtttctgccaagagatccgctgttagtctgatgggcttccctttgtggataacctgacctttctctctggctgcccttaacattttttccttcatttcaaccttggtgaatctgacaattgtgtgtcttggggttgcacttcttgaggtgtatctttgtggtgttctctgtgtttcttgaattggatgttggcctgccttgctagattggggaagctctcctggataatatcctgaagagtgttttccaactaggttccattctccccgtcactttcaggtacaccaatcaaacatagatttggtcttttcacatagtcccatatttcttggaggctttgttcgtttctttttactcttttttctctaatcttgtcttctctctttatttcatgaatttgattttcagtcactgatatcttttcttccacttgattgaattggctattgaagcttgtgcatgcgtcacgaagctctcatgccgtggttttcagctatgtcagctcatttaagttcttctctacactgtttattctagtgagctattcgtctaaccttttttcaaggtttttagcttccttgagatgggttacaacatgcttctttagctcagagaagtttgttattaccgaccttctgaagcctacttctgtcaacttgtcaaactcattctccatccagtcttcttcccttcctgtcaaggagctgcaatcctttggaggagaagaggcactctggtttttggaattttcagcttttctgctctggtttctccccatctttgtagttttatctacctttggtctttgatgttggtgacctacagatggggtttggtgtggatgtcctttttgttgatgttgatgctattgctttctgtttgttagttctccttctaacagttaggaccctcagctgcaggtctgttggagtttgctgggggtcagctccataccctgtttgcctgggtatcaccagcggaggctgcagaacagaaaatattgctgcctgatccttcctctggaagcttcatccaagagggacacccacctgtatgaggtgtctgtcggcccctactgggaggtgtctcacagtcaggctatatgggggtcagggacccatttgaggagtcagtctgtccattctcagagcttgaacacgatgctgggagaaccactgctctcttcagagctgtcagacagggatatttaagtatgcagaagtttctgctgccttttgttcagctctgccctgcccacagaggtggagtctacagaggcagtaggccttcctgagctgcagtgggctccacccagttcgagcttcttggccactttctttacctactcaagcctcagcaatggcagatgcctctccccccaccaggctgcagcctcacaggtcaatctcaaactgctctgctagcagcgagcaaggctccgtaggcatgggacctgctgagccaagcacaagagagaatctcctggtctgccagttgctaagactgtgggcaaagcacagtattcgggtgggagtgtaccatttttcctggtacagtctgtcatggcttcccttggctaggaaagggaaatcccccgaccccttgcacttcccaggtgaggcgacacccaccctgccttgcttcggctcatcctccgttggctgcacccagtgtccaaccagttccagtgagatgaaccaggtacctcagttggaaatgaggaaatcacccatcttctgtgtagatcttgctgggagctgcagactagagctgttcctattcagccatcttggaagtgtgcatatgtgcctttttcatagaatgatttatattcctttatattataatccttgacccagtaatgagattgctgggtcaaacaacagttctaagttttttgacaaatctccaaactgctttccacagtggctgaactgatttacattcacactagcagtgtataaatattcccttttatcctcaacctcaccaacacctgttattttttaactttttagtgattagtcattctgactggtgtgaggtggtatctctgtgtggttttgatttgcttttctctaatgttcagtgatattgagcatttttccatatgcttgttggttttgtgtatgtcttcttttgagaagtgtccgttcatgtcctatgccgattttataatgaggctgtttgcttttacttgctgatttgtttgagttgcttatagattctgaatattagacctttgttggatgcatagtttttgagtattttctcccattctgtagtctatctgtttactctattgatagtttgttttgctgtgcaggagctctttaatttaattaggtctcacttgtctatttttgtttttcttgcagttgcttttagagacttcatcatgaaatctttgccaaggcctaatatgtccagaatagtatttcctaggtttttctcctagggtttaaatagttttaggtcttacatttaagtatttaatccattttgagttgatttttgtatatggtgaaaggaagggtacagtttcaatcttctgcatatggctagacagttatgccagcagcatttattgaatagggaatccttttcccattgcttgttattgtcagctttgtcaaagatcagatggttgtagatgtgtggcattatttctgcattctctattctgtttccttggtctatgtgtctgtttctgtaccagtaacatgctgttttgattactgtaaccctatagtttgaagtcaggtagtgtgatgcctctggctttgttctttttgcttaggattgccttgactattttgttctctttgtttctttcatataaatttagaatagctttttctaaatctgtgaaaattacattggtagtttaatggaaattgtatggaatctataaattgctttgggcaatatgcccattttaacaatattaatttctcctgtccatgagcatagactgtttttccatttgtttgtgtcatctctgatttctttcagtggtgttttataattttcattgtagagatctttcacctccctggtcaactgtattcctaactaatttttgtgtgtctgtggctattgtgaatttggctctcagcttggagttattggtgtatggaaatgttcctgagttttgtatattgattttgcatcctgaaactttactgaagttgtttatcagttctagaaattttgggacagagactaaggggttttctaggtatagaatcacatcatctgcaaagagagatagtttgacttcccctcttcctatcttgatgcctttaatttcttcctcttgacaaattactttggctagggcttcctagtatgtattttaaacaaagacatttgaagcaattaaatattttagtgttaatctttgcaaccattacttaatttgaaagaaacaacatttcactgtcttttctttaaaatagcatgagttagatggtaactgtattagccaaagttctccagaaaaacaaccaataggatgtgtatgtggtgtgtgtgagtgtgtgtgtgtgtgtgtgtgtgtgtagaaagagattataagaaattggctcacacagttatggatgctgtagttggcaatctggagacctaagagagctgatggtatagttgtagtccaagtccaagggcctgagaagcagaagagccaaatgtgtaaattacaatctgagtccaagtttgaaggcaggagatcaatgtctcagcctgaagacagttaggcagaaagaggagattctccctactctgccttttgttctaatcaggccttcaacagattggatgaggctcacccacattgggttgggcaatttacttttctccgtccaccaagtcaaatgttaatctcattcacaaacacctttataaacacacacagaataatgtttaactaaatatctgggcacccaatggcacaatcaagttgacacataaaattaaccaccatggtgactatcgcttatcgtgggataaataattccattgtatcctgtttacaacaagacttgaacatcagacatagtatatacttgcaaatcagggcaactaatacaacagaaagttttattgatttttagcatctttctgggagttacaaaacatcactagcattaaaagcctggatggggaaagaagtaagagtattctattcaacacagttttggaagtcctggccagaacaatcaggcaagagaaagaaatagaaggcatccagataggaaaagaataagtcaaactatccctgtttgcagatgacatgattctatacctagaaaaccccatagtctctgccaaaaaagctcattgaactaataagcaacgtcagcaaagtttcaggatacaaaataaacagacaaaaatcagtagcattcttaacccccaatgacattcaagccaagagccaaatcaggaatgagattccagtcacaattgccacaaaaagaataaaatacctagggatactgctaaccagaaagtgagagatctctacaatgaaaattacagagcactgttgaaagaattaagatactacagaagcaaatggaaaaacattctatgctcatggataaagagaatcaatattgttaaaatggccatactgcacaaagcaatttatagagtcaatgctattcctatcaaactaccaattacatttttcaaaaaaaataggaaaagctgttaaaaagttcatatggaactggcccggtgcggtggctcatgcctgtaatcccagcactttgggaggctgaggtgagtggatcatgaggtcaggagatcaagaccatcctggccaacatggtgaaaccccatctctactgaaaatacaaaaattagctgggtgtggtttcacgtgcctgttatcccagctactcaggaggctgaggtgggagaatcgcttgaaccggggaggtggaggttgcagtgagccgacatcgtgccactgcactccagcctggcaacagagtgagactccgtctaaaaaaaaaaaaaaaattcatatagaaccaaaaaagatcccaaatagtcaagatattcctaagcaagaataaagcaggaagcatcatgttacccaacttcaaattatattacagggctacaataaccaaaacagaatgatactggtacaaacacagacacatagaccaatggagcagaatagagagccccaaaataatgccacacatctacaacaaagctgacaataacaagccagggtgaaaaggactctctattcaataaatagtgcgggcataaacgtctagcaatatgcagaagattgaaacgggaccccttccttatactatatacaaaactcaactcaaaatggattaaagaattaaatggagaacctaaaactataaaaacctcggaagataacctaggaaatactattctggacatagaaactggcaaagatttcatgacaaagagaccaaaagcaattgcaacaaaagcaaaaattgacaaatgggatctaattaaactaaagaactttgacacagcacaagaaactatcaacataataaacagataaacagccaggcgcagtggctcatgcctgtaatcccagcagtttgggaggctgaggcaggcagatcacttgaggccagaagtttgagaccagcctggctaatatgttaaaaccccgtctctactaaaaataccaaaaatttagctcggcatggtggcacacgcctgtggtctcagctactcaggaggctgaggaacgagaatcacttgaacccaggaggcagaggttgcaattagccaagatggcgccactgcactccagcctgggtgacagagagagagtctgcctcaaaaaataaaaaataaataaataaatgaataaataaacatacaacctacagaataggagaaaatatttccaaactatgcatctgacaaaggtttaattccaggatctatcagcatctataaggaacttaaacaaatttacaatagaaaacaaccacatgaaaaagtgggcaaaggacatgaataaatacttttcaaaagaagacatacatgcagccaacaaacatatgaaaaagctcaatatcactaatcattagagaagtgtaaatcaaaaccacacagagataccatctcacaccagttagaatggctattatcaaaaagtcaaaaaataacaaatgctgcaaggctgcggagaaaagggaacatttatactctgctggtgggagtgtaaactagctcaaccatgctggaaagcagtgtggcaattcctcaaagacttaaaaatagaactaccgtttgacccagcaatcccattacccaaagaaatataaatcgttttaccataaagacacgtgcacgcatgtgttcattgcagcactattcacaatagcaaagacatggaatcaacataaaggcccatcaacagtagactggataaagaaatatagtacatatacaccatggaatactatgcagccataaaaagaatgagatcatttcttttgcaggaacatggatggaactagaggccattattcttagcaaactaacggaggaacagaaaaaccaaatattgcatgttctcacttataagtgggagctaaataatgaaaaccaatggacatagggaggggaacaacagacagtggggcctacttgaggtgggaggatgggaggagggaacagatcaggaaaaataactatcaggtaccagtcttagtagatggtgacaaaatcatctgtacaccaaacccctgtgaaacgaagtctacccatataacaaacctgcacatatattcctgaatctaaaataaaagttaaagaaaagaattaggagtatgtggcagtgaagggttaagtcttggttttgctaaggtcattggtgacagtaataattaataataatcatcatcatcatcttagcagttcccattgattgaagcttatgccaggcattatccaagttatgtttcttacgttactttgggcaagtatttttgagcctaatttttcttctctgataaaaccgagctattaataactacctaagtgcctcctccccaggcaaggaccaaatgagataagataggtgagcgtgctttaaaaattgtaaagtgctctacaaatgcagagtgtcatcattttccgttgaaatatcaacctgggaggaagcgagggaaggaggaggttttcattcctctctgtaagcctactgcagcaccctgtgatctcagaagtgctggaaacctgtatttggaagacaaaatgcatttctctggtgaaatgggaagggacaggtttcttattgcttccaacccttccagaatttgaattttcttccctttctgtggtcatcagttgtaattttatagaagctattgtgcttatcctgagggagtgataaggaaggaataatacctaccacagggggctgggccagaagtgaaaatgtataaacaataaacaagttatatttgtatctcaaataaagcattatttatttttttcaactttaaaatatactggtttgtgatatgataccaaaccacggaatgcagctcctaggaagacacaaaattgggagataaaaatttttctgctcttcagcttttggatcatttcaaatactattgatattctactcatgcctagacaccaaagggtgaatgtaattaaaatgcaatgagattgtgcgtgtcaaataaaaaatgttcttcacccatgtgtccctggtacttacgcgctatgtgtcaccctagagaggggaatcattgaaaatattgcactttatacagtgagactgagttaataaagcaagaaagactttcaagtaatagtggattcactctaaaatttaaggcatttaaagatcataggatgtggtgctccttccctgtttattataggggaataacacttgtctgtatactgggaagacctggattttgggggagctccatggaaaatttctttctctcccagatgtcataggaaatagcataactatctatttttttttctagaaacaaagattatgttgtaatatataagtaatctcacagtgtcagcctggaatgatgtttttaaagttttaaatgtcatcggtcagtgggtagtttctttctagattgcaatgggatctgtgaactctactatcctgggatcccagtttgagtctctgaaggtgctagaaacagtatttcaaagtcaggcaactgagttaatccaaactttaaactgttattccctgaggagatatgaactgggataagaaagggactaaaagagtgagtcccatcctcaaggttctgggagctgtgctctctgaccctgttgacctaggaaagttgtatcaaacgtctcaccatctcaccacttcgttaactcccactgttcaccacaaaccaggaagaacgggaagctcccctacattgtctttggcaaaatcaattatgtagatattaagaaactagttatgaattaaaaatgtaaaaagtgggcttgggcacagtagcttatgcctttaatcattgtactttggaaggcctgggaggatgaaattctgtctctacaaagaatgcaaaagttagctgggcatggtggtgtgaacctgcggaggctgaggtgggaggatctcctgagtatggaggtcgaggctgctgtgagccaagactgcactccagcctgggtgacagaatgagaccctctttcaaaataataataataataataataataataataataaaataataataaagtataaagtgtatatcttttgatttactgtttgcacttctaagagtttaccctaaggattaaatcaggaatacacaaaggattatgtcaaagtgggtgatgaaattttgtataatcctaaagaaaaaaagaaaaagagcataatatccatcaagagggaattgattaaataaattgtggttatgcacagattaaatgcaatgacatagaataatttatattttaattcattatcatttattaatatcaatattagtaaatacatattgttgactgaaaaacacattacagaaccatggaatcccatacaagagaagtgtgtgcttgggtgtgtataactgtactacagaaaggttaatcaccaaaatgtttgttaaggttcctctctgggttacagatatgtgatttttattttcttctttatgtgtaactgttttactagacattccataaagagcatgtggcattttgataatcaaaagctcattttattcagaaaaaaatgattctctcttcaaaacccacctaatctcttaattatttgctaaaatgaagcaagaattctttcacttagtaaaggatttactgctttgtgaagaagaggagtctatgaaactcgacagtgtgtatggcattagaaattacatgatttggcattatatgaaaaagatacctgcttacgtatgtttatcacagcacaattcacaatcgcaaagatatggagccaacctaagtgcccatgaactgatgagtggataaagaaaatgtggtgtatatgcaccatggatactactcagccatcaaaaacaacgaaataatgtcttttgcagcaacttggatggagctggaggccattatcctaagtgaagtaactcaggaatggaaaaccaaataccgcatgttctcacttataagtgggagctatgctatgggtatgcaaaggcatacagaggggtataatggacattggagactcagaatggggaagagtggaaggggggtgagggataaaaagctgttggatacagtgtacaatgctgtgttgggtgcatttaaatctctgatgacaccactatacaattcatctgtgtaaccaaaaaccacttgtacctccaaagctactgaaataaaaaaattattcaaagaaaatgacaagacttgggagtgaagactcaagcataagctgcaactttattattaccatgtcaaagtcatgtccattttcgcatctacaaaaggaaagtcataatcatcaccttactcaggccctgagaagttactaatactcggcattttatagcatttaaattgtcagtgcattgtattttcactatgtcctacaaggctcactggtggacagtagcatctgctctcctttaaaccatttttaaatttattttattttaatttttttaaagccaagtcttgctttttcacccaggctggagtactggggcatgatcacagctcactgcagcctcaaatacctgagctcaagcaatccttctgcctcagcctcccaagtagctaggactacaggtgcttaccatcatgcttggctaaattttttttttttttatagaggcatggtttcactatgctgcccaggccggtcttgaactcctggctcagcctcccagaaggcttgggattataggtacaagccatcacaaccagccccaatctcataagttagaagactattcttgatatgataaaatattcacagcatgtattgtaattgaaattggcaggctacgaggcaatgtataactataataaaaattataataggaacgatacataagagtatctattaggtatcccctatgacaggaactgtgctgagcatggggtatgtattttcttattcactccccaaagcaatcttagggcgtagggacttttttaatccccattttatagctgagcatgtcattttacagcgaatcataaatacttgtccaggatccagctgagattggaatccaggtgtgtttgaacccaaggtacagacttttaaccgccctggggtgtgagagtgtgtgtgtagataaaggcctgctcaaggaagaaggaggaggaaagagctgaggaggaagatgttgatgtatttttaattgtgcatcagtcttcctggtggtgacaggtctcttagtgtcatgaccagctctgccatttgcaacggtaggaattacagtctttcaaaatccgtttctggtcattgctgaacccaaatttacataaaaacaggcccttgaagtcaacctcttaagttttagaaaaagatattcctccctgaaattggagtgacatctccagtgaactatcctggcagcagagttgtcccctgcagctgaccagtggaggtcagccagcccccgccaggcagcggatgaacctcagccacctgtcggccacagcagctggaggacctccggaagcgatggctcctgaaggtgacctctgtgtgacacacaagcgtggtgaaatggaaacgtccatgttgatctagtgccatctgagaccccagtattaactgtgcacagtttcccagtcatcgtatcagcgtctcaccctctgtgaaagtctgtaacagcagttatcaatggatttcagctactatctccaagacatgtgacaaatgttgctcagatacaatgcactttccaagagatttacccaaattttgacccaaaatattttgaggggaagtagaggtctacaataatttgtgaatctccataataactattaaccatacagtagtaccaagttctcagtacattctgagccacaagagacaggtggtgggttatgagtaatttaagtttttaaagcatttcccaattctggttgtgctagctactcaagatgaatatcaggatgcagcacagttatattacagtggggacaaccttgaaacccttctaatttaaatttttaaagtacatttatttgccagttctactgttggaaacgttacagtggtgtccctatcatccgtgcgtttaagttatgcaaactcaaaatacattgctatagtgaaaatactgaaaaatttcatggtaatatatatccttttagagatatttacctatatatttatatgtatatatttatacttgcaattgtgtacagattgcatgtataaataatactgcatatttatgctgtgtgtgtactgtacttaatgggtaatttgaggaatttccaagggtaattttggctataactactttttgctttaagcaacatctgctctccccactcctgcccctcccattgtcaccaccaccacttcaaattgaaattccattgtgtttatgatatcttacttttgatacttctcatcagtggctgtaagatccacaaagtgctatcagctcgtggttaactctaaatattattcatgacgagttcaaggtagctgctgctttttcttggttcaaatttgtgaagcttgcgtcatcatctgttaatattgcatgcccatccccactgggtaccagacactgcattactctaaaaatatacttccttttccaccaggctttttgagtagtctgaaaactggtttaactgcatgcttttatttttggtgttggtggcaatggaaaatggggtatgataatagtttcactgacatcaagaaagcttgggtttgtttttcctgcacagaatagaattatctctgtaaaacatacatctgactttgtttctcttccatgcttaaaatccttcagcagctcccccttaagcacatgataaagtccaaacttcacgtccacatgacttacaaaactttgctttttctcccagcatgcctctcccttatatactcagtgtgttcaccacaacaaacccttgtattgctcataccagggtttttcacaactccaagcttttgtccctgctgtctccgttgtcagaaatgttgtcatggtctccactcccttagtgggtttatacaccttgaacaccatgctcaaatatcacttcctttgtactgccttctgtgacttcctgagccagacctggccatgccttttcttatatatatttggtatatttttatgcttctattgaggcagttatcaacctttaatgaaatgataaatttaaacgtccatctcctctattaggcagtgaacacaacaaaagcagaggtaatgctttatttacctttgcaatcccagtacctagcatggggattggaacccagtggttccgtatatgctgaatgagtgaagaaatgaatggcagacagagatacaatcttcgaaattaattcattgaggtgtttttgaccccagatccagatataaactgcagaagttcaatgaatttcctctaaaatgaatgctaaattgtgattgaatctctgtgtgtatacttgtgcatacatttatctgggaagctaatccatagccttcatcatattcccaaaggaatgtaggatgtattaaaggggatacaaatcactgacataattcaatctcctcaaaaaattaagatctccctttctcccgctgcatgacaaaaacaaccaaccaaccaaccaaacaaacaaacaaacaaacaaactaaaccaaggggaatgggggcttttgaaaggaatgagtaggcaggaatgtccctgaaagatgaggtctgcatgatagtcttgttttagtcctgaaggggacggcggagcccaaaatatcagtgctcagaaagatttggacctaactggcatgcaatgcaagcccggagcttagttcattcactcctttgtccattgtggaattatctaatgacaagagggatgtgggtggtaacaagtgaggtgccttcttctcccttcctgttgagtcattctccaaataatgttcagagtatgaggggaagtaacattagcttgaggattttttgttatttgaaatctgtaactaaataacagcactactcattgtggcttttcctttctttctggtttcataaatttcccttacattttcaactgggtgagttatttgccatttgctttcctaacctggtgtttgtgcagcatcactggcaaaagttaatatgtgcttcttgctgccccagggattcttgcagctctgtaatgatgaaattaatctataaatgtggtctctaaaagcacctctgggtctcaatctttgaatgaaaggcagagtggaatggaagggatctgttgctttcattatcattatctaaatggatgcaaatgcagcagattgaaaatgctcatccttaccagaaatgataagaatccaaagacctgctatttgcatgtttaattgcaatggcgcattgagagacagaattactgtgtgggggttatgggcacttcacaaacggtaattgtcctccacacttatttttgtcatcttgatgagtgttagaagatggctaggctttctaaacacttgcacgcttccaactagggaggatattttggcacattaggaaaacatggcatgaattcaagtgagctgagttacattagcccgtcttttctggttagttctggttaaatggtaactttccataaagtgccttccttttcctggcagtaacatttactgagcacaaagttgcatttcaggtacagaaccaagctctttacacacttctctcatttgactccaatatctgaggtagattctattactattttcattttacaaataggaaatccgacacagagagaaatctagtaacttagccaagtttacataggaaatgactaagtcaagatataaatgcttatttgtctgattcccaagccaaagttgttggtatgtgaaataactttttttctatcatcaaagctctcatttatcaaccattttttcatccattcatacatcagatatttattgagcaactactataggctagctattatgtgcagtaaaaaaatggaagcaaaacattgcccctgccttcaagtccatgcttgaaataaccaaaaatgaaattctgttgtttctttatacaagcatcaacagagcatcatttttgccaccttcctcctcatcaacatcatcatcatcagaattactttttactgagcctgagaaagttgtcagaaccaaaatggagtcgcttgtgtttaaaaaaacaaaaaacaaaaagccatgacaaatagaggcagggaaggctgtaaagagagggtcctcaaacttctgtgcctgataagaaaaactatcataaaagactctgcaaaaactgcaaccttgccaaaggccatcacaaccttgcacaaaaaagtacttctgtggagacatctgcccagcaactgcctgtccaacatcagactgatgtcactcttgttattgatctccgtagccaagaagaatcatttgaaaacaattatgtaatcctcctcatttttcctttaaaaccctttgtcttcctttacctccctgaatacacacaccatttactatggcatgcatattcccattgcaatgcctattcctaaatacatatcttttattttagagaggctctttctgtttatgttggttgacaagcccttaacatctgccaggtgctgtattgggcactatttacttctaacaaccttttgaggtaagtgtgatcatccccacaatatggctaaagaaaccacagctcacagagcttaaatgactttgcccatgccacccagctagtaagtggaagagccagcattgaagtccagggctgtctgattctaaagccacatattttaataacaatatcacccgaggattctgagaccactcaacaaaccaatgtcacttaaggattttttagagactactttaaaagcaatgtgaataaaatgcttaatgaagaaccaaagctatatgaactgagttctcagtccctgccagtactgtgctagaaactgtccatgtatgctctcattcaagtatctccatagcctccatagatcttgttagttctattttgcaggtgaggaatctgaggctcagaaagaggaagtaacttgcccaaggtcacacacagtggaggcaatatttaagtccagatctgcttgattttaaagccctatattttactaacaacatcacccagagcgttcctagggaaaatgctcattttcagaaaaaaatccagaaaatgcttaccaaatagcaacccctaagttagttgcctaaaggatacaggctgctgggtaggcttcatcttaacaagggtttcccttccccagacccatgcaacattatttttctcctattttaaaaaaactcttttttcccccttcttgcttggtaggaggacggggtgtgtgtgtgtgtgtgtgtgtgtgcatttgcggaatggaacaataaaaaggagagagacatgcatagagataaacggattgcagagaactcaggagatccaagttgatctaaaggccctggggtctggcttcttgcaatctctctttacctgttgataacagctcacttctggataagtcagcagggggttgggggtggggagtcatttttaaggagaaggagagcctctgtattagttaaatccttttaacatatatagtaaaagggaaagaatcccaccactcacaattttccctggaatgttgctgggttttggattctgattcagcttcagaaggctgggatcccacagagcattagaaggactggtgtgataagaacaagatcatctattaagcacctattacatactggtgtgatgctgaggactttgcattcattacatctgctacggtttgaatgtagtgtccccttcaaaattcatgctgaaacttaatccccattgtggtggtattaagagttggacccttttaggaggtgattgagtcataagggtggagccctcatgaacgcccttataaaagaagctttagagagagtttgcctctcttgttcttctgccttcggccactgaggacacagcatcaaggtgccatcttgaaagcagagagcaaccctcaccagacagcaatgccagtgcctcaatctggtacttccatcctctagaactgtgagaaacaaattttgattcttaataaattcctcagtccttggcattttgttataataatgcgaatggactaagacaacctcatatgactctttcacctaccctgcaaatgaggcagttgtatgcccttttgataaggctaggaaattgtgggttcagagagacaaaacttttcccaagagacacataatgttctctaagattgtacagccagtatgacatagacctgggattcaaatctaagattagattttaagtgcaatttatgtgtctcttcagtggccaaatatctgcacttgcttcttctggttaaacataatttgctgtctgacatccttatctcagccactgacccctgagtcatctcccttctctatcccctttctcactgccaacatgtaatgggcttgcaagatggaatgcctcccctactacctgtcccttctagggaatccctacccttaaatattctttatgcaggaattcaaaactacatgttgaccagataatcccaatcatggattgggaatagacagttcatctaagagtagccaaccaatagcaggctggcaacctgtggggtgagctactgtgaagcctcatgcattgccatgtgctgtggctcaggcctataattccagttactcaggaggctgaggtagaaatgcttgagcccaggagttcaaggctgcagtgacctatgatcatcccactgctctccagcctgggcaacagagcaagacccaactctttaaaaaaaaaaaaaaaggccaggtgcagtgactcatgcctgtaatcccagcactttgcgaggccgaggtaggtggatcacctgaggtcaggagtttgagaccagcctgaccaacatggtgaaaccctgtctctaccaaaaatacaaaaattagctgggcatggtgggacgcaactgtagtcccagcttctccggatgctgaggcaggagaatcgcttgaaccccggaggtggaggttgcactgagccgaaattgtgccactgcattccagcctgggcaacagagtgagaccctatcttaaaaaaaaaaaaaaaagaaagtttgatgtaggcagatatgatggttactaataagtttcattctctttcttttactttctaccccaccccatccctagggattcaaatgatatgaaatagtaagatacagagatggtgttgctagtcacttttaggaacagaaacacaaagatgtccagagaaaggccataaagaatttggggtcatgaggaaagcaaaggtatgagttagcagaggctatggaatgatgggcatagaaggaagttcagtataacagcaagagatccatctgtttccgttgctgatggtacagctgactgccttaaatcctaaataagctgtccatgacacctgagaaatcctatcccaacactgggattcctactcttttggtgcttacctttactttcacttaaatctgattacttggagtaatatgttgagtttgtgggattatccatgattgcattcacagatctaaacagacagtggaacctaaagaaaaaaaaaatccagggcaaaaggaaggtgactcccaacttgagaaaaatttttattttttccattcagctctattcagaatgctaaaacataaatataaatctagatagagaaacatttcctaacgttaagttaaacagatccctggagttgacagagaacattaacctactccaaatctttacctaatccattaatctcacataaacacccaacaagtcttcttgtctgtgtttgaatacttcaccaatgaggatctccctcttgtgctataattgccaggaggtttcaatacctaaaacttttgcctaacaagcaactaagataaaaacaacataacacagaataacatatttctaacacttccaaacgacaaatatttctttattgtgcttggcatgagagtgagcaagacaggtggaaatcctgtctttctggggtttacatcagccttttcaaatttttattttgaaaaattttgaacatacagaatagtagagagaatagtgtgatgaacacttatgttccattatccaattcaacaattaagaatgcacagctctttctgtttcatttttatgccttttcccctaagtctccctaccaccctgctgaattattttaagataaatcccaggtgtcatatcatttcggcatgtgtttctaacagataatgactcttttttcttcatgtaaccacaatattgttattcacacttgaaaacatttaacagtgattttttaatatcatctaatttccagtcagtttttttcttcaaatttttctttttgtattaaaaatatctttttacagttggtttgtttggagttttacattacaatgaaacatgctctttgaacaaaaacacagctaaatcttgatattttattccatatatgtagttaaacctacctggaagactaccgattctataaaatgtatagatttaaacaaaaccagtagctattttttttcctctactttcagaagcttatcttctagaggattttttattttttatttatttttatttatttatttattttttgaggcggagtctcgctctgttgcccaggctgtagtacagtggcctgatcttggctcactgtaagctccgcctcccaggttcacgccattctcctgcctcagcctcccgagtagctgggactacaggcacctgccagcacgcccggctaatttttgtatttttagtagagacagggtttcaccgtattagcctggatggtctctatctcctgacctcgtgatccgcctgcctaggcctcccaaagtgttggaattacaggcatgagccactgtgcctggccatcttctagatatttttataagcttgatattagacatcactcttctgttttctccaaaatgattttcctcttttttatcacgtggctttctttgttaatgaagcacagatcatgtttgcaatgtgataattctgctccttggaaagcctattattctgaaggcctaacatcctcagaaaacattcactgaaagcccactagaataacagaatgtagggctattgatccagcagtcctacttctaggactgaatacagaagaaaatatgagagcagaaataaatgttatattttatattatataatcatataagttgtttaaaaagtttcactgttatagataactgtaagagaaacatcattatatataatatgtatattattatcgtgctatattgtacattaaacatataatttataaattaaatctaatgacatatttatatcttatgcagaatgatgtctataccattgtttatttataacattgaaatttttaaagtccattgaatggaattggttaaataaattaaggctaacctccataatgaaatactacaaagcgattaaaaattatcatggaaatatttgtatcaatatggaaagataaactattttaggtgaaaatattaggctatgaaacagtatgtagcattgttatgcaagatctccaagttgtattaattttaaaaggtgcaaaagacctaaaaactatatatatatatacacacacatatatatatgcacacacacatacacacacacagacataaagtgatcccatttgtaattactccacgtattccctgacactcaaatgtacatatacatgaatagaatagcccggatgactacatgccaaaatgttagcagtgattctttctgggtaataggtttgcttgaatacatatttcttaaaatgtctgtgttttctgaatattttaataagtatatattattttatatcataaaacttttatgttcttaatgttaggttagaaaaagttactggcttaaggttacagatagttcatttcaaagcaagacccaagctctcccttgagaatcatgttatttgtttctcctccacttaaggctgtttcctggcaaaatgtttctcagttgctgtgtaaataggttttggttatgcctgtcctacaaagtgtctaagcttggaccagacacacctgaatcacagcattggcccaagctgggaccaccacaggcaagacatacacacaggcaagacatgtgcaacagttatcaaaggcattgagaggacagaataatggtcagtgtcaaggtcattgtgtgaagctgcacaggttgagctctgcacatctcctgaggttgaggggaccatttacattagaaactatgaaagtttctgtgcacaatgtttccctgaaaatgtataatgcccaatctgtacaactgtgccaccaagtcctgaattccactagggcaagaggaaacttcatggaaaggaagtcaccttgaggtcgacatttcaatacaactcaattctgagtgatttagtaacattacatcattgtgctaatatttaatggtttttgtttgtttgtttgagatggagtctcactctgttgcccctgctggagtgcagtggcatgatttctgctcactgcgacctcagcctcctgtgttcaactgattctcctgcctcagcctcccaagtagctagaactacaggcacgtgccaccatacccagctaatttttgtacttttagtagagacggggtttcaccatgttggtcaggtggtattgagctcctgacctcaagttatcttcctgcctcagcctctcaaagtgctgggattacaggcatgagtcaccatgcccagccccaataaatttttataacacctacagtgaatgtatgtaagaccaaaaactatagcaattaaagatgttgagactcttctcagaaatcaaagaaattctcttaactgaaaaaacatcttcaatgagccttcagtgtactcttgtgcatattaggtttatctgtgtttaaattaatcagattttctcaaagtaattcctgaataatatgaaactgattgcatatacagtgatgaaaatgtctttcctacattggctgacatgaatcagctttttctttcacttcattgcttaagataattacttgtatttgtgaagaatgcctctcttacttagacatttccaaggcagaacttcaaaatgggtatgatagaattacccccaagtttcacacagaacattaggatttattcagtttaaattaagaagtctgactcaacatttattttttaaaaaaatggaaatccctgccctttccacttttctttctctttctttttgttttccatttctttttttccttcctggtttaaattcagcatggcaggtgaacaattttataagtactgtattaggggtactgagagccaagtttctcagtgccagagaagacaattacaaatgtggaaagaagaaggctagaaaaatcccagtagtgttggattggaatcgtagatggcagtatcaactcatggttttataaaatctatatgcaggggaacacagtacttacaaatatctgtttatgtatgtatgtcaatacatacaaatattttcaaactctgtctattgcgagagccaagaaacaatgacagcccagtagctacaagcacattcaacactcagatcttggtttctaaataccgtctattcaccaagtacttctcagagaaatggctagttccagggttggggcaggcaaagcgcaatatgaatgtgaaacatcattttgtgtcagaatgtaaggaaatgctcatgaataatgcattacaatatgtaatagctagcttgaagcagcccccagttgccaattagagaagattttgaacatcaaaataaataagatagtaaagtattacccattaaataaaataagaattcatgattctatactaacatgatttatacatatatagataaataacaaatggagaaatagagatggtaggttcaggtgggattcatcaatggatgttcatgctggtaagtggagatctgataagaaatggaatttgggtgtaattatcaaaaatctcccctataaaatactaatcaattacaaagggaaaattggtgaaggtaaggtggcaaaacagtagacagtaatttgaccaggctttcaaggttagcatcatcagtgaggagacaaagcaacatcacacacctccctttgtgatgtgcagagaagagcacagcttcatttctgggtgttcctgctgagaatatatgaccagcatatgatcatgaggaaacattggtgaacccagagggaaggtcactctccagaatgaaaagcctctcctctttaaaagtgtaaagtacacacgggaaagacagagggactgttccagattagagaagttcaaaacggcatgataactactaaatgcaaaacatatccctggacaagaaaggaaaagctggcaaaatttgaaagggatctgtgcattggatctgtgttgtgccaattggaaggattggatgctggttttgtaagaccacgtccttgtttcctggaaacagacactggaatgcttaggaatgatggaacataacgtctagcttgctctcaaaaagatccagaaaaatgataatgaatacttatagagagcatgggagatggagtcaaggcaacaccttaacaattagggaatccaagagaaagagattcagggcattttcgtactgttctggcaacttttccttaagtttgcaattattgtttttaaaaggttttttttaacacacttaaataagtggggaaactgcaagtggtttttacataatataaaaaacataaaacaaataccagtattatctcccacttattaagtgccaggcgctgtaggtaccttatctcttacccttagaggagccatctggagagatattattgtcccctcttgaaagaggagataacaggctgatagcgatgaagttatttccctaaagtcactctgtacgttaggggcagagaccagattcaaacctgggcaatctgattccaaagcccacactcccagccaccatgccatgttgcctctgtgcggaatgatccaaaaggccatggcattattagtattatgattaaacacttcttatggaccagacaccatgttattcactctttggtgcattctgtcttccaagctcgcaactctgtgaagacagcagctgtgttacctccattttacacttgagagactggggctaagaaaagtgtggttcacacagctggaaagtgtgggagctggcgtgtggaatccagttctgtcattacaccaagaagagagaaacttcctgttgaacggtgagagtgcgaaaggcacagaggggccatttacaagttttaaaccccaggctttgggactctgctaaatctaaattgccttgattaagttgccttggtaaatatacacgacagacatgcccttatgcacagtgcacacagtgcctatgacccaggacacatttaggagcccctgaaaacgttataattccttttaaaatcagattacaaaatcaatataatccagcttggattatatttgtcttaacaccagagtagtgatgaaacataatctttaattttttttatggaggaaggagctcatgaaggcaaaagtgtctagggccgatgaaagttacaatgtagccctgcaagtgtatttttatacagatctgagattgtgaaaatgtgtcttggtcaggatactcacaagccacactcagcaaatgaacaactccggattacggatagcctcactcaggacagattgcactatttaagatctactgcaagggggaaattgtaactgtattgacttcatgaagttaacaaggattagccatggtgaaaaaaatattcagtccacagagagaaaatattaaagtcatatctcaaagcagcaacgagataaaggcagtaatgggcttgtgatttggcggatgtccttttattgtgtttttgctgtcatgagctattctcctagagatctttttgtgtttgcgcttgacaatattgagaggtgacaacgtgctggcggccatcactagctctcagcacctcccaggcctcggtgtccactctggccaggcttgaggagcccttcagcccgccgctgcactgtgggagcccctccctgggctggctgaggctggagctggctcactctgcttacggggaggtgtggagacagaggcgcaggcgggaaccggggctgctcagggcgctagcaggccagcgcaagttccgggtgggcatgggctcagcgggcccagcactcgaagcagctggccagcgctgcaatccccagcagtgaggggcttagcacccggcccggcagctgcggagggggcgccgggtcctccagcactgccagcccgcccgcgaggctctcgaattctcatcgggcctcagccgcctccccgcggggcgagccttcccgacaggcggcgcctgctgctccgctgtgcccagtgccatgaatcgcccaagggctgaggagtgcagccgcgcagcgcggggggactggtgggcagctccgcccgcggctctggcacgcgatccaccaggcgaagccagctgggctccggagtagggtggggacttggagaacttttatgtccagcgggagattgtaaatacactaaccagcactctgtgtctagctcagggattgtaaacgcaccaatcagcaccctgtcaaaatggaccaatcagctctctgtaaaatgggccaatcatcaggatgtgggtggggtccgataagggaataaaagcaggctccccgagccagcagtagcaacctgcttgggtcctctttcacactgtggaagcgttgttcttttgctttttgcaataaaccttgctgttgcttactattcgggtttgcactgcctttgtgagctgtaacactcactgtgaaggtctgcagtttcagtcctgaggtcagcgagaccacgaacccaccggcaggagtgaacacactccggaaaggaggaatgaacaactccagacgtgccgccttaatagctgtaatgctcaccgcgaaggtctgcagcttcacttctgaagccagcgagaccgtgaacccaccagaaggaagaaactcggaacacgactgaacatcagaaggagcaaattccagacacaccatctttgagaactgttaacactcaccgcgagggtccgtggcttcactcttgaagtcagtgagatcaagaacccaccaattccagacacaatatcatgttaatgtcacaattttataagattctactagtcagcaattgaaaacctggtcacatgaaaaaagatgaggattttttttttctttttaattctatggtgttttctatcagctagagtacattttactttgaatcaagggaaactcaaactattttaagccgaaaaggaagttattgaataatgcaactcaaaagaccaagaccagtctgtctttaggcaaggcttattcagggttcaaacaaagtgaccaggacctagttcctttccgtatgtcactgtgacattgtcttttgtgtatcactttccttctctgcctacatgtgatggcaagacggtgacgatagtttcaaatctcaaggaaaagaaagatgtttttctaacattcccataaaactcttaggattcattggaccaaccagcttggaaaacatgcccacccttaatcactgtggccagtgctcattggcagaggcccgggctataaattctgccccaggctaagatatagtgagagttgaatccctcaatgaaaagtaagggtgtgtaaaagctatcaagaaaacaaacaaaaaaacccccaaagtctctatgtgctcccagaactatgacttcagtctctactgagaaatcctgagatatataagaggtggtctgggctgggcacagtgtgtcatgcctacagttccagcgtttgggaggctgaggctagcggatcccttgaggccaggagttcaagactaggctggccaacatagcaaaatccctttctactgaaaatacaaaaattagccaggcgtggtggcacattcctgaaatcccagctactcgggaggctgaggcatgagaattgcttgaacctgggatgcggaggttgtagtgagctgagattgcactccagcctggatgatagagaaaaactccttctccataaaagaggtatcctgggctgggctgggcttgatggctcaaccctgtaatcccagcattctgggaggccaaggtgggaggattacttaaccaggagtttgagactagcctcggcaacctagaaagactctgcctctacaaaaaataaaacaaaataattagccagttgtggtggtgaacgcctgttgtcccagctactcaggaggcttgagtccaggagttcaaggctgcagtgagctgtgatcaccactgcactccagcctgggcaacagaatgagaccctgtatctaaaaaaagaaaaaagagatggtctggcttagtattaggaacacagcctctagaattagagcacctggctcattcccttacatgttaggcccagagaattctgtgcccaacatcacaaagccaagaatgtgggagagtcatggactcagacccagaccactgtactactggcagacactggctggcaaaaatcctactcttcaaacttccctccctcccactgcccgacctccagcagtttacattttcactgtttctggtttatttactaggtcagttgttctatgaaaacaaaacaacatgaagttttgtaatgtagtgtcaattcttctggtttgaaaaaaaattctcccccatagcgttcagaccaacaacgtgagctttcatggaacccgtatatgaaaagagctgaatccattattttttcttcttttctcattagcccatcactctgataagaaaaagcaaactaattaaataaactccatgagctttctgatagaaaccaggagacatcaaagtctttcatggatggtactaggtaggtctaagaagtcaccttatgtcaatatcattccattatttcccaaacatcatcattactgagcatgaatgcaggaaaatgggattaacttccacaaaaactccctaactgttatgtatctaagtatatgggcaatgtttatttgtttgttcgtttaacatatcctgcctaatgaaattcttctcaatgctgcttttttgggaattaagctggtggctctccctggctttaggtcacatgcttcttttcctcaagtgcaaagaagtgatggttataatggttactacaagggacagtcctttccaactggcttgccctagttgccttttgttctgaaggtttgtacaaaggtatccacccacatctgggcaggattcttcattcactcaggattttgaaactaaaatctgaatataactctgggttctcttagaaagttcccgatcaggagagcgagatacgaatggaaacctctgctaatccttagtccctcttttttacagatccataccccacttcaaaatgtctttttttcccctcctattttcttctggtaactaattagatattcacttgaaatctccctttaaaaaaaaattagataactttgtccgggagttttctgaattcaaatccagcccatctctccacatcaaacatatcccatttgagtgatatttccgggctcatatttgttttctccttagaggctttaagctccccgaggatgagaccttgtccagcttccttccaggacccacaaaaatatgtcatacttttaaggcccccaataaagactgggtcagttcctctttatagtaagtaaagagttaaaaacacagactgaaaactcctcaaggggttttgttatttctagactttgtatctttattttgctatttacacatacaggatttttagtacagaatatcttatgatacaagttacacataaaaggcattgttattccttctgcactctgaatctctcttttctggaatctgtagcacaatgttcaattagaattagaggcaaattaatatatcaaatacggttctaaagcacgagcaattgttgttactacattatacaagtccacatgtatgcgctgagaaccttcatgtccctggcactgttggacagcctgtgggaataagatgggaggacggaagggcaatttctattttcaagagtttggaatgttaaggaaatccaaggtcatgtctttttcatagaaaacctataggacctttttgcattaagttatggaagctgcccctgagggtaagcttggattagtgattcctagacatttgtgtgtttggacaatttatgatgctacccatatttgaggtctgacatgaggctgtcaataaagacactagaaacacacatacctgctgcttattatgataattatttcataaaagtaaggacatcttagtattttttgaaaaaagataaagtacaatgctttcaatggattaaattctgatttataaaaaaaatcatgctgtatgtagttttttccccctaattcactgggaagtgacagaaattctgctaccaatctcaccctgggagtcactgtgcagtaattgtgagggctgtccaagtgtgaagtgcttatttgtattatgtctaagggagacagtgagtaagtggcttggcagctgcagggatgttaatcaagatctagcaggctcaggagctttctgtctgctccccagagcccgtttcatagcaaacatcggggtatttatttgcctctggttcctgggaaacgaggacacattgcaggaaggaggtttagctggctgtcacctgcccatgggcaccctaggaagtttgctgggtgtggaaaggaaatagtgtgaattgcaggaagcataaatccgatagtgctctagggtgggatcatgagctctgggcttccccaggttttgacacagccttcacttcaatttcattcctgggcagagggagtagccagaaataggcagtaagaccccatatgttacacaattgtaagctgatattccatgtctcacactaatattgtctgccctggtggagacatggagcaggaaggattgattctggtgtgctatggcctcaagtgaggcctaatgaaataacaaaaccccttgaggagttttcagtctgtgtttttaactctttacttactctgaagatgaactgacccaatctctattgggggccttaaaagtatgacatgtttttatgggtcctggaaggaagctggacaaggtcttatcctcagggagcttaaagcctctaaggagaaaacaagtgaggagctcaggacaccggaaagctttctgtacgtttgctagaccctttggaaggtttcagacccagagttttctaggtcagccacacatgcacatactgcacctcagggtggaggtgacctaggcagacctggaatcaggaaatggggttattctttccacattattttttactgctgaagaggaactgaagagaagaagcagaactgaaggtgccatgaatgtatatgagcgggacactgtccaagagaaatagaaggggggccatatataattttcagtgttatagcagctacattaaacaaagtaacgagaaacagagaaacagacagaatgaaattaatttcaataattttaataatactatatattaatgtatcataatattaatatgcattaatataataccaatatattataatacaaaatatattaaaatgatctttcatcatgtaatcaatacaaaaattattaatgagatttgtgcattttttttggtatcaagtctttgaaatccagagcatatgacacagcacatctcaattcagacaagccacatttcaagtgcttagtagctacatgtggcaagtgactatcatattggactgtatggatctagatgctaaaaatcacattttttttattttaaggattttattttttacttagtatcaaagcagaaaaatgttcaaaataaaataaaatttaaaactaagttatgaaacagtactaaatttttgcttttattttttaatatgtggattatatatagataaaagttgagttacttgtcaagatgaaaacagtagttgcccatgagaggtttggttaaagtagattttttcttttaatttttttcttaattttctatatattcattttttctgcaatgaacatgtaatatttgaataatggagaagtaatacatacattatttattttcatcaaataatccaaagcaaatatgacaaagtgttgacattgttagttctgaatgatgactagattagatatttagtgtagtattcattatgcatacactattttaaaatttttctctcatacaaaattaaaacctttttaaaatttgcatatgttcattgaagacaaatttagaaaatacaaataaaaatagaaaaagttaatgcatgattttgtgagagcatatatagtacgtatatttttgttattttatttattttattttattttattattttattttattttagacggagtcttgctctgtcgcccaggctggagtgcagtggtgtgatcttggctcactgcatcctccacctcctgggtccaagcagttctcctgtctcagccttccgtgtagctgggattataggcacaccactcccagttcatttttgtatttttagtagagatggggtttcaccatattggtcaggctggactccaactcctgacctcaagtgattcatccgtctcagcctctcaaagtgctgggattacaggcgtgagccaccacacccaggccgtatttttatttttaaaataaatatagaatagtacaaggtttcattctgatttttttttactttagtttttctcatttactggaagttggcacttctactgatacagcatcatcttaatgattctgtagtagacagcagcccagcaggggatgcctcataaaggagttgtaggactggattttatgcctgcactgcacaggtttaaatcctagttctgccactttccagctacataacgatggaaaaattacatatgtacctcagttgtttgttgtatttttattttgtttttttaaatctgtaagatggggcaaataatagtatgcaccttagaggttttaatgtttgtaaagtacctagaataatgcttggcacaaagttaatcctatgtaagtgtttcaaaaataatcctagaagtcattctctgtagagttgaatctaccttacttggaaccaacttattatcataacactgagtaacctaatgttcaattctttaaccgtttgatgaagtaataaagaataatttcagtacattttaaattatttattttaaccagttcatggagatgtttactttctaactaaagattatgaaactcctctcactccagtgaccttaacttctcatctgtgcctttcactagcatttcccaagatatgttctaaggaacactggttctgcctgtcaatacaggcaataactgaaaaacgaagaggggcttccaggttacatttcggaaattcttgattaaacgggttataatggggtatattttgtgcaggcctttaacatgcaagtctgcattgacaacttccagcaaagggcatattatgaagttgtcccatcttttcttttctcagcacactagggacttgtgttctacccaatatactttggggaacactacttgatactttgaacaacaatttcagtagtacaatgctttgttaatggagggctcatgttattcaaattcctggtaatctcagactcaggcaaaaaagtttttggttcacttgtttctataattgtttctggaatatctttcccaatggtttcttcttcagaatataatgaattttctatttgtcttgtggcctctgggccttcctacctgaggattgtgcaacatgggttcatagtcaagtagcaagaggtacagatgagggtgaggtgaaactgcaagagccccaaggcgttttctgaaaattgttacatgcgttagttttctatgctgtataacaaattaccaatttagccacttaaaacaacatgctttgtctgggggcagtggttcatgcctgtaatcccagcactttgggaggccgagatgggctgatcatgaggtcaggagtttgagaccatcctggccaacatggaaacccccatctctaataaaaatacaaaaattagctgggtgtggtagcagatgcctgtaatcccagctacctgggaggctgaggtaggagaattgcttgaacccagggggcggaggttgcagtgagtggagattgcaccacggcactccagtgcccacaaacaaaaaaacccaccatgctttattatctcagtttctgtgtgtcataatctgagcatggcttaactggtttggagttaagcaatggaggggttggctggggctgaggtgtcatcagaggctcaagtgggaaagaaatggcttccaagctgtgaaggttgttggcagtactcattattactcagctgtaaaaattatggcagtgtccttcttcaaaggacaagctctccccattttactaggacagattcttatgtaataaaacattatcacaaagttgacatctcattactgttgccatatttattggttagaaacaagtcacacatcctggatttgctaaaggagaggaaattatataaggtatggagcattgggagtcactgtgaggcgtgtctgtcactgtacattttctaaaatcctgaatgggacattgttttctttggcagagctaatggttgcattccagttaatccagttatttctttagtcatttgtatcaacagatacattctagttttgtttttttttaaacgtgccctctttctgaatctatcgtatctctttgactagattttaaaactaaaaggtaaggataacatctctgtgtattcttcatagctactagtgtggatctcaaagtaggcttttactaaatggttgttgcacacatgaatgaagcttttggcctatgttagttcaccccttccaagctgagtgatctctggcaaattgtttaattattgtaaatctcagtttctttaactataaaatgggaataatcatactccatgaagaaatcttgtaaaagagtaatttgaacactgtcactcctctgtcctctgctttaaatcttcaatgtctccccatgcacttgtagttggttcagattcctcaattttggcctctaggccctacatgatctggcctctgcccctctctctaaccccatctcctgtcactgtcacccactcaatagggtgggccacagagaaccccttaacttgcctaattatccccagttccttcctgccttggtgcctttgcatttgctgttcctcagcctagaatgttcttctcccagatcatatcaccaatttctcattctttttttttttttttgaaacaagttcttgctctgtcgtccaggctggagtgcaattgctagatcatggctcactgtacccttgacctccctgggtcaagtgatcctcccaagtagctgggaccacaggcatgcgccaccatgtccagctaatttttggtagagtctgggttttgccctgttgcccaggctggtctcgaactcctaggctcaagcaatctgcctgccttcacctcccaaagtgctgggattacaccacatctggccatttctctttcgcattatcattcaggattcacctcagaagtcaacaactctaaaaggctcagccagaccacctccatttgcctgtgcaattcattacccttctttattttctttataacaatgatcacttctgaaacttgtactatttgtatatatgtttcttgtgtgcctgtccttgccagaatgcaagcttcatagaggcaaggacttggcttcctttccactggatcctcaattcctagcacaggacctgagatatttgttaaataaaatagtgttattttgtaatatatatgtaaatatatgtatatattatgtataaaagcacagttcatgagacataatttaaaatagacagacatataaacagaaggtggtatgaaaaataagtaggaatagttttatattcaggataagtaaaactggggttctagccagaactggtaaactctaaatttcttcttctaaccacttgaatatttttttcgttgatcagtactcggttatcaggaaaggaagataccaggcaaatagattgtaatttagtgcctggcacacatgaataaaagcaaaatctaatgatattggaaattcatgaggcaaaaagaagtgatgaatcaccaccgttccatccataattttttttttttaagagatagggtctccctatggtgcccactggtctcgaactattggccttaagcaatctgcctgctttggcctaccgaagtgcttagattacaagtgtgagccaccacacccggtcattttttttaatgatttttagtgatgcaaattcatttctattaccttaatctataattatgattgatttattgaaataaacccactgggatttttagaaaagcaattcaaaataatcatttaattttgcttttccaaaggactgaaacaattagtgtcagctgcagtgtgcacttataagaagtgaagagtgcctatatttttgcatatatttgctatggcttttgaaaacaacttttgggaagatggatgaggggaaggaaggtagaaactagcaaaactctttgtcagacattgccatctgctggtatattcccaaaatgcaaccctggactcatttcttgtcaaaaatataatttaggtgttccaaattcctctgttattcaaattcatgtaaaatctgggattcagattcaaattatgtttgaaaattaatgtattataagtaaaatttcaaggtattagaacaactgaatgaacggtttctctattgtgctgaaaaaattccaattccagatttttaaaaaatcctcattaaaaaagatcatcgttatcgtttaatcgtctgcatgggaataaagcagcaaattaaagagcctggagctctaccctctctgcagtttactagattagggctaaattagcttaatttgcttggtcaagtgcccatcacagcactctcccttcactccatgtggagctaataagaactgacaagtctaaaatatgagacttgcctttgctcagcactaacccagagcctgatgctgaccatagcctttagtgtgtcctagtctgcatctactgcagacatggtcggcagcagcacaggacttggctggtgttcaggccacagagaactgtgaagggagctgactgttcctgtgatgatgggtcacagcacaacagcaaagggagttgactgttcctgtgatgatgggtccacagatggggaggcaaagccgggaattgtacctgatggccatgctggctgcccttctatgggataagccccagccaaacgggttggcgtgaatattctggactggacttttcccgatttcagatcttccctgagttggaaagcaaatgcactttccccagggttaatggggttttactaacagctgtgatgatcttccttaaagttagcatcctgcagtctttacaagagcttgctttctattttaatttaagtgtgtgtgggtttcaattgactgtcaccgcttgggatgccatagggtgttcgatggagtctacttaaacagatgtgagttccaacatacctagctccttatcagttaggtgaccccatgcaagctactgatggtggtgaccctgagttttgtactcaagatttaacttcaagttcatatataacctcatgtgtggacttaggaagttcatgaacacccccttgaaagtatatgggttgtgtatgagtttgtatcatgtggttatacacatttttgttcctaaggcatccctaagctttcatcagatttctaaagtggcctataacttctctccatgctcccaaaaagttcagactttctgtgattctgctattaaatgatgatactaatggcatagaattcacaggggttgttgtgaggataatttaaagtgggtaaaaaatcacaggcagtgtgcctgatacctgtaaatattagtttagatgagggtatcagagcagaggtcaaaactattactaaacttaagagccacagtaagtgtaatttggacttgctgtgaatgaacttattgggaatcacttaatgactagcagcacccttgtgacccactgcagtgtaattccttcaattggtctgatgatgttattggtattatcctcactgggcctgattttcctgaagggaactgagctgtgtgaccttcgatgagttcagatttttaccaacaatcttcgattatcaaaagcagaagaaaatgcttctgtgtgaaatcaaaggctttcaggtaaatataagggtttagagagtacatcttctattatgtacttagtgaggaaattagataatgttaaggtagatgcttgataaacattcattcccattcactatttttttattttttattatttatttattttattttttaacacaaggtctcattctgttgcccgggctagagtgcagtggcacaatctcagctcactgcaccctccacctcctgggctcaagcaatcctcctgcctcagccccccaagtagctgggactacaggtgtgaaccactacacccagctaatttttgtgttttttgtagagacagggtttcaccatgttgcccaggatagccttgaactcatgagctcaaaagcgatctgcccgccttggcctcccaaagtgctgggattacagtcatgagccaccatgcctggccctcattctctatttaggaaaaatggtttcataagagaaatccagcccctactaaatttatcaagttttatttgatggctaatgttgaaaattctgtttcattactcagggaaagcaagtattaaggagtgaaaaaggcattgacttggaaatccaaaacacctgattttaagtttcatttactagggatgatcttgagatatggttttggagaagactccaattcttcatctatgaaatgtggattttaaattccacattattaaaagagtcactgaaataaccaagcacgtgggaatactcaacagatggcaactagatatgtgaagtaagagagttcctgccctcacagcactcacaatcttgagagaggagaaaggaatatgtcaaatacttgccagattgtcccctcgagaaacatggggcatttatcaacccatccagaccccagggccattaactcctagcaggatgagaggtccacacacagtcagggagacagcactgacacagaaagaaggaggaggaggtgcaagcttggggcaggatgctgcaagcacaaagcaaggttgagggcacaaaaggtccacttcagcttcggctgaagtcagacgtgggcttagggggtgggaagcagggcatgataggtttctgctacattggggtgggcatatttcgtaaagagtggccacagatggattcctgaaggaggagatcttttcttttcctgtttttttgtttgtttgtttgttttttgagacaggatctcattatgttgctcaggctagccttgaactcctgacctcaagtgatgctcctgccttagcctcccaaggagctgggattataggcctgcaccacctttaaacagtgatctgggtgctaagaagggaccacttttgtaagacgcatgcaaaagagttccacgcagaggaaacagcaaaaggaaagtgcaaaaagccatgaggcagaaacagatgttgaatttaagatgcagtgggagagcaggagagtggaagaagaccaggccctcagcgcttgctcctccctctgtctgaaaatctcctcccatatccccatggctgttccttgtgctcacggagtcttcacctgaccgccttatataaaactgctcaccttacgccggcccccaccactctacttccctactgtggatagcaggttgaatgtggtcccccaaaagatatgtctgcatcttaatccctggaacttgtagatgtaatcttcttttgggaaaaaaaaagtttttgcagattaagctaaggatctcaaaattaaatcatcttggattaatgagatggacccttagtcccatgacaagtatccttaccagagacacagagagaagaggagaaagcaatgtgaaggtgaagcagagattggcgttatgtggccagaaaccaagaaacagctggagccaccagaagctggaaaaggcaaggaaggagggtgcatggccctgatgactccttaattcagacttcttgcctgcagaactgtgagagaatacatttctgttgctgtaatccacccagtttgtggtcattcattacagcagccacaggacactaatacgccctgcccaaccatgtgacgtatttgtgtctttgattattttctgggtcctcccactatataatgagctttactggggcagggactttgtcttggttgctgctttgtccccagacaagtgttgccattttctaccaattctgtcttttgaagttgccctcttaaatagcaaagccaaacccaataccttctcctgccttcattaacagaaagaatagctgtgcttctactttttggatagagctaggctcagagtgaaatcatatatcaggaaggaaaacagaaaacacactaggtattttaatagaggagatttagtatagggtattagtacacagacactgcagaacttaaaaggcaaaaagtgggccggggtggtggctcatgcctgtaatcccagcactttgggaggccgaggcaggcatatcacctcaggtcaggagttcaagaccaatctggctaacatggcgaaaccccatctctactaaaaatacaaaaattagcctggcatgatggcaagcgcctgtaatcccagctactcgggaggctgaggcatgagaatctcttgaacccaggaggcggagtttgcagtgagctaggattgtaccactgcattccagcctgggcgacagagcaagactctgtctgaaaaaaaaaaaaaaaagcaaaaagtgtagacacttaagacgatccaattttcacccctagagctggtgaaacaaaagggaagtttgaggttattagggttgtaggagctcagaaatgagggaacaactctgtgagggctcctttgagggggcctgaggctgctcctgggaggggctggagcctggagccagatgctgctgctgggctggtgcagattcttaaccaagcgggcagaaggcaatcccgtcttgagggcctcctgcttccttctcacttttgcttgacttccaagctccctctatgcttcctgttaactggatccaataggaaggcccctgacaacggcacctgggaaatgcagtttgtgtgtaacccgaggacagaatagagagagatggatttggaacttagagataatggcttaataataagcacagtgatcaagtgtgctttttggcctggcatcaaaaaatagaacaaagatgaatactttgcaggcccgtgcatacatgtaattgtttaattacacatgcttgtaattttttttgcttaatgtcttcctcattagacttcaaacttcataaaggagtccattgtttatttttccttgaggtatccccagggtctagaacaatgaccaccatggagctggcacttctaaaaagctgttcactggctggctgcttttctgggtttttgtctcatttgatttaatgtttctggaggactgtgctatcctttatgttataaaggaaagtcttctttccttgtataaatatgacatagctcttttagtgctattattccagaggcagggtggtgagtgaaggagaaagttggcaggtggccgctctggagtctaaattacctcattgttctgtctgcagcagaccaattattgtcaaatctctaatatctggttctatttgtttcatgttgacatacccatagactttttccagcaggctttatttgggaaattccttacatcatatttatgaaaattcaaaactgatcatttttacttctgaaaaatgtgaatatgatttagtatatggctcttaaccggtgattattttgctccccacaggcctttggcgctatctggagacattttgggtggttataagtggaggacactgctggcatctagcagatggaggccagaaatgctgctgagcatcctccaatgcacagggcagcccccacaacaacaaactatctggcccaaaatgtcaattatgctgaggttgaaacatcacgatataatttaaaatatatttttattcattcttctattaaagaaatatagtggagaaagcatcagtttgggaatacacaagattaatttgactttaaatcttgctctttccctgcaccagctgtataatcttagggaagaaattgcattagaagttgctgaagacttcaatttctcatgtataacagagaattaaatcctgctttactgtattattatgaggattgcaagagttaaccagtgtatggttcctgacacgtggctgccccttaataaatatataaagaaagcatatatgtttaaatgtatttatactacaagattctaccccagaagcacttctttagctttttaattactttttactctcaaggaatagtgaggtgacagcgtgctggcagtcctcacagccctagctcgctctcggtgcctcctctgcctgggctcccactttggtggcacttgagaagcccttcagcctaccgctgcactatgggagcccctttctgggctggccaaggccggagcccactccctcagcttgcagggaggtgtggagagagaggcgcgagcgggaaccggggctgcgtgcggcgcttgcgggccagctggagttccgggtgggcgtgggcttggcgggccccgcactcggagcagccggccagccctgctggccccgggcaatgagggacttagcaccctggccagcggctacggaggatgtgctgggtcccccagcagtgccagcccaccggcgctgcaatcgatttctcacagagccttagctgccttcccttggggcagggctcgggacctgcagcccgccatgcctgagcctcccacccactccatgggctcctgtgcggtcggagcctccccgacgagcaccaccccctgctccacagcgcccagtcccattgagggctgaggagtgtgagcgtaccgcgtgggactggcaggcagctccacctgcagccccggtgcgggatccactaggtgaagccagctgggctcctgagtctggtggggacgtggagagtctttatgtctagctcagggattgtaaatacaccaatcagcaccctgtggctagctcagggtttgtgagtgcaccaatcgacactccgtatctagctgctctggtggggccttggaaaacctttatgtctagctcagggattgtaaacacaccaatcagcaccctgtgtctagctcagggtttgtgagtgcaccaatcgacactctgtatcgagctgctctggtggggccttggagaacctttatgtctagctcagggattgtaaatacaccacttggcactctgtatctagctcaaggtttgtaaacacaccaatcagcaccctgtgtctagctcagggtgtgtgaatgcaccaatggacactctgtatctagctgctctggtggggccttggagaacctttgtgtggatactctgtatctagctaatatgatggggaggaggagaacctttgtatctagctcagggattgtaaacgcaccaatcagcaccctgtcaaaacagaccactcggctctaccaatcagcaggatgtcggtggggccagataagagaataaagcaggctgcccaagccaacagtggcaacctacttgggtccccttccacactgtggaaggtttgttcttttgctgtttgcaataaatcttgctgctactcactctttgggtccgcactgcttttatgagctgtaacactcaccacgaaagtctgcagcttcactcctgaagccagcgagaccacgagcccaccgggaggaacgaacagctccagacatgccaccttaagagctgtaacactcaccgcgaaggtctgcagcttcactcctgagccaacgagaccacgaacccaccagaaggaagaaactccggacatatccgaacatcagaaggaacaaaccccagacgcgccaccttaagagctgtaacactcaccgcgagggtctgcggcttcattcttgaagtcagtgagaccaagaacccaccaattccggacacaataggaatctggaaaaccaaataaaacgcacatttccaagagcaaactttttattaacggtgtctaacaagaccttagtctacacagtctgatttattttaaggactttaagtggaatcaagacgttcttgaaagcaataattttatgtgcatcagagtaagaagatattaaaatatacaaaaacggagataataaaaacaaatgtttgaaactgggatatatcaatgccatagttttgagacactttttttttgttttttgttgtttttgtttttttgagatggagtttcactcttgttgcccaggctggagtgcaatggcgtgatctcagctcaccacaacatctgcctcccaggtttaagcaattctcctgcctcagcgtccccaatagctgggattataggcatgcgccaccactcccagttaattttgtatttttagtagagatgcggtttctccatgttggtcaggctggtctcggactcccgacctcaggtgatctacctgcttcggcctcccaaagtgctgggattacaggcgtgagtgagaaatgttaagaaataacttagcaattagattcaggctgaacaaaaaatcgctcaaaacactcacctttagttataaaagattatcttaacaatacaaaaatgttcatttaggtgtaccacaaattaattgggttttttgctccttctatagcttgcccaagtgaacatatttgtaaaagatttttttttctaacaaagtaatgcaaattcattctagaaaaacttggaagatacaaaagagtaaaaagagaataataaaaatgacattctgatccagtaatgtagagacagacacttaaaatttcagcaaatttctcttcttgtggtcactaatgaatattcctgggggctggggctactgcttcagatttatatcagactgagtaaactcatcaggtctgtattatagagctttgcaccctatctagcacagtttgggaatacctttcctgcaaaaatatttgttggctgattaaatgggtccttaattcaatatatatattaggctataaaattaaatgaaaatagcacactatcgcagtcttaaaatcatgttacctttaataactgcttatatgttaggttgtatcatatgaaattgcctatgtataacaattttttttagcaagggggcaatttgattgcagcctctattctatcacaagctttttgagcactgcaggtgaatttgtttctcttttataccaactgtaaagcttgggtgataactctgtagaaggaaatgcttaaacattgcatcatgaatccatgtgtgtgtgtgctgcgaagcacccccaaaacctttacaagaaaccaatacttccacaagatcttttgtggaattttattttctttccttacatctaaaaatagctatatttctacattgctggtcaaataatgtagccattgtggaaaacagttgggcagttcttcaataaattacacatagaattaccatatgagccaacaattccactcctgcatgtatgcccaaaagaattaaaaacaggtgttcaaacaaatactgtatccaaatgttcacagcaatattcacaatagtcaacaggtggaaataacccaaatgtctatcaagtgatgaatggataaacaaaatgtggtatatccatacaagaatattattcagacataaaaaggaatgaagtgttgatacatggaggaaccttgaaaacactatgctaaataaaaggagctagacatgaaaggacacacattgtatgattctatttatataaaatatcaaaaataggcaaatccatagagaaatagaggagcttagtgtttgccagaggctgaggggcaggtaggtatggaaagttattgtttaataggtacagagtttccttttgggatgacgaaaatattctggaactaggtagtgtggtggttgcacaatattttgaatggtaaattttacgtgcgtttatcacaacagaaaacagaaccaaataaaacccatgtttcgttaactaatttaatcaggattcttttgtttgcaagggatagaatcagaccactttggtttttaaaaggagggtgaggagaagattcattatctcacaaatttgggaagcccgggggtagagttgaccttagggattgatttcaggaactcagacgatgttgtcaagatattctctctctctatccccaccacctttccctcctctctttgcgtctctccccctcactctctttgctctcctccgtatgttggcctgattcttgcctcttataggtgccctttcactgtgtggcaggagaagaaggcagcagacagcctcttacagctccaggcttccatcaccagctgagggaccccagatgaagggggtacaaaactggcaaggcggtattgggtagtgggaagaaaaaagacctcctaacatttctacttgaccagatgcgtgattttgagcaagctgctgaatctctttgaacctcatctataaaatggagataatcatagcatctaccccctggtgttgtcatgatggttaaatgagttaatatatgaaaactgcttagaactgggccaggtttactattttagttattaccctcattgtcattatcattatcatatgtcagtaaaatccaggggaatgacttcattggctggtgaactcccctgttcccaggatgctggggttggcaggcttaccagagacagttcttacaaaaaatgaagttggttatcagaaaaagagagtaagggagaagggcagaaattaacatgagatggctacacattagcctaccactgttacagagactttcaaaatccccactctctctggtataaagacatatacacatatagttgaagttagtgcttgtttcttcagtatgtgccaagcaccgtttgctgtttgtttgtttgtttgtttgtttgtttttgagacagggtctcactctgtctcccaggctagagtgcagtagcatgatcatcgctcactgcagccttgaactcctggactcaaggaatcctccctcctcagcctcctgagtagctgggattacagccacacaccacatgtctagctaattaaaaaaaaaaaaattgtagggcgggcacggtggcttacgcctgtaatcccagcactttgggaggctgagtaaggtggatcacctgaggtcaggagttcgagaccactctgaccaatatagtaaaatgccatctctactttaaaaaaatacaaaaattggctgggcatggtggcatgcacctgcagtcccagctaccggagaggctgagacagaagaattgcttgaacccaggaggtggaggttgcagtgagcctagattgtgccactgcactacagcctgggtgacagagtaagactctgtctcaagaaaacaaaaaaaaaaaaccaaaaagctgtagagatgggctctcacttggttgcccagcctggtttggaactcttgcttcaagttattctcccacctcagcctcccaaaatgctaaggttacaggtgtaagccactgcacctggcctaatttttaaaatttttaaaaattttttgtaaaggtgagatctcactattgctcaggccggtcttgaactccaggcctcaaatgatcctcccaataccacctcccaaaatgctgggattatgggcatgagccaccgtgcccagcccaagcactgttttaagtcatttatgtttataatgtcatttgttcttctgaagaccctgtaagataaaatattactatcattacaaatgaagcaaccgcagtacagagagattaaagagcttgcctaacaccgccctgtcgggctgtgatttcagtcagtctgtctccagaacttgaattctcaaccactcggctctgttgccttctccttaatagcaggtaaaaaaacaagttaatgaaaaggtaaggaaaaagttgggcaatttgcacaggtgacatctgtgttggctgaaaacaacaataggactgtggttttaagagtacaagtatgtaaccaattctgtcttaaagccaatgaaataaaaccatgaaataaaggtttgtttgcagccctattataaagaatacatgtttgtcagcttgaataaatagttacactttcctaagtttaaatttctcaatgccattgaaaacttatagagacttgaaggcaggaatcttttaagacacccaagactaacaattctcacatatttctgatcttcaagtaggcatcttttactaacaggcttaacccagggacctcaggttaagcaaacaggtcattttccttgacaatggaagggtaaacatgacccggtggcaagaatgagttaattgtcttccattgctgattcttgctcaaagcacctctctgggttgcaggacaaggcaagtgccacagctggcagtgaaatcaagtgaaatttgcggggtttggccaaacatcccatcctattgaataaagacagagacaaaacaaaaaactgtttaaataagcaaataagaagaatgcagaggactagacttattccctgcatgtgacaaaagagaggctctgctttattttttgagcactgagatagattgaagtcaagcatatttatttaataatagaataaaaaggaacagctgtggaaaatatttagcagatgatacacagagaatcgcacacacagacaagacatagttacagcctagaccgaagaatggtgccagggtagcagagggtttttcttaagttttatttccctgaaattaaaaacaaaaaactttgtgatttaaatgatagagtttataaatgccatttataaagattcaaatagcacagaggtaagataacacctttcacttctgagtacctattatgtgccaagtaatattctcagtatatgaattgattagtttatctgaattctatggaggaagttattctgaccaagcctgttttagcagatgggcaattgatgcccagagctgggaagtatcttgcaaagatcacccagcttctaaactggacctgggcagttagattccaaagcttatggtcaaaacaactgctataaatccctgaagtctagagaagttgtttaaagaagaaaggagaaggctgcagttctgctccatgccccattccgccaccacacctccaatctcatcactgacagaggtaagcagaccaacacgtctctattttcctaagaccttcccaattttaaaactgaaggtcttgggccaggtgtggtggctcatgtctgtaattccaatgctttgggaggctgaggcaagtggatcacttgaggtcaggagttcaagaccagcctggtcaacatggcgaaaccccgtctccactaaaaatacaaaaattagctgggtgtggtggtgggtgcctgtagtgccaactactcaggaggctgaggcaggagagtcacttggacccaggaggcagaggttgcagtaagctgagattgcaccactgcactccaacctgggcaacagagcaagactccgtctctaaataaaataaataaataaataaataaataaataaataaataaataaaacaaaactgaaagtcttgtttctcaggactcccccagtcctgagcaaaaaaggatggtttttcaacttaccagagggcacatcacagacagcagtttattttgtatctcttccatgaatatataagtatactttcaaaactttgttgtgacacgtatacacacacacacatacacacacaaatgctcctctgtgagctatttttctcatgtctcaatgtattaggcaacactttccctttcctttcttttaaggtgtcaatcaaaaagaactgcatattgctttcattttatggatgtacattcactcatagagccaccctctgtggctgctctgtaagggtgaaaaaaaatgtactataaataaagaggaataatggtgctatgtgagcaagaaaataatactttaaggataaaatgagggagagatggaataataatttttacatctccaagaagcagtaacaaaaaagtaaaggtgctttagacagatagtgagcataattttattttcagagaaaggaaggtctccgtggatgaaagtcaggggatgaggaatcaagttctggtttccccttggtgagctatggaaccatggatgaaagctgcacctcagtttccatatctgtaaaatgggaatggtaaatcctgcctagcaaactggagagaacacatgtgaggatctggcaagtataaagcactttgatgcattgtacaaatataaggcatgattattagtatcctaaagaatttgccagaagctttcattgtgatcactgaagtctgattcaaaggaaaacatcacagagggataaaagtgtctaagtttgtgatcctcacactggagcatgtggaagatatacccagggagattgttaaaaataaaaacctggaggtctactgcagacttcttgcatttgattctccaagagtggaacctgtgcttttgtcactgtaatgagttcacccaggggattctggtgcaaccatccagatttgtgaactaagggtcagggcaccacctaacggggggcaccattcacttgctcagcaatgcagatagcagcagaagggttgtgcagcacccagcctaaaaggaagcctggccctgtgaccatcaagccccattgaaaactgtcagaaagaccccttgaccctttgctaataacagagatagggccatgaacttctgctgaccacctgctgtatattagagcatttcacattatctttttcaaatttatgttttggtggtaaaattcacataaaataaaattaaccattttaaagtctacaatttggtggcatttagtgctctcacaatgttctgcaaccatcacctctctctagttccacacatgttacctttatttaagcctcacaaaattttgagagattaaatatttgttaatgcattttcaatatacaaaaggaaagctagaagagctttagcaatttgtccatgattggacaattagtaacggttgaagttgggattcaaatccatgctaaccatccaaaacactttcaaatacacgagtggcaggaggaacccccaggattccatattttcaatgaaaatattgaaacaatctaggacattgtcactttaatttcataatgttactctaaataaattcagtaggtctaatgctgtacctctccccaccttttctcattccctccctttcgtaaggcatgttctacatgggtgcccaatcacaagtttaaatttaaccacaaggtaaatcaacaacttatccctgatgtacaacctcagcaaagtaaagagaacatgaagaattttcccagactataggtaaacccatagagaacaacatatgataggatgtcttctgtcttgggacccgtaagacccaagtatattaaatcctggtctgccaacaacagtgaagcaaacacacttttagatagggcagccatgtcgtatcacccaactgggacattctcgaaaggatacttagactggccatcagaaccacaggctaacctagggctgtccaagacaaatgaggacatatggtcactttacttttggagcctcttactaggaggctgaaaggccatcactcctcagcaacatacaaaagcaagagaggaacaaacaaagcatactgagaaataaatacttaaacaattaaagtcaactagcaaaacccaagccaagtgaaatagctatgaagatttaaagttatttgattgcaaaactcagtaggggagtgaggagtgaagaggaagaaaggatgcaagaaaatatggacctggccaaactcaatgaatctcaaaaacccggcacttacaaaacaagcagaaacataaaacttcagtgagagcatgtaccagaccaattaagtcaaactcaaagggctgtaaaagaaaatgcatcttgaagctggagcaaaatctaaatggaaatcagatgacttaggagaagaaaagccagcacatgactcataaaaataccccttgaaaaggaaagttagaaaaacagagaaacattcaaatgaaatgaattctactagttcagagtctggtccaacagaaggttcctcgtggcctgtcaagtcacagacacggggggatttgagatcctctctgccatagctccctccattgagttggggaggttaggcagatggctgctgtgtgtgtgtgtgtgtgtgtgtgtgtgtgtgtgtgtgtgtgtgtagctgagcaagataaatgtggagctgcctcaggccgcaagtgagttacctgattcccagtctccctgactcccaattctcagtccatctgcctgccaggccctgcctgggcgtcctgcagtgtagaggcttccggtccgtgtgggcctagagtaaataccacctgctccttggctgcaggtgttgcagtagctaagatgaactgcagccctgagcagttcatcttaatgaggaagggaggaaggaaggaagggactttactgagtacagcaaaactctttaaccattttgaaaggactcttgctttctctgcatggcagtgttctgcaaggagtattggcctttattattggattatgatttctttccccatcccatcttgtgtgatggaggagtaaaggttttaaaggcatggattcaaggcttatttttttccttggtggctgaatgaccttgggcatatatctttttatcctagttttcctgtctgtaggtggagaaaaataacatttctctaggtattcatgaagacagagataacccctgggaattcccagaagatggtttagcacatagtgtgtgctcataataaacgttgcttgttcctcattaccagaatagggaataaacggttataggcacagaggacttaagtccttactcaaactcaaacaatatttggtagccaagtcgcgactaagattcaacgcttttgcctttgccctcagtgtggatgctaacctaggctattctgtctccctgcagcccaccctgtgctcagtggcagctgtggtggacagtctctgatgttcaagtgcctgaatggctctgctctctgttttagggctttctctaaaactgcagaagtcactccatttccagcaggacaaacatggaagtgtggggtgggagggggttcatatactccagaggcaaacacaacctatgcaagtcagaagtcaatacaaaaggcccttctgaggttcccttatatgattaagccccagttgcctagagcagtaactggcttattctatacgtgttactggcttttatccctttccttgtcttattcctctccactacctccttctgcttcctgggtctcagataaaccatctgcacccaagtccttatcttaagctctgctttggggaaacccaactaagacaccatttgtttactctgtcttatgtaaggaccctacatggttttgctttttgcctctattcttaggactgtgaataccttacccaaagaagaacgtgtaataagtttattgagaaggaactatgtgccagacaatgtgcaaaggaaaaaaagttaatacaagtctaatgtaacaaaaaaagcttctcctccccctccccctccccctcttcctcctcctccttctcatccttcttcttcctcttcttcttcttcttgacagagctttgctctgtctcccaggctacagaacagtggtgtgatctcagctcactgcaacctctgcctcccaggtccaagtgattcttgtacctcagactctgagtagctaaaattacaggctgctccaccacacctgtctaatttttgtacgttttaatacagacaggatttcaccatgttgtccaggctggtcttgaactcctggcctcaagtaatccaccaccctcagactcccaaagtgctgggattacaggtgtgagccaccatgcctagccaacttttcttctaatcgtgctggtgtgagttatatctgtggaaggacaaataaatctacctcttccttcttcatacagagagtaaagggaatagccaaccaggtctgagattctaatcatattaaataacagacgggatgtcataggctctgtggctgctttgccgtgccagaggacaaaggtcctgggttagatggtttcttctagaacagagccccttaatgagcctttggagataaagaggtaggtgcagtgttaaggtgggagctgaagagctaaaaacacaaatgtttaggaagaggttataggtgactataggaaagaaaaagttagcaaggtctgggaatgcagcaagggaaagaccccaggggtgacatgtccagtgacaaatttccacagggaaataccgaatgagcctttaagtacaggtagtgtcttactctctttgtgttgccataaaggaatacctgagactgggtaatttataaagaaaagaactttatttggctcacagtcctgcaggctgcacaagaagcatggtgccagtgtctgcatctggtgaggacctcagtctgcttccacttatggcagaaggcaaaggagagctgggtgtgcggagatcacatcacatggccagagaggaagcaaagcagagatgggagaaggtgacaggctctttttaataaccagcaatcacgggaactaacagagtgagaactcactcacaccttccccctcctgaaggaggacattagcctatgcatgagatatctgcccccatgacccaaacaccttccaccaggctccaactccaccactggggatcaaattctcacatgaggtttggaggggcagatgttcaaaccatagcagggaggttggcttgattgatgtattgtgctgggagataattaccctctgctgcccctaaccagttttgggcatgggccacacaattgtcttgtgttaaccaactcttgatagggatggataatgaaattctccacatttccttcaacatggggcagaaaaagatacagaagaaacaggaaatcagagaagctactggaagaaaagcaactcccccactaaaaataccgagggatccctgggtttcatgtatagaggggagggtgaacttgagccagaattttctataaggtaaagagactcaaaaaactgaattttagggtctggggaacaccaaatgattgtattacaaatttgttatcccatttaattctcagtgaggatgaagaggctcaggggaattaaaatgactggtctgaggtttcaaaggtggaatttgaactcagctctgacttcagagcctcacattacaggcatgctccaattggctatgttagaccagaaaatgattcagttctcactcagatatacccattccatttcagaccaggctttttaaatccctggtttaaaatggttttcacatgggctaaaaatataagataaaggacttgaagattcatcaaatttgttcttccctcttttaccctctaatcatcagagaagaaattagttcttccttccacattttattcatcttcaaaatcttgagtgggtcacatacatgcacacacacacacacacacagacatacacagagaatctacctgggaaagtgaaaactgacgttgtgtatacgccactgcatttctttgctgatcaagtacagaaggaaatgtttggttgggtgcttgagacttctgtacaggaaccagggatcaggttgttgaaatgatacccattctagtatttgaattgtgtcagaaaagaacaacatggcctgtggtcttccatgcatacattcagcacaataaaaaaatctctttaaggtttccaacgatttcatatcatggtataggagaaagcattcattcattcattcaagaaatactgagttccttctatgcgtcaggcactgttatagtcacttgagatcaaagcagactaaaaaaatcatttctgctcctgtgaagtaacaaagaaagacagaaaataaacaataagaataaataagtgatacagtgtgttaaaaggcgataaatgcaatgaaaaggggaaaaactagcgtgacataaaggggaatgggaatgggtaggttgtgaattgctgttataaatagggtaggctgactacgactcattgaaaacgtgacagttgtggctcgaatatggataatacatgaacaaaacaattagaaagcctggggaatgtttctgattctggcttttggcatccacattctgagctggaagctttgcctgtctcatgactgtgtctgtgaaattccacagggaggcagcatgtcctagtgatgactgcagccttgagggatttccaaggtgacggcttttgcttccaattacagaggagggtctaaggaatctgtctttggactgtttgtaaaggcactttccctttcctgatttcaagatgttagctagacgtggctgcatggctctttgtaaccatgacagcaacacttgctttcacatattgaggatttaatactatatgccatatgttaaacgcaatatcttctgtaaccttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttttttttgtatttttattagagacggggtttcaccgttttagccgggatggtctcgatctcctgacctcgtgatccgcccgcctcggcctcccaaagtgctgggattacaggcgtgagccaccgcgcccggccttctgtaaacttcttataatttctgggcttgatcttgttataatgtcaccatttctcagatgagaattcagaggctcagaagcacatcgcgagagaatgtgggaaccaggattagccataaagtctttggaaaatctttggatgctaagttgatagaagaaaggaatctttttagatgggtttgtgaaacctagttgtttcagattggattcggttcagtgaatttgaaagctagaagcttgaagatcagcaacaacagggtgatagtaataaccagtttcattgagcaataccaagtgctgtgctaaatgcttcacatacgccatgtcattcaatcctcaatcacagtgctgaactgcttcagatgaggaaaagaagtcactgactgtgtgctcactgcatggcaggcattgtatacattgctatatcaatgtctctcccaaaatcacttcatttgtcaatgtaagatgtcatcattataaatattcaaacaatacaaaattatgttaagggaaataaaacaaagtcaaaaatctctttccctaatgttaacccccgccaacgtgagagtctatatgtattcttcccaaattaaaaaagtaattatctgtatctgaagctatatcaatgtaacagttgaacattgtgaattttttaaaaatagtgtagtataatatgaaaattacatctctttcaatctcactacctagaaataatttcttatagcatattttttctggcaatagctactataactttaaacaatatatttatgctttttgttcttgatttctcaattttgaaacacaactactcactccttgctggcttgttattacccaacaacctccgatttttgttaactctatttttaatgttttttctactgattaattttggggcattgaagagtctatataaatccctatttttgatatataaaacttagaacatgccagttagctttttaaaaaaacaaatagatgaaattaatgcacttacatttatgccacctcctgttgttcagctttctcctgaccactcaccagtcagtttccccaactgggagttaaatcatccccaatgttaattatgtcataatctcatccctttggcaacctcttaggaagccagaacccacaccatttccagagcagtggaaggagccagaaacaatgggtgtgtgactggttggcctcaggtggtaaaagtgtcttacagcataagaagttgctgcaatgttaggcgggggctgtggccacacatctactgtgtgtttctgagattggtgaggcccaaagaatctgaggctatacgttagttgtgttagttgtatccaatacggtctggttggtccttttggtgcattaatttcttgtttcatacatgcggtgttaccaagctctttattaaaatgtgttaatcttctattccattccttgaatgattctctaaatgtttcctagagattcaatttttctgtttattattttagtccttctcggattggatttcctcagaaatgttactggtttattttaataattgtagaatatttacgatgacaacaacaaacactttaggaatgctttccacatatcagaaaccgttataagcaatttttaacatcaactattttcatcaacccaggatcttggtcatacttttattttcattttacagggaaggaaatggaggcccagaggttatcatagagttgctaagtgtataatccaggattcataccccagccctctgaccgtaaagcctgagcccttacctaccacaaaacacatggtgttgtatctcacttgtgtttaggttttactttgaagtgttacaatagtagtgcaaaagtcagtagtgcttgtgggaataagttttagctgtcccccatatccatttttctattctcccacagtaagatatcttttagctaggcatacggctgtcctaaataaagattctgcatcaaagcttcccttgcaaataaataggggcatgtgataagtcctgaccaatgggatgtaaactgttgtatggttgcttcaagggtccttccctaagagataactaaactgcacctgacgtgccttctttgttctccctttcctctcttgttgagaggagggtggctttggactatgaagatgggggcccctccctaagggtggtggaatggggagctgaggggagtcttatttccctgggcactgctggaatggatcttccctcccagaactgaaccactcctacggacttttgcttgaacaaggaataaactttctcttgttcaagctcttgttatttgtgtacactttgttactattgttgttacttgcagcctaatataatgtcaactaatgtggttttaaaaggcttgttaaaaaaaaaaaaaaacagcagttgtcaggcccatatcctgttcctcagccatacacaacagattttgctgtttcttcccacatttgcattcacatttctaaatgatatgcttttgctgctctttcttaagattggcaatattgattttttaatggttgatgaggactttactctcttaaatctgtccttccccttcacccacctaattagtatagttccatcacagtttatttagttaaattaatattctttatttacattgatatgattaagtaaatattattcactaatgagacaaatagttaattttgcttacatttcttcttctttgttatcatttttcttttcagacgtgtgaattttctaagcaattgtgaaattttcctttaatcctcctattagatgggtatttttatttccattttataggtgaagactttgaagctttttgttgttgttcccactctaatgatagtagtgaacatatactgggtatgtgcattccacaacaagtttgatgcttactgaatgctcaatcgtgcttactactgtccccactttacagagcaggaaattaaggcagtagagcttacaagacttacccaaggccacagagtcaggattcagactcaggtctctctgactctggagctcacatgcatcttaaccctcttacttggacgtggggtgaaggagaagagagggacacagtcactatatttaaaattgggaagagtgtgagcatgagcatacagaatagctcagactaatctgatcagaaaggcagctgttattaactattgcatgctagataaatatcagcccaatctcaactaagaactcctgacttggtctgagatgaaaacacaagtttttggttttttgtttggttttgtttttttgctgctggactgtagatgaacctgaacattttgctttgaagtaaaaaagcaaatagaaggtgcctaagggcttccactttccagatagaaaattgagcctccagggagtttagcaacttgcctccattcccacagctaaaactgccggacgaggatctttcccaggatcctcagtttccagaatccgggtgtttctccctacaccaagacatctttcatggctgtgctctcaaatttatcacctctactatctatgggacttggtggggatattttccaagaaaaaaatccatgcatatataattaaaaaatagagataattccatttccagtcaatctgggagatgacttgggcttctcatattgacacttccttaaaagatattttgatactttgagggagacaataataggatctttaaaattggagctgttccacaaaatctggagacctgtcaccaagatagagatattggatgtaacgagattaataatgagacagtaatgaagtaatggcctaactcctgcctgttgagtcagcgcctgcctgtgtgtaaataaataatgaattacaggagtcacattacctgagatttacagaacatctctcagctgtttgaaaaagctgtctctccctgaggataagtcagaggaaggtttttttaattatcttgaattattaagattaccatttagtggtgaataattgtttcctattggactctcaaaagtgcttaattatacttagagaataatttgcttgagctttataaataaacctgaatattgctgtagtatcttttttaaaacccctatgggaatatgttactaatataaatgaaatcaatgtcttcacaatccccagagtagcagtgtatccttatcccagtctataaaattagttttataatgcttacctcttggggttggtgaaggctgagtcacgataagcagccactggctacaaaccagcctgttccaagcactttacatatattaactcattacctttgtaacaaccgtatgaggtgataactgtgatcatccatggggagattgaagcacagaggagttaagtaacctgccttagtcacacagccactacaggacagacttggaattttaacccagactgtctgagagtttctgcagagctcatactctaggaaacaagaaggcggtcagattggcacagataatgtgtaataaaatcccgtgggaggcaaaagcaggtagctagagcaggagagaatggttaggttatggctaattgattatgctaggtgctaaaagttgccagaaagtggaaagagaaaaagaactgtgtcttcaaaattaggaaaggactagaggtcttgaagtggaggtgagacttgactcaggaggcagggcttggacactggaccaaattgaggactagctaaaacagggaaggggctgaagcagctttctataagacacacccactagggtgccatgtcagtttatcattgccatagcaacacccgggagttcccacccctttccatggcaataatccaacaacccagaagttactatgttttccctagaaatttctgcataaactgctccttaatctgcaaacaattaagagtaagtataagtactactgcagaactaccctgagccgctactctctgcctatggggtagccctgctctgcaggagcagtcatggagctgtcccactgtagagaccacatggacctctagtcctttcctaattttaaatatgtataaatacactgaagctaaacatttctgtgcaaagtgaagatgccctcctttacttgccttcaatagctaacattggcattagcccacttatggctctaaaatacatcatcctagttgatttttacaacacctgtgacatgggaaaaacatgttattttccctatttttcaagattaaaaatcaagcagagaaattatgatttttccaaacccccatggaaagcaaaaaggagctttcaaagaaggaatcaagtctctaaaagttaagcacagtgttgctttgattagcctctcccagagggctttgcttaatactgggactataacaggccctggagtctttattgattagctgatcccatttgccataagtagcttatttagaaacagttttggtcttgaacaccggcctcaagcaaccctactgcatcagcctcccaaagtgctgggactacaggtatgagccaccatgcctggtgataggtactgtttttatccccattttatagctaaagggacagaggcttagagaaatcatgaaattcgcctttgtcatacatcttgtacattgcggacctgggaatctgactctgatgacagagccagtgtttcgtaaatttatgccgttatgcctcccagcaagacaaaaaaggaaaaacccaagatttagagagctgagttctcagttctgggacttcctctgccagtcttcattgtgcacttgtgggcaagtcacttccagccttagagttaccccctgtcacatgggggcgtcaacaaggctcacagcttaggattgggcaatgggttaaaggagatcttttctaaattgtagcactataaaaatgttaatgaaacagagtttatggcttctttatgtttggatctttggtgtctactgggtactcaatgatggatgttaaataaatgaatgaaatgagaattcctatcggttcaagaccgagaattttggcatgatttggaaaacaaaaggcaaatgaaaacagctaaagtaaactcagtaatatcctattttagttcaaacatctttaattatgagccatcaaagggaacacacacacacacgcatgcacacacacacagacatcacactgcatataccatatactgcaaatgattctcaagtctaagtgtgactagattaggcaaagttttcaatgagacccaaaagattccttttaaattgtcactgacatcacactaccagattaatttttaaaaattgatctgtcttgggtgtatcttggagataaaaatgaagaactatatttctccctttctcacctttctagtgtaattttcaggtacaaatatagaatgaagtgttgctgttgttaaaatgacacactttttcacataggctaagattagagagtttcaggagagaaattctcacaagcctgtggtccagcctgggagccactcattatctattttccagaggaaaaaaaaatcagctcactcgagtttactgagcatcttctatgagctaagggtaagtccaagggacatcatggaaaatattcttgcttaatgtatttgcaatgttgtcaaagaggtaaggcataaatataggtaatcatactgacactgtactcttctggactgaaagtattggaacacctcttgaactataataaagggatttattataataattataaattaaatataaaatattatataagagtatgtaataaaatataatattaaatttaataaatctttttatagaggtagatcccaaaaccccaaaaatgcgatggtgcaaggccttaactagaaccaagagttcatctccatctgaactcacttttcttcttcattcttatttcctcatattccagttttctctgcttcccagtccacatggcctaacaagaccatccacagctccaaagtttgtatttccccagttcagaaaaaaagacaaataagtgctgggatttctgagtctcaattccaaatcttagggcttattagtctagcttgagtcagatgcccagtcgtgatctaaccaactgtggccaggaggccaaggtgaaattatacaatcatcattaaagaaaccctgtccctgtaaccacaaaggtcagggaaatggggctgtactcagaaaggggctatgcagtgagtccaatacctggtccctgtgttaacaatgtgattttattagcaggaatgttcaagggttgcaaatagcaaaaaactaactaacagacgattaaataataaaataatataattaaccacatactaagatgtttagaagtaggcagtcctagggttgatttcagggctctgagtaggtctctgagaaggtcttggcatttccctcatggccacaatacagttgcgtagatttagacaagacatcctcacattagattagggaatatctggtgagagagctctccttgcacacacacttctctcttttatcatatgcaagaggttttgtccagaaaccctcccaaaaagcatacctttaggttgcattggtcagtgctgagtcacaagaacaggactagcttcaaagaagtctagaaaaagaagtctgggtttttcaggctctatcataagaggcaactaagaaataagggaattgagaattggttgttgaaaagccagttcaaagtcagaaacaatgatgaactgccaaataaatggcatagatctaaatgtttagcagaattttctgagatgaggagaatgctccatctctttgctatccagtatggcagctgctagctgcttgtggctactgggaactagaaatgtggctagtgtggttgagaaactaaattttatttaattaatgatttaaatttaaataagcatatgaggctagtgactaccatattggtcagtgtgaaactatagataatgtcttcttgggaataacttcttggaggtcagaggaaaatcagaggcatcaccctgggtcagaataatttggtagccttcacaggagatggatgtgaaggatggttggggtttgaaagttttccaatacagtaagcttgctctaaggcagagaggcagaatatagtatggcattcttaggaggtgttaatcagattagtttggtagaggtaggttttttgtggaggagtgggcaaaaagctgaaaagtaacttcaattcaaatggaagaaatatttaaatgccagcttggactatgtacaataggcaactgatgctattgaaagaagggtaagatacgaagtgatacttagggaagattaacctggtgattgtaaaagagatgaatagaaggcaagaaaattagttatgatagtattttccaaatttttcatgttatggcacatacaaaaatcgatatatttttgctcactaggtcaaacggacaagacagctcctggccaaaggtgaccatcccagagactccagctgctgtaacctttcaccccaaaatcctgaaatgaggattactatcttctcacacctataacccttttatagcacagtagtgaacaccagcacatagttgggatgctctaacttagcagactgtctggaacaaaataggttgtggtatatatgaaaaaggaaggaaaaagagtgaaatattttattgagggaattgaaagaaatcaggaactaattagaggtagttacggtagatgtcagagatgacagtaactcctaagtttcaagaatggtgataccagaaataaaaatagtattatgaaattgttttgacaggacatggtgatttcaatctaaaatatggaggtgataaatggacctcctatgaaggactgttacattagtgtcacccagtgatccatggctctggtagtcatgctatgggatattcccctcccatattgactctgggcttggacatgtaagttatttggccaatgagacatcaacatggtgcaagcagaggcttgatgagcatttgtgcattgaggcttttccccttggaaccagccaacatgctgtaaggaagctcaggatagatcactgactgatgagaggtcacaggcagagagagcaggtctatgagagtctacgttttttgtctttttttgtagagacagggtcttactatgttgcccaggctagtttcaaactcctggcctcaagcaatccttccatctcagtttttcaaagcactgggattacagatgtgagccaccgcacctggcctctgagagtccatcttgcatgtttcagccacagccaaacacctatctgaagatagacacaggagtgacctcagcagaagaaccactcagctgagcccagtcaatcctcaaattgatgaaaaataacaaatcattgttgttttaagccactaagcttcaggtgttacactagtcagtaataggtaatagaaacaatatccaaataaaaatgttcaataggaccttgatgacatggatctggatgccaggcaagagatctgggccttagatgtaattccataagatatgtgtgcttctgtcatagcaatgacattgtaatgaaattggatgatgtatccttcactagactgtgagctctttaatgacagggactgggtttttggtgatttcttatacactattctcggttcaaagaagattctcaagagatccatgctgagtaatagaacaagtgaatgaataaagatagtgaagtataatggaaaaggaatagactttgaaatcagacaggctaggcttgaacttcagctctcttaatcactaaatgtatgatcatcagtaaatcaccaatcctccttgtaaactttaagtaatgtgagcagcctctcaagagccactgagaggagccaataaacagaaaacacgcaataaattaaagcttttcataactggggatgaatcaagtgatcattgaaatgtgggaatgaatgaaatcaaaaaaaaggtaagtatagtaagagaagagtgatgagtctggggaggatgcatagggaatacaagaaagaaaatgattccaagagagataaaaaggaagagagaaagcatgagagaggaagacccagaccaaatggaatgacaggaaaagaaccaagatagggtacattttactagaccaaaaagggcagcaattttaaagaaagacccaagtcaacattgctatgcttagagattatagtttttgggtcattgttttgtgtgtttatggcatctcagccattggtccaggactgtcagcaggaaaatttttgaagaaaaagattaggccatcatggatgatcgaatatatcctaattaaggacagtggataaggcagcatttgaggtcgttataaaatgtcagctgggtgcctgatagttgataagaaagagcaaatttaaactttctgtggttggacctacagcttctaggagaatcattgaaaggaaggaatttatgtaaaataaagaagtggtatgagaaaggagagcactatctgccttaggtctcctgggagaaatcaaaccttagggatctaattatctgaagtcatttctctctggagagataaacataaacaactgaaaagacagttgtttgaaacattgcaaaaacatccaataaaaccatcagctctaaaaacagaatcatcagttatacaaatatctctcatgccattgtcctggtgttggaaagaaattaggccagactcttaatgatatcagattttgtgggtgagaactttgaagtttacatttgtaagttttgctgttcactttcctttatcagttaacagcatcctgattttgctttgggaaaccattttttccccccactttttcaatttatatgtttgagtggagttgatttcaccttccctccaccctctgctccaggagtaaatgtgtgcctaaggcctagtcaacagagtatcacatccatgtgacaatgatgattggttcagagatacatacgtaccctgaatgaagccaatcaggttcaatcaaagataattctgagtcttagcttgggcatctggcagatatatgcttcctttcttcttcaacttgtattaaagataaggtaatcttgaagctgccagatgccaacttgtctaaggatataatcagtaggcccagtgtggtggttcatgcctgtaatcccagcaccttgggaggctgaagtgggtggatcacttgaggagaggaattcaagaccagcatgggtaacttggcgaaaccctgcctctacaaaaaatacaaaaattagccaggtgcagcagtgcatgactgtggtcccagctactcgggaggctgaggcgggaagatcacttgagtccagaaggtggacgttgcagtgagccatgattgcaccactgcactccagcctgggagcctgggtgacacagtgagaccatgtctttaaaaaaaaaaaggaataaaaaagtagcttgccatggtggtgtgcacctatggtcccagccattttggaagctgagacaggaggatcacttgaactcaggaagttgaggctgcagtgagctgcatttggcccattgcactccaacctggtgtgacagaatgagactctgttaaaaaaaaaaaaaaagaagaagataggctatacaatggcattgcctaagcctctggatgcagttatatctgagcttttcagctgcataaaccaacaaatatatgttattgttgaagccagtttgaatttttttctattacttgcaattaggatccagactaataatgacagcagaatataaatatattagtatatgaagagggagagtatcagacatatatcattcaatgtaattatttctgttataatgggcccaataacaacttcattttaaagatgagaactctgtagctaagagagaggaataactttgtagaatgtcaaagaagtgggaaatatgttatctaaactagatggtagagcagcaatcaacaaattattgcaaggcagccaattctagtccatcacttgtttttatatgcccaagttaagaatggtagaaaggaaatggaaggccaggcacagtggctcacgcctgtaatcccagcactttggggggccaaggcaggtggataatgaggtcaggagttggagaccacctgaccaacatggtgaaaccccgtctctactaaaaatacaaaaattagtcgggcgtggtggcacccacctgtaatctcagctactcaggaggctgagtcaggataatcgcttcaacctgggaggtggaggttgcagtgagcagagaccgcaccattgcactctagcctgggcaatagagtgagattctgtcccaaaacaaacaaacaaacaaacaaacaaaaaagaaagaaagaaatggaaaagatagtttttcatgacacatacaaattatatgaaattcacattttggtatccataaataaagttctattggaatacagctatgtccattcacttatatatggtctatgactgcttttatgctataaggtcagagttgggagggtgagatggactgtacagtctgcaaagcttcaaaatcctctctaggacaggtgtagtggctcatgcttgtaatcccagcacttccagaggcagaagcaggaggatcgtttgaggccaggagttagaggccaggctgggcaacatagggagatctcatctgtatttaaaaataaaaaaaaaataactaaaacactctcttgctttttatggagaaagtttgctgtcctttgtggtggaggatatatacatgaagaaatctgtcttcctatagcaggatgtctgtgtatatgtatcatgtggccttatatatacatatttttatacacacatatatttaggaagataaaggtagaaagaaaaatttgttttttgtccactgggtttggaccatcacttgcaagagatgtcatagaagtattttccttcaaatggagcaataatttgaaaatcttttcagcagcagaatccctttatgaaaagaaatttctaggagtctcccataatgtataatatttgaaaacaggcctttcatgtgtgtatctctagccatgcctactaactgaaacttcatttcccccagccacttctgcccctaccaattccaaccatgtgctccaggcactggtgtgacatcttaagatattttaaggatttagaaaaatttggtaagcactgagattttggttctaaaccagtggtttccaaacctgtttgcacatcagacagcaaggatattacttttaaatgtgaattccttatttgcccgccttctgacacacaaccaaattctattttgggagctctgggctaggactctcaaaactgtacctttaacaagctctccaggtgattctgataagtggctatgattaaagttactgctagaggtaatcttaaatttcttcccaactctgaaattccacaactctaggatctttagcacttccagaagagcttcctgaagaaagatgtagatattctaccaatcatctcagcactctttctttcttttattctcttttaaacaaaatatgcatgcatccataaaaataaaaactcaaactctacaaaaggaagtttccctctaacccccaaattatccattgctccccgagaagcattcagagtttccagtttgtagtttattcttccagagatagtgtgcatacaagtatttgtgtctcttttcttttttatactaaagccaggaaaacatatgcacttgctgcttttcacttaataatgtttttgatatcatatcatataatatctgaataaagagaattatctattttttattgtctgaacagtattattcctgcatagtgttatttctattgaagcacggttagattattaatccagagtgtgatatgtacgtgtgtgtgtgtcccatatactcctggacctgcttattcacatatgcaaatgcatctgagcaatacatttcagagagctttagattaatgtcttatggtagtggtaggaacatgaagtaagcacctttttcattttgtttttcttcaaatgtacttgtttggctttgtagtggcaacaaagcataggaaaagaagcgcctgaaaattttatttttcataaatctatctaagaagagtcttccttttttcatttgtggaaaaaaattactgactacctattatggttggtcatcatgcatatggttttgtctaactcaccttatctaagtctctgtgaagtaattgatcatttctttgttttacaaatgaagaaatggagtctctgagtagtgacataagctactcacattcccatgtatgataagtagcaggactgatttgaaactttgtctttcattttaaaaacccaagttcatttcacaagacatgttattgagccttaaaaacaaatctactgagatgtcatctatgtaatttcaggtttaggttctagaaaccctccagtgagtagtaaagataatattacactaagttcttttcttaccaacacaccattgaagttgaaggagaaaggacacaatctccatcctttcaagagatggaagatttattatgtaagagggctaagaacagaaacaatagaaaatagtcatcctaactgaatccaatatctgcttattatccaggtctttctaaatttctctccttgacagtgccaattagctacatctcatgaagagatttgtaatctgacaaggctgaaaccctggtaattaggaagcatctcattatcactcatcttttgaacagtgcagagtggcagacaattgtcaacttcaaattggtcaagctttaaattggccaagggttcctgaagcctctccttcctgtcaggaggagaagagaacaaagctgcagaattggaggggcctctcttgaattcactgaaacagggaactcaggccaaataagggggccatcttaccagctacagctaaaagcctactcttccaaggcttattttaaatttttattttatttatttttgtcagagaactttgacaaagaagacttttgaggtttttaaattgatagtctccatataacagcctgaacttcccagtttatatcacttgtgtcccatcttaatacataaattattcaacaagttataacagtgaaacataaaaggcatccacacttttagttaataatggtagttaatatttactggacatttattttttcagtaggcaaaaaatgtatgaagtttttttacatgaatttccttacgtaattttagcaacaactctctgaggtgtgttcttttaactattcccattttatggatgagaaggctgaaacaccaaaaaattaagtagctattcaaggatactgttaggaagagacagggctgggatttgaacccattactgactgacttcagagtcactgactataaacattaagctttagtacccaggaaaacaaatctggtaattacaattctcccaaacggcgcaattttctgtttgaagaagattgataaatacttagtgttactttggggctatgtatctcttagtttggggaaaaaagttggttatacaaatgtgatagaaaacccttttctagaggaaccgtgatttgaagagttgaattgctctgcgggagaacatagactatttcactcagtgacagccttcatctctgaaggttgattcctatgatgtctatgtgttattgcttagttttggaggtgtgtgtggtgtgtgtgttgtgtgtgagtgtgtgttgttattatttaaaccattacatgctgaagaaagagaaccaagaatataaaatggcaggagggatggggagtcctaattgtcaaaatgaaccagaagaggaatctcttgagttgtttgcactttcccttgtgaaactgttaatgtctgacagtggttctatggaagaattcctgaaatcagccttgagaaatgcatggccccattgaagcccttagagctacggagagaatggaaattcctaccaccaatcaaccttgaaagaggcccgtcctagattaaaaataaggacttcattggaaagcctaagactttagtagtaaaaggagatcttttcttctgtttgtttcttacagacacaggcaaaagagatgtacccaaaggctccctaatgagaatatgtgagcattccatgaaacatgagccaaagtgaggcttaaacacccaacagatgcctgttgaaatgaattgaacctatgaactctgagagaagccaaatttaacatctcatgttaaatttctctgtgtcggaattcattttcattacccaagtctttgataaggtcttgctaaacattactgcctgatctctgcttttattttgtgttttgagtaggttctctctgattatacttggaatgaagggattcaaaaaggaacagcagaagactaagtaaagacagcctgtaactaatgattcctggctcaaaatgccagataggccacatgtgtttatatattcttcctcccaaaatcccgcaaaatgacaacaaacaataagtaagttattaatcctcatagtagatgtagttggtacctcaataatatatcttgggactcacaatgtcattggatgaccacaacaagcacattggaaaataaagttgaagaaacagctcaagatgtaaatcaaagtgatcaagagatggccaatagaagaagaaagattagaagatcaatcctggaagaacaaaatatgactcatagaaaaaaagaagaaaggagattattaaagaataaacacacaaaaaaaacaaaattgaaagacataactgttcagattgaaagagtacagaaagagctcagcacattgattaaaacaagacccataatagaggggatactcttgtatgccatccagatttccctacaagactaaggattccctcatatcaggggcatattggtagctgtggcttctcaaatgattttctcttgggcaattgcccttgacctaaaggagctgccttgcccacggacatgctgttttgggggatagactgaatccatgactggtcaaaaggggaagacaatataaaggcccagcccacctgcctaaggtgtgacaattccaaagtgttgctccagttcagaactcaccatgggattggctaaagtctttgttgcaattgcattgcagtttaacttcttctccttctgcccaatcctgttttctttatcccttaacaaatgttgctctcaagagcagtccctcataaacttcctgcacaacagtctctgtctctgtacccaaactaagaacatatcaaggcatattgtggtgaaatttcagcatttaagaaattaaaaagaagatccgaaaggctaccagaggggaaaaacaatagatcaactgcaaaggagctggaaacagaatgatatttcagcaacactggaatctagaaaagtgccttttttaaataatgggaggaaaatacttttatcttaggttaatatttaatcctaggttatagatttcattctagaagtatataacagtctaaataagtggaaggatggcataaagacttactcaggctgggtgcagtggctcatgcctataatcccagcactctgggaggccgagatgcatggatcacttgaggtcaggagttggagaccagcctggctaacatagtgaaatcctatctctactaaaaatacaaaaattatccaggagtggtggctggcccctgtaatcccagctacttgggaggctaaggcaggagaatcacttgaacccaggaggcagaggttgcagtgagctgaaatcataccactgcactccagcctgagcaatagagcgagactctgtttcaaaaaaaagaaaagaaaaagacatattcatataggcaagtactcagtaaatctttatctttctcaagctactggagtaaagtgatacaaggaagaataacagcaaattgagtataagaaaagtaccaaaatgaaagggtaaaccaagaaagagggagacatgagatgcaggaaaatagatgttttcctgaagactggcaaagagacaaccccgggaatgcagccatacagcaaactaagagaaagatcagcccagataggatcaggaggacagagggctccagcaaggagggctctaggaaccaggaaaaataacaataatagtaaataataataaataactaattataataactattaactcctgcagaagtttgtacacaaaaggaggcataattctagtgagctgagtaatatttgcataatcattcactaacgtaaatgttgactactgatttagtaaaagaaatggctacgctggcacgttaagaaaaaggaaatggtggaacatggtggtgagctagatctttatatagtgtgtagtgaagtctgggataccttcttaaatcaatgaaccaggaaatgacagtgtatgcacaattttagaaacatgaaagtcaatattaggagaagtaaataggagagttaagggggcttgcttctggggagtagaagtgaaaaaccattcaagaaatgactcattcatcgtaaaccatcaagtactaacttgagtatgttagacatttaaagtcatgtgtatgcattttaaaaataacatttttaaagcttatttaattttttaaaaaagttagaagtggtaggaaatggcctgctatgtagtggtagtggtgagtggggattgataagactcagagctggatgagtgatgaagacggtatgcatcaaccacacagattcctggaacatgcaagcattccctggggactgctaaagaaacttggacaaaggaatcctggtaaaggactcaaaccatcatggtatgccactttcacacttaggttctgctgacaggtttgaaccataatgtcagctgcctgccatctgttctaccataaacccttgtacccatggcagatattgctaactcagcatggctctgtttcacacacagatatgatcaattaacaaatgtccatcataggcatagaaaagaggcatggtaccacgtttgccaaaatgcttgtggcctcagaatccttctcaacacaaggctctaagagccataccattgggacagtgggacaactctggagggctcctcataggattagcatccctatatacaatttgccatccctagtatgaaagcccaccttccttatgttagtttgggtcctttgagaaacaagaactggatgcaaagacaggattaaatgtgtgtacgtcgattaggggaaatgtctatgagagaaaatggagaggttgggaaaaccatcagacctcattgcaaatctgcccctaattcccctaatgaagaagaaagggaagttctaagtgcagctctcaggaatgtttagcaagtccatcagggagtcctgaagccaatgccacccattagaggagtcctgtgccccccaaggaatgggcctgcctcagtattccatgttcaatcactggtgatgagaaacatggccttggcccaaaaacagtgatgcgcttcacagcatagaagctaggagtcttagtcaattatacttcctgcagttggaggtctgtggctcacattctcatggctgctgaatcccaccttgggaaatcaagagagttgagaaggcttcaggcaggccaatggagccaggtacctgaaattgaggtaggaggtgggacttgactccaaaggcagggcttggacactggaccaagctgaggactagctaaaacatggatggggtgaaagcagcttttcataagacacacccatcactgtgccatgtcaatttaccattgtcatggcaacacccagaagttggtgcccctttccatggcaatggcctgatgacttggaagttaccaccctatttctagaaaattctgtataatccatatcttaatttgcatataattaaaagtggatgtaaatatgactgaagaactgcatctaagctgctactgtgggcacgctgcctatgggctagccctgctctgcaagaagcagtacttctgctgctgctgtgccctgctgcttcaataaacgttgctgtctgacaccacccggcttgcacctgaattctttcctgggcaaagccaagaaccctcccaggctaagtcccaattttggggctcacttgccctgcatcaaaatcaaaggtgtgaccatagagtcacaaggaaagattgagacattggagagtgggccagggccagaccttaggcggtagcagacagactggcattgtcggtcatctgcctccctacagatttatcatggcgaatggccagatctagatagaaagagtaagataggaactttatttgcctgaatttgggcaatgagataaagggaaggaattggaatcgagagctaggaagacccttaggagtcctcctatgtatttgtcaaggactccgaggcgctgatccaatatatttttgttccctttaatggctcagtcaaagctgttttaatcagtaattacattagaagctacaattagttactgcactaacaacaaaagccattcataggtaccgactaagtatttattcttagacagtgagtattaaaaacagagttcttgacctctgggtgctcacggtgaaattgtagcattagcagattcaacagcgtatgatgcaaacacacacacacacacacacacatgcacgcacacccaagaaatgagcaatccctttcacttcaaagagagacatttgtaggaaacggccaatagaagtcagttactttatctggtattcctgaaacagagattttcttccaatgctagataaaatatttttagactctagttcccattttccccagattcattacataaagaactgcctattttgaactcattcctgatatcatctctacagagccccacaggcctaatcacttatattaatgaaaagcattatttgtgcccatcggggcaaacattgctcatttagatacatctttgtcgttgattcccattgaagctagtgccgttgatgcaattgtcaaaacatgaatgattgtaaacagtaaacttggtttgaggtacttataatattcttaagattctctgtcctctaactcaatatgtggtgagttgtgtctttctttgcttccatatctgagtaaaaaatagcacgaggatgattccaagtttggtttatgtacactaattaagcttcaacaccctgaagtatgaatttgttacccattgaacagataaagaagctgtgttagataagtcatttgaggtcgcatcatgagtcacgaggccatatcagaacatgaatacttggcttaatctgtgcttttgtgtcagatcatatgtttcaactagttcaacatcacattgccagcagaggtcttcagcaagtacattctagtgatcaatcagagtacttggcagaagagtcatctttgtcatagaatttccaaagcaaagtccaaacgactctgccattggttattaaatgacaccacatgctttttccaaacttaccttttgaatgcaagctaaataaagaaaggacttaagaaatctttcagtgctcactttggcagaacatatactaaaactggaccatgaagcactctatatttttaaaacttaaaattaaaaagaagaaaacaaaaatgacacaaaatgggaatcttttagctctttctttcacctgggtaatcatattcaaatagttaatctatcactttattcatttgtagagaaaaattctctttcaaaaggtggcatcaagaccagctaaacatggtgggaagacactgaaaaataagagctccccaaatgacaaatgctaaagacgttgatcaccgagatgctaactggcttccccaaataacctaacacttcaaggactgcacgtttattatgtgccttggccgcatcccttccatcatcactaatgaacctctcagggacctgcttgaccacattcccatcatctataccaaattaaagacaaacaccgcattggaaattcaaagtatttacctcccttgggagttgtttaatcaagtttcatttggagtatattcctaactctattgtaataaaaaacaattgagttaatagcgtgttgcatttgggaggatgattcagtatttgtctgaaaagtggtggtgcttttttgttgttgttgtagttgttgttgttgttgtttaaatactgaaaataagaaaaaagatttggcagaggcccagctcttgaagttattgtatcattctaaccattaaatataaaaagtctaatatatgtttcttcttattatttttgtcaaatatgtgactcctgaaatttctttcattagccttaactgtattaattttatcacagctacaaaagcagaaagaaaatcatgctacaatttctacttcactcaggtggttgttctacagttcatatgtagagttaagaaaacatatattaaaaatttaaagtattcacctgaagggtgtaattttcataaggaaatcaacaaaccaaataacaatttaccatagggactataataaggggaaaaacagtacgcttcaattttgctttaaaaaaattctgttgacaatttccagcacgcacacacacacacacacacacacacacacacacacaccctaacacaccttctcaggtacccacagctcctctcacatgtacattccctcacacataagaactcttatttacccttacacattcacaaacccatacgtgcccacacacaccctcaaataccacacatcctattataaaagggtctcaaaagaggaaaatccaatagagaggtgttagctatgaggggggagtttctatacgtattgctagaaattcttcaaaagggaagatgtgcccttctctcccacttatttatttattctatcatttacttacatcagcatgggtgtataaacatttattcttcaggttataacccaatactatagttatttattttgttgctcaaattgttccaacttatattcatatacaggacaaagaattattgctgcacaacagggaagggtcacacaagatgctcctaagttaatattaatattcagctgagtggtaggtacttgggtgtttgattgttaatattcaaattgtatgtatatgcatacatcatagtcattattttgtatatatttacaataacaaaattacctccccaaaatgaagtagatataatttttctcctaatgggctggtaaaaagaaatatctgttaatattaagtgtaggcaaaaatatgggcagatgggcaataaaagtatgaattgtaattttattctgcagggcattttggcagcatctgaaaaactcgaattgggcatttctatgaactgtaacttcactgctcaggactcacctgggggaagcacctaaggaggcaatgtgcaaatgtcttcagcgcagcaaatcttaaagcagccaaaaactgagaataggttaggtgacattaattaaggcactgactaaactgtgatccagccatactaacaaatattatgaaagacaaaaaaaagtgatgtgaaaccatttatggttcacatgagcagatcttcaacacagtgttctgtgaagaggcaacttgcagaacaaatatagatcccatagagatgtttgtgtgtattttttatttgctctaaattatgtccaaaaaataattggctgtttcaaaaagcctttaaaaattgttccactttggtcatggggagctctttgaggttggctcctgtctcctctctgcaaactggcctgaggactagattcagctccttgggacggggatagtgtcttatttgactttgcagaatggaaaaaaatgccttattcatagatgtcagtgggctagaaattaaaaatccaaattattcttctaacataacaaatactctttttaaaaatttttctttctttttctttttctttctttctttttttttttttggacggagtttccctctgtctcccaggcttgagtgaagtggtgtgatctcagctcactgcaacatccaccccctgggttcaagcaattctcctgccttagcctcctgggtagctgggatttagaggctcctgccaccacacctgtctaatttttgtatttttagtagagacagggttttggcatgttggccaggcttgtctcgaactcctcacctcaggtgatccacctgccttggcctcccaaagtgctaggattataggtgtgagccaccatgcttgacctaacatagcaaatactcttgggtgtaaggttgcaccacaagcacctctctctaggacagtacgtttcacatatagagtgtgtaatgggttctaaaccatgtcctgttatatgatgccatttcatctctaccaccaccctgtacaggtgatgttcaaaatatttggcaaccagtattagtgtgagcatcacgaccaatcagaacctacgttggccttggcagtggagcaagatcttagcagctcctggcagggccaggtttctacttagctgctggagaggaccagatctggggtttctgagaagtgaggaagggtggctggggaagttagtagagggcgtgctgggacatagcagtgcatacggactggaaatgttcactgtttgtaaaacaaggattattgtatccattttataagttgagatcaaacaatgtgcccaagagagcagagttggagctaaactagattttctagcagtgttctcttcacaacagcttgagttttggaaattaaggaaatgaatttgaattttgaaattaccccagacttagaagtaccttctacttattctcagaattccatctcatggtattacatgacacattattgcatttgaattctaaaccaacaatgctcaaattgacccctgacactttgacgagactttctgtttatagtgggaagaaaagacacttgttttcccttgtgttttttatcaagtatgaaagtgcattttcctgttttccaatctaagactccatccttttgcagcaatgctctgctccaagttaatgcccgtgggggcccagtggcttccttctttttttttttttttttttttttttgagacagagtctcactctgtttccccagctggagtggagtggtgtgatctcggctcactgcaacctccacctcccgggatcaagtgactctccttcctcagcctcctgagtagctgggattacaagcacctgccaccatgcctggctaacttttgtgtatttagtagagatggggtttcaccatgttggccaggctggtcttaaactccagacctcaagtaatccacctgccttggcctcccaacgtgctggaattacaggcatgagccatcccgcttggcctttcgtctccttaatctgcttcatttggcctcctgttggcctgcgctactggatggattctcattggattgtacattttaaatccttcatttcttccttcactctctagaacagaccctcattcctggggagaggtgcaggtttgcattttctgccttccaataagagtgtcaagttgaggcatgcacctgtgtaaatgtgtatggagagggggcgggtgggtagatttgtatgtcgggtggggggactgtggattgtggaatcaacttttctttttgctaacttattcaaaaccccagaactcctcactttgaacatgtgcaattaaaacataaacaaaataccttagcaggtatttgtacaggaatacagtcttactcatcactctatgtgagaattggatatgtacttgtttcaacataatagcaagatcacagcagtacattggattgtagttagggcatccagtaaaaataaacaatattgtttttctgtacattttatgtggaggtggaggtagatggtaatagtgtttacttttggtggctgtgattattcagtttttttaatgataggaattatacatgagcctcaaataatagtgctcatgtggagactgggaactctgtattgatattgtgtttattttaaacaagagaaggtctttgaatccttatagaagtatggtgaggccttttctattaaaaaagtaactcgaactgaatcaactgccatgaactaaaatggttatgctttgtaataatattattctcttaatggagaatctcatgaacgtttaaatatacctcctggccgagattcacagaccttccatagcctgactccctccttccgtagcctatcttccacaagaccttcctgactccctccttccgtagcctatccaccactgtcctcattgtctactagagctgtcaatccctgggccgcctgcccccagctcttataatagggacagagccactgaaggtgcaatcctcacagaagatgaggcaataggcaaccctgtgtaaagacagaatatttaatttctgagcctcaagttcaccaactttaaaatggagatgataataacacaccacttatcaggttattttgtgaattaagtgagataatagattaaaggtccctcacaggagagttaatgctcaatctcagctaccattggtgtgttcagtcctttcttaagtaagggaccatgagggattggatccatgagagagggaaaccaatcaacagactaactagcattttatgccaagaatgacataacttaataagctctttcagaaatttgactggaaaatactaagagaaaaaggcttattattacttattatttactttctattacttatagaagctgaagccgaaacatcacgacattgaagagaggcacactgggaaactgtaatgaatcacaggtgagctcaatttttaggtctctgtgacctctgctgtctgcgaacatatattggattatccaatttactcatttattacatagatttgctactgtggacttttgaatgtgtgcatgttaatttcttgtccctgtattagttagggttcagataagacaactgccatgactcctagtaccgaccctagtactgcagagagagagaggtataagttacgaaagcccaggatttggggccatctgctggaagctggaatcctaatgggttgtcaggcaggaactgggatcaggaagaggggggctgtcctgtagaaatggtgctacagagtagaaatggcttctaccgcatgaagcagggtgggggagatgtcctctggcttctggcctccacttttctttcagtcttgtaccagtgcctcctattggttaaatcacctggaagcccgagggcaacagagcctgaggaatgtggttccctaaggactgaggcagagagcaaaaaggcacatgactagcaaggcccacccatgtaactgctcaggggtaaatactatgtcatttactgggtgtttcctttctgtagatggttgttttcatcatagacatgtattattgcttctggagtatgattctctctctgaagagctgtgagaagaggagcactggaactccatagtcaaattcaagagaacagacttagaagtataaagggtatttttaaactcatagaactctgtagcttgtgtctaatgttttccagctacaacctgatgactcagaagattttgtgtgtgtgtgcttttgtttcagcaaatcttgattatcaatgtgatcagccttctctccgggatctgcggggaatgattagcaggaggctagctgtgaactgatgtagataattttgcacttgaaagggattcatgttacatccttaatctcaaggatattttaagttagcatttaaataaatgtttacacacaacccgtggtggtgatggattctgaattttggataatattttatgtaattgttttactaccttcccagtcactctgaggtgcatgtgtgtaactgcatctcaattaaaatatcaaagcaattgaaaatcagaggcagctcttacattgtaaaagctaattttagctcatctttgcagtgtcagaaattttatctacttgtagaggatcactgggtgacacaggtcttgccatttccattgcttcatagcagagaggtggatttcagtaagactggctattaacatcctgctatagctggacaccaactagtaaagtgagctatacttcttcaccaactggaaactctacaggaactccttccaagcctggttttaactcgtcctgacactccatttgttcatgctttgctcaaggagttcacccacgatgtatttatttttaaaccaatctttgcaagagctatcaccttaccgacaaacaaatcaaagacttactggatgttgggctgaaaatatccctgatgtccatggggtctgggattacatagccaggaattctatagtttgtaacataatgctgcatttcacacatttgtctcctgaagtcaccccttgtttgtaaaaatattattcttcctgccatttttagatggaatcaacagacatatgaatgtaggtctggcctgtttcagaagacagtgaagaggtcctctcattgtccacacttcttatctcactaccagttcctgaatatggggcccatgtcttgtctttcactccctttagtgtgtcagacatggaaagctgggtattggtggagtatctgcaaggctcatgttaaccctcttcctctgagaattacccctctccgtacacacaaggagtggaccctagacagccatgtgtatacaccttgccttcatcccacattaattggaccagagcagtcagttacatgacccattcagcaccaattagtttctctctccctagaatttggacctgagtaacttctgttcagtgtggtttggagccttgaaccaacaagacgttacccggggagatgtaagtagttattttggccaaaggcatgaagttcaagacaaattaaatgtaaagagaggaaagaataaaccagatatggagacaaaagccaaagaaaagaggtgagagtattgcccggtgaattcattatctattgctgtataacaaattacctaagatgtagcagctttaaacaacacatatttgttaccttacacagtttctgagggtcaggaatctgggactggcttagctgggtattttggctcagggtctctcacgagtttgcagtcgggatgtgagcctgggctggagaatgcacttccaatctcactcgtgtggctgttggcaggagacttcagttccttgccacatgaccacctccatagagcggcttacctgacatgacagctagcttcttcagagttgagagagagtaaccaagatagtggccatgatattgtgaaatgtatgtttggtcttcatctccattttcataggttcaggaggcatacaactcctaaaatccttagaatttccaaaataatgtctttgtctatgctaatgagttgactagtggatggcaacccctgggtagcttcaggatgtgggttgatcacaagaaagaccaaggcaggattagagggtgggaaatttcagcccatccccaacctctggggaggagagaggggaagaagattaagttgatcaccagtggccaaagctttaatcaatcatgcctgtgtaatgaaccttccataaaaaccagaagggctgtgttcagagagcttctagagagctaaacacatggagattcctggaggatggagcacccagagagggcaaagaagctctgcacctcttcccctatacctcacaccatgcagctcttcatttgtatcctttaaaatatgctttaaactgataaacacaagtaagtatttccttgagttctgtgaggtgctctagcaaatcaattgaactcaaggagcgggctgtgggaaccccaatttataactggtcagtcagaaacacaggtaaaacaacctggggcttaccattggtacctgaagttggggactgagctctccacctacaggatctgatgctatctccaggtgatagtatcagaactgaattgaattagagcacacccagttggtgtccactgaataattcattggttgttgatggggaaaaatctccacacacttcttggtgaccagaccagaggtcacagaattctttgtgttgattgttggagagtgagagaatacaaaaacactttggtttgtttttttcatacatcaacagagtgctatagcttaatttttctcctcttgggtgtgatctggcctaagtgacctctattccaaagaacagactatggaaagaagaaaaacagtaattatacaggggagaaatctggcagaccccacctcaatcaatcaactaaggttaacatcaccagggagtgataagtcaggtggatattatgtacctctgatatatagggataagaaaggaaccttgccttgtggtattcttccccaaatccataatcctagactaattccaagaaaacagcaggcaaacccgaattgagggactttctgtaaaatacctgacacatactcttcaaaactttttttttttttttgagatagagtttcactctgtcacctaggctggagtgcagtggaacaatctctgctcactgcaacctccacctcccagattcaagctactctcccgcctcagcctcccgagtagatgggactacagacacccaccaccacgctcggctaatttttgtatttttagtagagatggggtttcatcatattggccaggctggtctcaatctcttgatctcatgatccacccccctcggcctcccaaagtgctaggattacaggcatgagccaccgcgcccggtccaaaacttttaaagttactaaaaagagagagagaaaagagaggggcagagacagagagaaagagagagagaggaaggaaggaaggacggaaggaaaaaaggaaggaaggaggaagggagggagagaggaaggaagaaaaaaaagaaagaaagaaaagaaaagagaagaaagaaagaaagagggagagggagggagggagagagagagaaagaaagaaagaaagaaagaaagaaagaaagaaagaaagaaagaaagaaagaaagaaagaaaaaagaaaagaaaaagagaaagaaagaaagagggagagggagggagggagagagagagaaaagaaaagagaaaagacctagaaactgtcatagacttttggagattaaggatacttgatgaataaatgcaatatggtaccctgatttagatcctggaacagaaaaaggaaatcagtgaaaaaactggagaaatctgaataaagtctggggtttcattaatagtgttgtttcagtgttaatttatcatttttgacaaatgtaccctggctgtattaatatttgggaagctgagttaaacggatatgtatctctaaatatgtaaaaatgaaatctcttaatcagtggcttaaaataaaggtttatttcttgtgtatgctccatgttcaacatggtttgatgggggagggggctctgttccatgtcatccttactcagggacccaggctgtaaggagtttccagcatcagtgattgtggtggatgagggaggagaatgtgatggatcgcacgttggctcttgaaggcttctgcctggatgtgacatgcattgcacattcgcattttcacatgccattcatattccttggtcaaagcaagacgcatagccaggcctaccttaaaggtgtgggaagttctgttttaccatgtgcctgaaaggaaatattgctgaacaggcctgatggtcactgtgataaagaatccatggcagagtgccaccagagagtggcattgtccttctgtctcctcttccctttctttctctttctttttaacttcttccctttttcattcttttttctctcttttccctccttccttttccttaatttaaaaaatcatttctaattgcagaaatgatatatctgaactgcaaaaaatttagtaacactgaagtattaaaaaattgccaatttctcttttcctgccagcctactcttttttttgttttttgtttttttttttgagacagtcttgcactgtcgcccaggctggagcgcagtgactcgatctcagctcactgcaagctccgcctcctgggttcacgccattctcctgcctcagcctcccgagtagctgagactacaggctcccgccaccacgcccagctaattttttatacttttagtagagacggggtttcaccatgttagccaggatagtctcgatctcctgacctcgtgatcctcccgccttggcctcccaaagtgctgggattacaggcgtgagccaccgtgccgggccaatatgtactcttaacagatggaatgggcaatataattccagataattttttatgtaatgaaattataaatattactgtacattttcacattccagtcatattcattttcaaatcacaaaaattacaaaaataggaccatatagtacaaagtatttttcaacttgctttttaatttggcagtatatcttgaatatttcttcttgcttttaagtcaggaaacaataacaacaacaataaaacattaacaacaaccatttattgaacacctattgtgtgctccttgctgctttagggaggaggtatttactgctaaccaagacagagtctctgccctcatgaattctctattctagtaaggagatgtttgtgtctggtccctcctttatgacaaacagttgtgagacctgagtgaaattttttggtaatactagcgtctgtgcttgtgtttttatttttaagaacaaggaaaaatcagggagtaggccttatgttttaactgcacctgtgggtccaattctaactgtattcgtattttggttgttgttgttcaaactgcagttgctgactcttattaacttacataagaagaaggaattaatttgaagaatattgagttcagaaggaatagttcagaaggaatagttgaacaatcatgtctggggaagggtaggaactaggggtccttggagggtctctgtagcaggaactctcaggtcaatttggtagggtgctgctcttggatgactcagctccaacagccttttctcccagggtttcttagtgggaggtccagttcgctgagatagcaaggtttatcggtctagcttaagtcagcagcttactactctgaccagaaggagttgggtaatattgatggacagacttaccaataccacctgggatgggggctgggcagttccccacaggcaaagggaggtgctcttgggagaagaagggaagaagaaataaaagctgaaccaatcaaaaactggtgttcagtgcactaatttcctcctttctctgcctgttcccatctttctctcttactttcaatattctcaattatgagaatatcctcataattttctcaatttttctgcatttcttctgcttatcaacatcttgactttggcagtctgacaggctttgttgaattgtgctagtggggtataagtgcctgagggtttctaatctcttctctgatgcctctaaaggaatgccttctgagttgcagcacatttgtctatttttaaacatgtggagactcaatgatatctcagtgctttgtgcctttcatgttttctaaatagcaaaattgaaaactcctaaatttacttatagcactgtttatagtggtgaaaattggaaacaagcaagatgatcaagagggattggttagataaatcatcctgtgtcttccacaaccatatcatccagtgactcaactcttttttcctctgattatagaaccctagaagaatccaaggagataggagctccctttctagaaaaatccacatgtattttgcattaaagttttcataaatgttttgaatatttgcaaaagtactaactttacctataaatccaggagtggttcataatcattttatataaggggacttcaaaaagttaatgaaaaatggaattaaaatataaaaataagaaatacaaactttattttccaacacaacctccattaagatcaagacactttcattaacaatgatatcagccatttagcccatcactaaagaactgggggtcttgggaatttattcatgtcaatacagtcttttttacattattaactgaagaaaaataggtgccatttacagatttttttttaaagatcaggaaacaaaaataagtcaaggaggaaagagccaaatcaggactgtaaggtggctgcttcatattttccctttgaaacacttgcaaaattgcccttgtttgatgagagaaatgagcaggagcactgtcatggtggacactctggtgaaattttcctgagtgtttttcttctaaagctttcacaaaactttctcaaaacactctcaaagaacaatagctcttttgccctctagaaagtcaacaagtacgatgcctcaaacaccccaaaacactgttgccatgacctttgctcttgagtaatctgcctttgctttgactgtaccacttccacctcttggtagtcattgcgttgattgtgctttgtctccaggatcatagtggtactcatctgggtacaatggtttgggcaccaatcaaatggaaagcttgctcaactttaattttttagtcagaatagtgtatgctgaaccaattgagatgtctgtggttttctgttgcttctgctggtaatcgtcagttctcttaaattagggcatgaacaagattaatttttttccttgaaaattgatgtggatggtctgctgctgcaggcttcatcttcagcattgtctcttctcctctgataatgagttatctatttgtaaactgctgatttctttggggtgttgttcccataacttttcataaagcatcagtgatttcatcattctttcacccaaagtttaccataaatttgatgtttgttcttgcttcagttttagcagaattcatcttgctgtgataggaactcttttccaactgtcttatctttcttagtgcctcaaactagatcccattcagatatgctatgacaagttagtacgagtttattttggtgcaaaataactttgaaatccacgcatttttttcataatacatattttctgtggactttctgaagtcccttcatatgctcttgatgtaacgaaatactctgtaggcatgatcattaaatatttttaatataaaaatctgttcaaaatatattatctgaagaaaaacaggttacaaaacaatgcatatagtattgactcttactttgaaaagaacagttcgtgtatgtgtgcgcgtgtgtatctatatatgtgtgtgtgtatatatacgtgtgtgtgtgtatgtatagttacattaagaataaatttggacaactgtccaaaaaatactaaagtcatttctttctggtgggtcaattataaataattttttcttcttgtttattgtagtattttctagtacttctaaaattaacatgttttatttgtgaaactgaaaaatagatggtaataaagagtggtacagtaaacaggtgccctaggcactaattgctcagccttttaaaataaaactattgagatatgattgacacataaaaagctatatatacttaatgcatacaatctgatgagtttggagataaatatacacctgttgtccagcctttttatgctgtctggtttttatggctctttgactggtggtagaaataatttagtagttaaaagaagatcctatagcaagcactaaagagaatcctgaggtttaagtctatagttgatcacttcttctcaccgtaatcattgccatttttattactgacctaaacgacatattaaaaaattgccgttcctcccctgcccccgctttcaaaagccacatgcatgcattgtaaaaaaatcaaacattacaaaaaagtacaactttgaaagtgaaatttctttataattcctcctcagccccaatagtagctcttaatggtttaatccatatacaccattgcacacacaagttttttgatttttgtttttgtttttaaacagggtcttgctctgtcatccaggctggaatgcagtgcagtagcatgtttaagcctcagtgcagcctcgacttcctgggttcaagtgatcctcccacctcgacctccagagtagctgggactacagacacatgccaccacgcctgtctagtttttgtattttttgtagagacagagttttgccatgttgcccgggctggtctcgaactcctgaactcaagcaatctgcccacctcagcctcccaaaatgctaggattacaggtatgaaccactgtgcccagcttgtttgtttcttaaatgaaaatagaattgacatatattgctttgtaacatgcttttttatttcatgtaaaatttattttggacatctttctatgtcagctcatagaactcagtctcgttccttcttaagcacttgcatggaattcagttgtaaggatgcatcataatctatctatagtcctcatgccatggatccagtttttcaatattatgaaaaatattgcaatggaaattcttgtacatacatttttgtacctttgtgagagtatttctacagtgtagtttcctagaaatggaattcttattcttaataagttttcaccaggtaactgatttgcagtcccaatttcttagttaatctatgtgttaccaaaagaggcatagaatgcaaaaagctgagctgtccagttgattgtggattgttcctcagaactcttgctttactgaacagcttaaatgagaagaaaacatggctttctaagtctgtggcattcagtatgttcgctttgatttaatcagtcacaggaaaatatatcccagaagagagtgtatatctccaccccaaaccctcttctgatttctatttgagagagagtgaagcccggtgactatttgggaccatatgtaaggactactgaggctgtcactcagaatgccaactaagttggcagtggaaagaggtaagcatcattccaaaacattattgttttggtgattcaagatatttagattactaaaatactgatggcatatttggcctcaaaagtgatccaaagccatttatccctctctccctcccacatctgcatagatctgccccacaaattaaaaagtactgcttttccagccctacaggttaagaatttcctctgcatacagaaatgattatgaaaattaagccaaaacacatccatacaaggggatgctgtatggtaatgaaagtaaataaactaagctacatatggtttcatgggtgaatctttttaaagaaagttgagtaaaagaataaagatacaaaagaatttatacagtataactcctggttagttatctattgctgcataacaaattattctaaagtttcttggcttaatgcaacaaaaatcatttattattcatggtttctgtaggtcagatatttgggagtggcttgaagcaaatctggctcagggttgctcatgagcctacagccaaatgtcatctgggctgcagacatctgaaggcctgactagggctggaggatcgtcttctatggtcactcagtcacaaggctggcaagatggtgcaggatgttggtgggagggctcagttcctatccacatgggcctcttcacaggaccgcttgagctttctactggtccttcccagagtaaacacatggaaagaagtagacagaaacctcaataaccttttatgacctagcctttgaagttggtcgcacaaaacagccctgattcaacgtggaaaaatgccagtagtaggccaggatcatcggcgccattgtggaaactgactaccacaatttcatttatagaaaaaaatctaaaaatagggaaaaatgaactatattgcttagggaggcatatttaagtgtcaaaacttaaaagcaaaaaaaggaatgattagcttaaaagtggttatctcttggaggaaggaagttgtaagtgggcaaggatcattatttgtaaaagaatacatttatgttttatgcacttttccttaagtgtgatatatttcataattttcaaggaaagttcatttcaaaataataaactaaaagaaaaatgacatgagaaaaagaaaggattcatttctctaataataatataaaattagccaatagttcttatatgttccagacaattatatttatatctttatttagtactcacaacaactaatgtggttctattaacctgttttcacaaataaaaaaattgagaagtagggtgagttagatatcttgcccaaggtcatacagccaataaatggtggagccagggcccttctgaggcagaaaaggaggccagactattggtatacctttaaaaactctatttttgcctaaactaaactttatttatttatttatttatttatttatttatttatttatttttgagactgattctcactgtgttgcccaggctggagtgcagtggcgtgatcttggctcactgcaacttctgtcttctgggttcaagcgattgtcctgcctcagcctccctagtagctgggattacaggtgcccgcctccatgccggctaattttttgtatttttagcagagacggggtttcaccatgttggccagtctggtctcgaactcctgacctcaggtgagccgcctgcctcggcctcccaaagttctaggattacaggcatgagccactgcacctggccctaaactagaaaaacttttaaaatccttagctgggtgtgtcaactagtttttctcagtatgtgactggcagcagtatgtttagtaccatgtaagtactaaatagatattgttttaaatgaataaaaaatacagatttatttattttgcaaaaatcttggatgatgctggttatgcgtcaaacactgttctatgcaccttacatgtattaactcattagtcctctgactgtctcctggtgtccactctaattcctttctaagagataagatactgggtaactttctttcttcacttgtccctaggtgttgtgtttctaagttcttgaaatttgactcctggatcttgctgttttaacatattactttggcaagtcaattcaatagcagtacattgagcacctattccttactgggttctagtggaaaattaagatgaatgtattttcctctgtaacctaataaatgaaagcttatcttttaaaactttcagacaacgttttgcattaacatggaggggaatgtcaaatcccttgaggtttatccctgtaaacttcaccggaggaagtgtatctgcatcttggcttattgtgcttcctatttcagtaaccttaataagtgctaaatatgcttctttcagttatttttcagcatatttctccaaatcacccagtagcaagtcttaacatgtctgcctgttgttttaacgaaaaaatctcagctccttatcaggaatcccactgggacacaggctaaattctatgctgataaatcagttcaggctaggatagagccctagtgatgaagcagttattttgttcaataaatatttgcctatttgctacatatgaacactatggaaaacctagtcaaaatcccattttcatgtgcattatctttgttattactgaaaggagccaatgtgactttgctagaaaacattttttcttttacttacagctaattcattcactcattcaatagacagctactgagtatctatcatgggcatggtcccagccctgtaggagctcacagtttgggcaagggcagctgtgtactgggtatgtgtgtgatggtgctggtggatgtgcatgaaaagttatgtagataattataatccagtgtattacagacagtgtatgtgaaggacctaggaatggggcccaaaaccaacttggggatctggtgaaggttggtagagttgggcaagacttcctgaagaaggtaacacctgattgggttctctctctctctctcttttgagatggagtctcactctgtagcccaagctgaagtgcagaggcacgatctcggctcactgcaacctctgcctccagggctcaagtgattcttgtgcctcagcctcccaagtagctgggactactggtgcgtgccaccacgccaagctaattttttgtattttagtagagaccaggttttaccatgttacccagggtgttcttgaactcccgagttcaggcgatctgcccacctcagcctccccaagtgctgggattacagctgtgagccaccgtgcccggcccaattgaggttttaagtccaaataattgcgttaggccaaaggggaagggaaaaacagactggcaaattctgataacttgaagcagtttggggttattgcagttgcttaatatgaaactcagggggtgatctgagaggatgaaggaagggtgggtggacccaggatatggagagttgggtatccagggttaaatagcttggcctttactctttagcaataggaatcctgaaagatttcaatcaggggaaaatggaaggtgagatacgtgttctcgaaagatacctcttcacaaaagtttcaaaaacaggagtgctttttggcccagcaattcaatttctaggaaattaatgtgaatgggaccaaagacttagctactaggaaaacagcgacactatctttacctataagagtgaaatcttggaaatcaaataaaggcccaacaatgcagagattaaaaaaataaattctagtaaatatatatagtggaaaaattatatattctaaaaatattaaaataaatttatagacaaggaacaacatataataaattcaagacagggaaaagtcagggacaacactgtatattcagtgtgatctccttttgaatatttatttatatatctatacatatatatgaacatattgaattacatatgactaggtataaatatctgaatagtaggattaccagtgctttttttcctttttacttatccgcattttctaatttttaaagaataaatattattacttttctaatataaaaataagtttatttagaatattttacataaaagcaagtaacgttgctttggtagctatgtaaaggaggacagagaagcagaaatgcccactttgaagtttatcttccatcttttgctatattatgttgtgaaatattttgtgttctccttcttgctccaatcctgcgatctcagacactttggaataagaattaaaagcatgagccttccgttactgctcagtgttaggtttggagtctctaagtctacattagggtccaacccctctttcgctcctgccttagtagctctggggtgacaaccatctcttgccatctgcctggttggggctcatgagccacaaggcacttatttgttttaaacaaggtaaagccatccccaagctcactgctgagttctgaaccctgttgactcttcacagttgctccattgcaatgagttactcttgagacctatcagaatatcatttctaacccgtttaagccaccttgcagatcgcagccagtcctttcctaatccctttatgtggcctcttatattcagatccaagctcctcaaacttcacattggattattttcaaattgtcttcttctcatttttgttgagatttcattcagcctggtttgatgtcatcccttaaagtagtggttctaaaattcctacatgaataagaactagctggggagtttgctaaaaatgcagattcttcatccccaccccttggcaattctgatttaatagttctagctctgagtttggagctctgcattttaatggacgccccaggtgattctcatggacatggctcatggacgtcgctttgagaggggcacaacaccttcctctcctgatctgcacaacatagcactcttcccctgcccccttgccctctgcagtggctctagaaaagtacattatacagcactttcaagaataatatatttagaagttaatagttcatgatccacagaatccaggaggagccatagtagaccacagggtggtccttggtgcctctgagcttgcagatgaaatttttattgtgcactttttttttctggtaagaaggtctgcagctttcaacagtgtcagagaaatccataatccaaaaagttaaaagaccctaaaaatccgttaaacatatttatgccttaaaaattaagtaccttcctatttgacatgcttcatgtctaaagtttgtgtagcttaaattattttgggggggcagggcccatgccttggcatatatccactgccttggcacacatagaaagaatatatacgctgggaggatggtgcagaaaactctgctgttgatcatcacctctccccaaccctaacatcctgtttccttggtattttcctgttatttatatttttcttcatgtatacctatctcaccctctttctagataactggatagcctcttcctgttcactcctgtgctcattagaatgtatttcaaataacagaaacaaaagttgaattgtgtttaagaagggaagggaatgggaagatttttgggtttttggacacatgactgaatattcatgccagggaggctgcaaaataggattttttattttatagtctttaaaatagagaaagagttttggatagctagcatcttttgcagttaaggcttgggcacaaaacctagatccaccaattggattggaagataagcaggtgaagtagccaggactttgctgaatccattttggtggtggatggtggtagcagcatttcgacagtgtcctgtgtgcagtactggaggtgcaagctacgatgtttagtgatacaatagtggtgggaggtgtagtggtgtgggtgtgccttcactagaccagttctatggcatagattttggagttgttcccagttgcatggcttatatgttagggtctgctgcctttccttaggtttggtgagctactcagtagacttttgaagattcctttctgctgaaatacaccctagttagtttctgctggctctttttttccaaacatatcagacacaatcctgcttccgtatcttcatcatgtccattttctctttttgaatgacatggtttttaatctaatttcatcagaaatcataacccatttaagaaattgttatgatagtttcctctctcttttctttcttactttattttttaaaaaatgtttgatcatgaaaattttcaagcttacactaaagtagatagaatagtatagtgaattcccataacctgtcacctggcttcaacattttaccatttacgtttcatatttcttttcccatgcctttctggagatagaaggagaggagatgggatattttatgacagctccaagacatcatatcatctcacccatacatactttatatgtatttctaacagaaagagtataaaaatgagataagcataatatacttatcatacctaatacaaattaacaatacttttaaaatgtcattcaattccagcccacgttcaaactctcccagttttccccagaatgaatttttacaattggtttgttttaatcagggtccaaataaagtccacataaggtatttcagtgatatgtctcttttttcctgtttatttatttatttataatttttagtagatatgaggtccctctgtattgcccaggcttgtctcaaactcctgggatcaagcaattctcccaccttggcctcccaaagtgctgggattataggaatgaacccccaagcccagcctctaattcattttttattgatatataattcacatgcctaatatgtctcttaaatcttctaaagcctttacaagttcttccttcccctttatttcatgctatttattttttgaagaatttctcaatgtcttacagaatttttaaatctctgggttgtctgattctatttttgtgatgttattgacgtggtcttctcttgcattttttttcctgtgaactggtggttagacctaggggcttgattacatttagttttcatataccctagattttttttttaaaagatggagcttagtcacatcgcttccaggagtcttaatatcccgacccccagtggttgctcttttcttagacaattgtagtatttatctatcgctcttgttatccattaaatcctgcccatttctactcctaaaaggtcaaggaccatgtcctgtgtgcagggaccacatatgtgtcatcattgctatttccccatacctagggcacaatgtgcctggcacagagtggatgcaccaaaaatagctgttgagctaagaggatatgagagtacaaatcatacactgggtatctgctgcttagcattgctgctttatgtgtggtttctcattgtgttacaagccttgactcaactcatggactggaagcttcatgaggggagggaggaagtcaaatatatttttgtattccaggtacctaacacattgccatgcccataccttgcacatatttagtatagagtaaatggggaacccttgcctatccatctctgaaggatttttgtgagctcaaataagagatgtatgtgacaagtgtatgtaaaaagtaatgtattacataaatacatgtaatattaataacaacaattataatctgtagtcattgcttttgtacatttaataggctcagtctttagtttaaatgtatggatctattgcctgttatcatctatttttcaaagtggtacctaaccctagggcttaactcattaatgaagagggattacagggtacatctatcaggtggccagcttttggttatgtggattaatggtatagcaatccacagaaaatcatccatttaaaggagtgaaatatttttatggtgattatgcgaagctcttgtggttgcaagtgacaaaaaaatagttctagcaaaaaggaatttttttttgttcatatatctaaaaagtccaaggatatctgacttcaggtatggttggaacaaggaagtgaaacaatgttgtcgtacttttctattctttatctttgcttgtctcttcttctttttgttgatcttatctcattctcttccatttcaaattagcttccctaattgcccatgggtaagtagctccagattttcttctttctagcaaagcaaacagtcttctcccattgccctagcagagaagtcctaaggaggacttctagtcatctcaaggtcccctgtccagtcttaaaggaatcagaatgcactgggtagcagactgcactgtaatggataacccagccatatgtaatggaaaataagttttcctgaacaaggagtaggatgagaccagaagaaaaggtataggagaaaaaaataacagctatctgtgtgaacctcaggacaacctcagctcagaggtctgcaccctggagacctctcttgcgggtgtacttagttgaagatgaattcggaggtcttggttttcctgagttttctttcctttgaggttagtcccttaggtctggaaggtcactatttgatgtaataagtgatgggtagactgtttcactgcagatctaaagaagttataaactgcagttgtaacataaagtctgtgatagccttcagtgggtcagctgaccaaaattatgcacagttttgtttctatctgtattttctgagaagaggatccgtagcttccctcagattaaaaaacttctggtgagcccaaagattaggcagcttcccatgtttctcaatggggatacataccactgaaatttggacaagaaaatttgttattgtgcaatatgtgtagtgtctctggcccataccccttaaacgtctgtaacatccataagttattatgacaacccctcctcccatattccaagcactgataattgagagcccagatgagattagaagtctagactgcatgtttccttcatgtttgatctttcttctttctctcccagagaacatgaaggaaacacgttttctttgtttgcttttgacagctaatttccagcagtccatctattaaggaatctaggatcccacttttatgagcacaaaactcccactttccttaggggtgttctcaggtattctgacatagtttaatagtttcaggggagggcctaaaagtcgtatgttggggactaatttttattctgaaaatttggtaattgctactgcaacatagtgtgccttctgcactttttccaaatcaccttgagaactccagccctaacatcgatccatcctactggatgtcttttctgatgtgaaattaaaatgtttcagtgggaggcaagatatgcaaaggggtaactcctgggaggtgcccagttgtcactgtagcctctttagaattttctcctaggacagtcatttagtttattaattctgaaaggccaaacaccaaaatgagatgttaatctgaaaggaataacttcaagacctaataaagaatgaccactgagcagagtttttatagattgcaaatcactttctcttacatttgaccttgcaacatcttctaaaactggtttgccaatctcttcttttatggatgaagaaatggaggcttctaggaaccaagtgacatgctcaggattgcacagctcttcttagaaggactggggatttcaactctgagtcttatacctttaaatgccactgtaactctatactgcctccctgatgcctcaaaacacttttgaaaagaaggaacacgtcctactggagctaatcagagggaagaactagaagtacaaatgagccacaacggagagttttaaaattctcttccctaagtgagttccgggaagctcgggaaggggtggacacttgtacagttcacttgtacatcttcactcctgaaatgctaggacaaatctcatttgaactcccagtcaactgagaaattaaaagcagagagcaacgacgctattttgtaactttgtgccttttaaaattaaccgaatctttcaattgctgctgtagattagaagtggctacttggataaaggggaaagagccattcaactgatgaatactattgtaaaagtccagacttagttctagaaaaggaacgcacaagaacaatttctccaataacgttttcattacagagcgaaggaaagttcttcctcgttgttccaatccgaggacaagctgatatgtcgcagcagcccagggaagcatgcgagctgataggaagtccttttattttaagacaggctcgaatgctaaaactttcttgtgccaaaacccttgactattttatttttaaaataagcacttggcgtgccctcgcagatgtctgagctgagaggtcggggcgatggtagaagagcagtcagtgtccattcttattcatattaagtagccaagtctgtacccttgaagcaagtggggagagaggagggagaggagctgctgacattgacaatgaatccaaacaggagttgcactagcggtgtccaccacgttgcctctcccccgcctggccttctgggagctgtagttttcgtgggagcggctccccaggcgagctgggaatgccccgcccgggccgaactacagatcccaggcggcgctcggccgccagcccctcccgcccgggtgcgagtgtaaactccccgcgctggggcgggcggccgcgagccggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcaggtgagtggtgacagctgggcagaggcgcaccgggcggctggggggcactgcgtctgccactctggggcgaggagagcgggtcgcgggagctctgggacaaggacccagtgcccttgccccggagcagagggcgaactgcccctcgcagttgggggccgcgcctgcccggcccaagtgcgcctttaggaagctcggatggagcgcacttcgcgggggcgcggcgggtcgccggggacgaagcgtccaggcgcggggaccctcggccgaggatgccagctgctgagactgattgggggctggggagcgacctggcgcgatgtgggggaggaggagcgccgggccgggacgctgtcccggtgggatgggggagaaagagttctagtgaaccccctttctgaagatcccagcgggttgagggctcggagagggagagctttgggtggactgagatgcgacattggagggaagcaattagttcgcttggagtcacctcttgggagtccggtctctgtggggaaactagcctctgggctcctgcaggtgaggtttctctgggctccgcctctcacctccagaccgctgctagcgggcgcgggaggggccagggcagcggtgggcgtgtccccttgttcaagttaaactctctggaaatagagtcccattcaaatccaggccttacctgcagaggggaaatgagccttggtcttgggggttactgggagtgtaccccgcttggcagagacacgtgtttaattcgctggggacttcagaaactttttagacgaggagtgaagacatccactgctctgatgccccatcccctctagtgcccacttcccttgagccaccctttttgctgcctccattcccacttgtctgtcgaaatggattgggtgtcttccgttctctctgtccggcagccactctggacgcctcgtacttctcgtttacaatgtttcctaaaagggacatggtcaatggaggctggaatagctgagaagggtttatttccacccctctaagctgtgagctaggataaggctatcattggaagcatccagcagggcttctgcactcggctgtaacttcctgccttgcccttcgctgtggatggggcctgggtgaatgggcctggctggcagagtgggagagggtcttgaaatgagggtgagtggagaagggcaactgaacggggagccaagtggtgtaatcttggcctctggcgagcactgggctggttctttttctagtggaaagtgcagccaggtttatttccttcagggctgtggcaggactctttatccaagttggggaagaaaatctgggaacagcggtcctactgactgccattgctgaagactctttgtagatgcttcacggcagattggaaggaaaccgcctaagcagttggacgtataaaaccagcctttagttggtggtttttcctcataatggctgttttgtgtgtgagcatagattgtgtgtgttgggggctgggggttttgagtaatattgtgtgaagggtattgttggttatgctcatcagggctttatctgcattcggctgaagggaccagtgttttactgggcagtctctgcttttgcttctataagcaaatgcttacacggccagaatgagggaatgagtgtgtgtgtggaatcctgaaagaaataaattaaccggactgtttggaacatttctgatggtagctgatacataacattaaatcagtttgagagagcgaggaaaataccatctggaaaaacccaaatgagtgccgtgaaactcatgttgcacgatttgggcctgttctttttcagagtcagcaaaaaagacttgtaagggtgaacgtcctcagtagctagctagcaggcacgtgtaagggaaaatgtgggtatgtgggaagaaatggcttcacacgttaatgctagaaacaggtgtgggcctgaaccagcagggaaaggaaggctaaattaaaaaagttgttgtaaaacttgtatatggagcacacacatgctctttgaaataaaccagttaaataaaatctgtgaataaatatatggagttggcaacatttctctatactgttttccacagttgtctaaggtattgtcgtcgacatctgttgtgtgacttaaaagggctgcacattgttcagggccttctctctcattgctttttgtcttatgtttttgctggggcacctcacttcttacaagtctttgtcggaaaaagttgaaattgatatgtgaagactgctgtagccgttctgcctatcaactgtcttctctggattgtccagagttgttagagttgaaaatatgtccagaatctgcccgcttcttaccacctcctctgctaccactttggtccaagccaccatcagcccttgcctggattattgcagtagtcttttaaactgcaatacccacatttagtgaattttcagtatagtagccacaatgttcctgttaaaactggttctcagttggaggtgattttgcccctggggtcatttgacagtgtctggagacatttgtgattgttacagtggaagggatcattacccatatctagtaggtggaggccagagatgctgctaaacatcttacagtgcacaggacagcccccacaacaaaggattatctggtcccaaattgttagtagtgctgaggtcaagcaactctgtgttaaacctcaagtcagatcctgtcattctctgcccagaacctgcccatggctcctaatttctcccagtaaaattcaaggttcttaagatgtcagctctgaccttatctcttgttgcctgcctcctacctccctctgctacagccaggctggtctcctcactgtttttggaataccccaggcccttccaccactgggcatttttatattgcacttgccttgatcatcctttgcccagacagacccagtgctcactcccccaccaaccagtatgtgcctgcctccaggagtcttaagaacattaagtgtgacgttgactgtgggaaagtattagcatggtgcctggcacgtagtaagtgctcaggaaatgttagcagatgttgttcttgttattttctttacagttcattctttaaacatcattcccatcacactgatagtgtggcccttttttgaccacagtatttgcgattgctgttcctccaaattctctgtcttctttgtccagctatatatttttttcccatagggcttatattataatctactgtataattttccaatatgttatgtttattacgtgtttctccatgctagactgcaaactccaagggaacagggttttctgtttgttccttgctcactattgtgtccccagagcctagaacaaagtttctcaacctcagtgctattgatattttgggccagataattccttgttgtggagggtcctatgcattgcaggatgtccagcagcatccctggcctctatctattagaggccagtactcctgcctctatcaattatggcaaccaaaaacatctctgaacattgtcagacatcccgtggtaggcaaagtaccctcatttcagaaccactggcttagaacaatgcgtgacacaataaatatttgtttgagtatgtgttgctttcttccttaataccataacccactcaaggtatggtatttggttttttgtttttgcaatgaatattgtgtttcctttaaaatagatacctactaggctttctccaaagaggaattcatatattgttcattggggctaacctcagatattcaagtctttcatgaggaaggacatgtttcatttctaacccagacatccttgcctttaggaatctgaagttgctggatttagattatgtgaatctcattttggtcatattggtggttaaggctgtgtataggaagacacatgctgtgggaaaaggttccaatgaattgtttgcacaccgtttcctccgacaaggttttagaaaccttgtgttctcctgggaatgagttctgaatggtgggtggcagaggaaaagcgctgaatatctagagtgagcccagaattcacataggcatagtcatggcagggaaacaaatgtgaaactgttgaatgagctcctaggagcagaggaagtctctacaggtcttttgtacccaaaaacattttaaaccgtaggagcatctttcaggctcatagtccttttgtttggtttactcagtccacatggctttgtagttgttaatgtccttttcctggacagacttcacagttggcttagtttaattccaatttcttcttaaatctttagtactatttagacagctgttattacattttctgcaaattagaaatgggaatgaaagtgagtattagctttatcatggcaggacaggatacagcagtgatccccaaatgctgattcacaaaggtgtgtgaacttttaaaggtttgggtgaaatgagaaagacaaagactgttgcgtcacacgcatacctacatatatttgggtgtaaggccgctgccatttcttggagttatgctgagatgtttttctcctgtcttcatattaaaaaatgccctttctttgatgacataataatccattcttggcaaaacaaaactgtcaatcattttttgatttctgaaagttttcttgattttttttttggtctgtctaatctgagggaaccactagcatagagatgaagagccttgttctgccatcgatgtctgtccctaactaactgggtgaccttgggcaggctgggtgacgtctaatttcagtttcctcatctggcaaataggggcctgcctccagtagtctcaagaatataagtgttacattgactgtgggaaaagtattagcatggcacctgacacacagtaagtgctcagtgctgacacatagtaaatgctcagtaaatgttagcagatgttcttgttgctattttctttattacctagcagcgaacctggcattttggaaggtgttttgcatttgcttgactgtggttgtcttctctaaggcaagtgttgttacgcaacacagttctttgaatgttagtaaattcctttttgcttttcttctaatgaagtgttcagataaatattttacactttgtatctttcatttaatcataacaattcttttatgctagttaaaaaaactaacaattttgacattagtgtatccataaaaattcgtgttcaacacatatttattgagtcctagtatgtgcacattaatactaataatgatgggtcacatttattgagtatgtactatgtgtgagccccattctaagtgtttttacgtgtgtaaaacctatttaatctttgtgaaatctgcatgaggtgatcataataaataaaaacaataatgatattaattataattttaaaaacagttaagacttatctagtgcttcctatgtgctaggcactattatgaatattaactctatattaatgctgttaattcaaccttgggtgtatgtaatagtttattattctcattctacagagagggaaactcaggtatgccaagttggtggggcctggagttaaactgatgcttctgtagctacatgctcttgtcctctagtctgtactatgcctggttgattgtgcaaaattcaaagatacatcatactgtgccctccctgtgtggtgagggaaagagaactcatgggtccagctaattatacaaggcagagtgtggtccctgtggcagggtgggcatcagcagttgggggcatttaacagaggaaggggaactggggaggcagttttgtggacaaataggggtgtttgagtttggccttaaaggtgaaacaatagtcaaatgtgtttctctacactaagtaaaatgttagacatcttggagggcatggtcctaaagtagacatttagggtttccgtttgccttttaaacttctaacctttctttaagctctttcttgtggtctccaggcacctgatgatacctcatggtggcagagaggctgcatgcatgtggacaggtttagagggagccctgcttaagtgctgtctgtggtcgctgctttgccacttaaccagtacatctgtgttcaagaaacttaacttcttggagtctcaatttctctaagctgtaaaatgagatcaatagaacccacccccttagggttggtagaacttttaaaactaagcaaaaatgtataaatgtgtttaacatagcacctagcactgttagtaaatgaaattaattcctccttttctagtagaattttactatggtagcagtttttacccttctcttaagaataactaaaacatatatagaatcatgcatccaaaacaaagtagacaagattgaggtgcctcaacctgcagatgttcaaatcgtactatgcagattcgttttgtggtatgattagagggaacacttgattaaagtgggattctcagtcttggtttcgtttgttattggagatttccttttcccgattactactatttacagattttacttaagttgatatatgtttaattccctttgagttctgcagtgcagtttgcacaggctgatgtttatatctgctccagttgtgcaagaagtggaaaatatcctttttttagaacagatcacatgtgcttactgtcaggaataggacctcagtgtaaaaaaatgtatcttgggacaaatcaaagttactaaatttccctctccaactgctttgtttcaggattggcagtattaggataaataataggaaaaaaaaatccttggctactttctttttgtcatctttcaaggacaataagtgagagtttcattttttttgtgtgtgtgtatgtttgtgtgtgtgaggtataaaatgtactttgctgagggtttgtctaatcggaataaattataaaaatatgtttgactacactccaagtatgcattatttggagaaaataatcatgaagacaggtcaaagatattaaatgcagccaccacaagcttttgatattataaaggcaaatttgcagtttataagaaggtttttgtgagtctagtgaacattgtgtactccgaggataggaattataccaagggataagtctgcatctttatagagacaaacgaggtcgagaagacccacagggaggtctgggatctctgttgaaatttctgcacctcccgttctattgcaaatgatcttgggaggaggaccaggtttggcttctcaatggtaagcttatttctctagcccatttctacaatgtggctttcttatttcttcgcttcgtctttccctcctgtggctttggatgcatgctgtgaagagtagagaagtagacctttggagtgttcacctgagacccctgtcctgggattcagagtgatgaagcttttatctttaatggctgacctttctggggacttctcaaggactgggtgctgagtgtcagtctctgtgctggccatagggagtccagtggagaagcagatgggttcctgctagcatggtgcatacatcttggaggtggcgcacagttaacaatgaaccaaatacatgagcaagatgagttttactaactgctatggaaattaaatggagcattattggtagaatgggcctatgaaagaagggggctttttattcggttgtatgatcaggaatgacctgttggaagaagtgattttcaggcaagactgaatatctgacataaaggcacaaatccagacactaccactcactggctctgtgactttggtcaagttatccaacctttctgaactctaattctctcttctgtaaaacgggacagttgccatcttgcaaggcttctgtgaagataaaaggtaatgtatgtaaagcagctaatattaggcttgaggcttagtaggtgttcagggttacccataggactgaagttaacatatgaatagtggaaaaagaagcacagacattaatctttgttataagtgtttataactcagtcttaaatgttttcctaatgttgagtgagtcagagattcatgcttgtctttataaacctaaccctggactaaaagaggagatgggtcttgttagttttgttatcctttctttcctctaggatcatcctacttgatgtcatcccttgttctcctgactgttgttgtcctgagataattaatgtctgaccatagtttttggggctggatttttaattacttttttggtgttaaggagaggcctaagtaattgaggattaaaaaggaaagcctgagattgatttcacaaaacatacacgcctaccacgaacaaataaccagtgtagaactcctgactcctagtcctgtgtttctgtcctgagatcatgcttcctgtccactctgttgtgaaaatgtcagtgttggtgcagaaacaaaaaagaagaagctctcctcccacataccacctccagtgttcaccaactttgacatccacaggaagtggcatgcatttaatttgacatctttaaaaaaatcttcaaagcatttggattttagtagctgtgttctttgattcaagtacccacagagtgataattttctttctttctttttcttttgaggtggagactcactcttttgcccaggctggagtgcagtggcatgatcttggctcactgcaacctccgtgcccaggttcaagcagtagtcctgcctcagcctcccaagtagctggaattacagatgtgttccaccatgcttgactaattttttgtatttttagtagaggtggggtttcgccatgttggctaggctggtctcgaacccttgacctcatgtgatccacctgccttggcctcccaaagtgcaaggattacaggcatgagccaccatgcccggccagagtgataactttcacaacgaaaaatactgggttgtgtgacagcaaatattttaagtctaagtgcatgccctatagagggcactggtagaatcctgtcatataagaaattgtgcctcattgagcaatttcaggaaggcatctgtggtcttcaccctccccacccttgcctcttctccaaagtggggtaacttgctgaatcattcacacacattcatcagttttcccatgtgattaagggcatcattggaaaagtggttgtccccactgttgggagaaagcatagcttgtatttgtagaataggtttccttctgggaaggttgacttgcctcagtggaaagaagacttgaggcagagaggtttcacttagcctggtggctgtggttatatatgaaattacgaaatgacagacaggaatgctatatttactttggtacctttaccataaaatattcctaaatactaactgattctaggaagcatgtttttcaaaaacatacattttattttttacagttggagatttgaaatttggtgaaaggaaatgctcatggaaatcctaaagatgatttccttgtttaactcaggacctagctcaatcctggtgaaggctactagagaacctcattgagatgtagccacactgtacctcttgcctgcagtgtgtcctaaattcgtagagatggtgctctaaaactgagttcatgaaccaacacacagatatgtcattggtcaaattgtaacattcccttccatcaaaaggactaggtatatatttgtcattgttttgttttgtttttagcatttgaattttttcagcgaaaggtggaaaggtattatttcagtgttagttttgctctgctgtattggtgagcctgcatagttgcaccatctaaatttaggatgctggcacctcagccaataagaactctttgtaactaatttataatgcttttggcagagagtgcctagaataaacattaaaatagtgttggccagttaaggtcatttactttcaagggaagagggtgaccccaaatatgcattcttgaaaattctatttatttagttttaaaggaagagtttacaatagcttatgtgaagcaatacctaaaaatataagcaactggcatgattcctggtcacattccgaataaaggtttgtccatttgctgcaaagaagcatgcttggaggataacttgtaagaggtcggccactggcttatggtatattaaacaaccagtgtgtagactttttggaactgcatcttgtatcatctcagcgtggtaatttttccactggtctttgggtaggtacacactaataatattttttatctaggcaaatgcgagatgagtaaatgctaaatgataggattttggaaggtaattctaacaatactgattatatttggaagctttaaattgttgattcagcagtgaatgagagagtttgatggtgcttgcttggtcataatatcaaaatcactaaagtgcatgatgtaacggcagggagctgaatggcaaggacaattaattggggtttgtttttgggaatcaatgataccacatgtcaatctgctgtccttagggagtctctccctagtgttacccctctttctcacttttgggttcatatacctgatacctttctaaaaaagtcaatttcatggctccaggagtggagaatctgatacaggcctggctacatgtccttatcacagggattggtttcacgggggtgcacattgttcaaagtgaatcccaggattttcttgggtgctaccacaacagtaatatagatctgataacaaactttctagaggaaactatagagctttccttttttttttttttttttccttttttaaaaaccagtgagtaattattatcaatgattatctctggcctgacaatacaagtgacactcctttttttttttttttttaactaaatgtattctgatctggtgaatttttcattctaaaataacaatacaagagtatttaatatggagacatgagatttgtggtaaaatcattagggcagtggttcttaaactcgagtgtgcatcagcattccctgtagggcttgttgaaacagatttcagggacacactcccacagtttctgtttggtaggtctggagtagggtctgaaaatttgcatttctgacatgtttctaagtgatgctgaaactattggttgaatcacactttgaaaaaatcatggcactaaggtggtggtgatggtgttgggagtgggggtgatttgctcaatgaacttgtgatagaaagcattgcatagagatgggatataaataatatataagcttgggtgacagaatacccatatttgccgtgtttaatcagaaaatgaatttattggttaaataacagaaaagtctaaagatggggctaaccaggccttccatggataggattcttggttgtataatgtgatctctgagtgacttagagttaacctagctttactaccataaggagccctggcccaaatctcaaaaaggggttgtattttaatctacactctaaaagtgtgaaacttgaagcatactgcagtcacttgactgaaagatttggttgagaaacagggtgatggtggttttgggcatgtccacatgaccaaactgtttttcacaaaacttctgctgaataaaatttgaaatactactgtcagcctgttttcctgtcttaatgaattccagacagtttgtagagtgtgggagcttccaaaacagagaggtggaatggatgtgaccagccagcatctgttttgtcacaaatgaggatgtcctgacataatggaatcgttccccttgttctgaatctcaccaagctgttcacttctctgatcatgaagtacagactgtgagaaggaagggcaaggccaatgtcatgtaacacaagccaaaagaaaatttctggattccttatttaccaggaaattcagcctacccctgtgtttcatccacttagacccaagcattttgatttttttttttttttttttggcatgttgacattctttagagaaaaagcgctgatctgttcttgttgtaaactggttaagacttctaaccagtctaataagtctaaatttcagagtaagacagatttgaacttaaattccaatttggccacttactggctatatatgtgtctttgggcaagttattcttgtggcctctgtttcaacagaggctgatatggtttggatctgtgtctctaccatatctcatgtcaaattgtaatccccagtgttccaggtggggcctggtgggaggtgattgggtcatggaggcagtttctcatgaatggtttagcactatccccttggtcctgttctcataatagtgagtgagtcctcatgagatctggtcatttaaaagtgtgtagcacctcccctgtcattctctcgctgctgctcccaccacgtgagatgcctcactccccttttgccttctgccatgattgcaggtttcctgaggcctcccctgaagctgagcagatgccagcatcatgctttctgtggaaccgtgaagcaccgtgatttaatcagcccatggaaccatgagtgaattaaacctcttttctttataagttacccagcctccggtatttctttatagcaatgtggactaatacagaaaattggtgccaagaaatggggcattgctataaagatacctgaaaatgtggaagcaactttggaattgggtaacaggcagaggttggaagaatttgggggactcagaagaagataggaagatgatggaaagtttggaatttcctagagactgattaaatggttgtgaacaaaatgctggtaatgatatggacagcgaagtccaggctgaggaggtctgagatggaaatgaggaactcactgggaactggaataaaggtcacttttgttatgtgttagcaaagaggttggctgcattgtgtccctgccatagggatctgtggaacttttaacttgagagtgatgatttagggtaactggcagaagaaatttctaagcagcaaagtattcaagatgtagcctggctgctcctaacaacctatgtttatatgtgtgagcaaagaaattacctaaagttgaacttatatttaaaggggaagcagagtataaaagtttggaaaatttgcagcctggccatgtagtagaaaagaaaagcacaatccccttggtcctgttctcataatagtgagtgagtcctcatgagatctggtcatttaaaagtgtgtaggacctcccttgtcattctctcttgctgctgctcccaccacgtgagatgcctcactccccttttgccttctgccatgactgcaggtttcctgaggcctcccctgaagcctccccattttctgggaagtaattcaagcaggctacagaaatttgcttaagtaaaaaggggccaagtgctaacatccaacacaacggggagaaggcctcaaaagcatttcagagaactttgcagcagaccctcccatcatgggcccagaagcctagggggactgagtcgtttcctgggccaggcacagggctctgctgccctgcatagccttgggacactgctctccacatcctagttgctccagatccagctatggctcatagaggcccaggttacactcaggccactgcttcagagggtgcaagctgtaagccttggtggcttccatgtggtgttaagcctgtaagtgcacagagtgcaagagctggggcttgggagcctccaactagatttcagaggatgtatggaaaaacttggatgtccaggcagaagcctgctgcaggggcagagccctcataaagaaactctactagggcagtgcaaaggggaaatgtggggttggagcccctacacagagtccccactggggcattacctagtggagctgtgagaagagcactgccatcctccagaccccagaatggtagatctactggcaacttgcactctcagcctggaaaagccacaggcagtcaatgccagcccttgagagcagctgcaggggctgaaccctgcaaagccacaggggtggaactgcccaaggccttgggattgcacttcttgcactagtgagccctggatgtgagacatagagtcaaaggagattattttggagctttaagacttaatgactgccctgctgggttttggacttgcatggagcctatggcccctttcttttggccaatttcttcctttttgaacaggaaaatttacccaattcctatacccccattgtatcttggaagtaactaacttgttttttaatttataggctcataggcagaagggactagccttatctcagatgagactttggacttttgagttaatgctggaataagttaagaatttggggactgttgggaagccatgattgtattttgcaatgtgagaaggaagaaggatatgtgatttgggggaccaggggtagaatgatatggtttgaatctgtgtccccaccaaatctcaggtcaaattgtaatccccaatgttgcaggtgaggcctgatgggaggtgatttggatcatggaagtggtttctcatgaatggtttagcaacacccacttagtgctgttcttgtgatagtgagtgattcttatgagtgtggcaccacccctgttagtctctctctctcctttttttttttttgagacagagtctcactctgtcacccaggctggagtgcagtggcatgatctaggcttactgcaacctccacctcctgggttcaagtgattctcctgcctcagactaccgagtagctgggattacaggtgcataccaacacgccatgttggccaggctggtcttgaaatctgtcccccttggccggccaaagtattgggattacaggtgtgagccactgtgcctggccccctgtcactctctcttgctcctgcttccaccatgtgagatggctcactcccactttgccttctgccatgattgtaactttcctgaggccaacccagaagctgaaaagatgtcagcatcatgcttcctgtacagcctgcagaacagtgaaccaattacatctctcttttttttttttttgaaataaattacccagtctcaggtatttttttttgtagcagtgtgagaatggactaatacagaggctaaaagaggacagtgcataataatatgatctaagtgatagggtaattgtacagattaaaagaaatacatgggtagagtgctcagcccaaagcctggcttttagttccctcgttctgattacctctgtattcacagcatcaacaaggtttttgacttgaatttctagttttagacaccttaataaagaaaaaacgactcaaaggcaatcagtgtgggggttggggggagaggatccatagaacagtggggaggaggaggctaagggagggaggagggtaaatagtctttaagttaggtaatcagcattaggatttttgggagttgatacaggtcaaatagtggtgaaaggtgggatgcctaacaggaagatatttaaggatggcacatgctatttacaagcatggtgttacttttgttgccagaacaatttttgtctttatcaacatgtttcctttcatcataattatagactatagctaagtggagaaataaataatgagatacactaattggggttacacaataccaaggctgtgtagcactgctgtctcaacacagaaatctcgaattcctaactgtcatgtttcggccttggccatagtgacttcctaccttatcttttcccacttgacttggcagcctgtttatatagttatctttatccaatataagccataaggccctgtattcttgagcctcaaaatctttgtatcttttacccttctgggttttttttttttttttttttttttttttttttttttttgggaatagcagtatatagccactttagagactaggatataagttttcaagggttttttctttccccgacacgaatatgatagtttgcttttcttgattgtcacacaatttctctcccgaaaactgtggcttaactggtcactagcaagcataaaggggaaaaaaaaagcagaaaggggggttagtccaaatagtatccatctttctcaggggagagatttcgattatattacacatgtatgtggataccttcatcagttacagtttagtcattgactaacttggacaactgggtgcctacctcattgaatagttgtgaatattcaataaggtgatgagatgctacctgtagtaagggtgcagtagataccagctgctgctgctcaccttactgctgctcctcctcctgtactatgattattgctctctgcctactgctgttttgtgctactactggtgtcattgctactagaacttagaagtttgcataagaatggaagaaatggttaatcacagaaacatttctctgtgcaggtggtattgactctctcattgccttatcactgttgagtaaataagcaacagtttggttctctatcgctgaaaaaactctaaccacatagtcaattctcaaatccttggggtatatgtggcaagtttttttttttaagttctaggatacatgtgcagaatgtgcaggtttgttacataagtatacatgtgccatggtggtttgctgcacctatcaacccatcatctaggtttcaagccctacatgcattaggtgtttgtcctaatgctctccctccccttgccccacaacccccgacaggccctggtgtgtgatgttcccctccctgtgtccatgtgttctcattgttcaactcccacttatgagtgagaacatgcagtgtttggttttctgttcctgtgatagtttgctgggaatgatggtttccagctttatccatgtccctgcaaaggacatgaactcattttttttttatggctgcattgtattccatggtgtatatgtgctacattttctttatccaatctatcattgatgggcatttgggttggttccaagtcttcgctattgtaaatagtgctgcaataaacatacatgtacacgtgtctttatggtagaatgatttataatcctttgggtatatacccagtaatgggattgctgggtcaaatggtatttctggttctagatccttgaggaattgccacactgtcatccacaatggttgaactaacttgtacgcctaccaacagtgtaaagcgtccctgtttctccacagcctcaccagcatctcttgtttcctgactttttaatgattgctactctgactggtgtgagatggtatctcattgtggttttgatttgaatttctctaatgaccagtgatgatgatcttttttaaatatgtttgttggccgcataaatgtcttcttttgagaagtgtctgttgatatcctttgcccactttttggtggggttgttttttttcctgtaaatttgtataagttccttgtagaatctggatattagacctttgttagatggatagattgcaaaaattttctcccattctgtagattgtgtggcaagtttttaaacctatcatagcactgggttgcagcccaggagtcttccagaccacttcccccaactatcagctgttgtgtgcataggaatgagattaccaagtttgagtaccaattaaaggaatgcatattctatcagaatccatatatatatattcatacaaacatatgtaggattctcaaggcagtgtttttcaaaatattttcagactttctccagtattcttactaaccaaaacttgactcttggttaaacagttcccattcagagttttataagaaaagaggaaaaatgaaattctcctctttctgtgattgaaacaaaaagacaaacacactgaagaaactgacatagaagtaggtgctttagagtgagtggttatgtgttcagagaagctgtaagcacaggagagaagacagttggggaggtttggtcagaagtggaatggtgggatgagcttccgaactctgcattttagtgagagtacaggataaatctgctgtgtaggctggtgttgagagttaggacaccctgaacttggggaagagccagctatcagagatgaaaaaaaacagtttgggacattttcagaatagatatatttcttgagtatctaaatgggtggacggtaagagatccgacttttactcttgttttccaggagttatggtttgagaattatgtgtaggatcttcgggcaaattttcattgccttgtagtataaaaggattcttaataaatatttgttgagctgaggataatggggagcaggaagggtcaaacttgaaccagtgttgcctgtggaaaatgggtagctgttgagtgatggtgtggatcccagatcagaccctcaaaggccaggggaggtctttctgggagaggaaaagaacctggagttaccctagggcatgtgtgtgtgtgtgtgtgtgtgtgtgtgtgtgtgtgtgtgtgtgtctatatatataatactctcttccaccactcataaagtatatatataaatatatatatatataaatatatcatatgcacacacacacacacacacacacactttcccagcactcagaaatatatttcattttatttacttttttttaagacagggtctcactccatctcccagattagagtgcggggatgcaatcatagcttcctatagcctcaaactcctgggctcaagcaattcccctgcctcagcctctcaggtagctgggactacaggtgtacaccaccatgcctggctaattaaattttttttttctaaggttgggatcttgctttgttgcccatgctggtcttgaattcttggcctcaagcaatcctcctgcctcagagtcccaaagcactgtgattacagatgtgagcctctgtgcccagcctggaaatatattttaactggtgttcactgaagatggcctttagctatcacttttttaaaaggctttatttttaaaataatgtatcttttaataaatcaaaagcttcttatgtatcaatagcccaatccggtaatacttattttattattggttagttcccatgggaacagggaatttgttagttcactggacatctcaaggttccaggatacagagtgtgtccaataatgtttgttgaataaagaatgacctagatggctgaagtgtttctggtgtgctagaaggggtcagtaaattttggaaactttgctaaaccctttcaggaaaatgtgtaagaaattatcttaccttttcttttgttagctatgagcccttgccatgtgtttctgagccttaatatctttacctataaaatggagctaatggcatgtccttcttgggataactgtgaggattatagaagataatatgtaaaatgactggcatatgtacattctcaatacaaagttagtaggggtgatgattgttactgctattggtgctaaagatacagactgctaaaaatacagtcaattctcattatttttgttttataaagctgctacaaataccgaattagcaaatactgaatgattactactagggaaatacaggataagttccttagagcctctggtcgcaacatttaatcaatctatcaatacataactttgttttatgtgtgtttctgtgtaaagacacattatttaatatatattgttgattcattaacgttgaacttgtggccagcagcactataacctgactgacttaggaacactagacagcactttcgcactaaactttggtgccatactgaatagaggagtcaccaacaaaaacacacaaaagtgcaaaaaatgtggcactacatagactgtgaaaaggacacttttttacaatatgatgtgagagctgaaatgagaaggcagaccaataccttatttaacctcaattggtaacgtgcatgttgggggactcaaacttcttgctgttctgtgcacgtgattgactgtaaaaactctgagaatgttgattttgggtttacaaatcagttttagtgagtaggtgaatttgaaagtggagaatccatgaataatgagggttgactatattaaaaactgttttcttgcatctgtatttctctagcagttcttcctctggactaaaaagcttacccactggggaaaacattttaaaacactatctgctcagatgttgtggattacagagggagccacattaataaagcttttccaggtacctgatcgctctcttttttttttgagacaaagtctcgctctgtcgtccaggctggagtgcagtggcacgatctcggctcactgcaagctccacctcctgggttcgtgccattctcctgcctcagcctcccaagtagctgggactacaggcacccgccaccacacctggctaatttttttgtatttttagtagagacggggtttcaccgtgttagccagggtggtctcgatctcctgacctcgtgatccacccgccttggcatcacaaagtgctgggattacaggcgtgagccactgcgcccagccctgatctctcatttttatcagtttgtttgccaataaaaatggcccatcacttccagatctttaaagttgactgaggcttcactgttcagatatggtagaattttgacagatttttaatcattctttaataaggtggagtgtgaggttggggacccaggaaaagaccacagagagattatggaccattgctgaaaaatccagcaaaaagcagtaggattgacagagggcaggtgagcccccagattggggcctagcctgggagggttcttggcattgctcaggaaagagttcaagaacgagctggtggtggaagaatgcaggtctagtgaagcaacagtgtacaacagagtacctgctccttgcagagcagggctaacccatagacatgcacccagagtagcagcgtatggactgtagactggcagtatttatacccacttggaattacatgcaaatcaaggtacaggttactcagaaatctctagaaaaagggtggtaacttttgggagttgccatggcatttgtaaagtgtcatggcactgctgggagtgtcttatactgatgagcagtgagggcacctagaggttgcctttggtgccatttgctagttctggtgggtttcttcatttcttcctgtggagaccaggaaataagcgctggtagtctctacttcaggatggcttagaaattctggtgtaggcagtttttgaggtaaccaggctcagcttactcagggcctagaggataaaggtgatgattttgacttttgcaagcattggaaattagcatattatagttatcagaatggtcattattgtaaacattaactgagtacttgttgggattgcttggaattcttttagaaagaaggagaaaaagaattggtttcagtaggttctgtactttcaagttacatagcagatagatcacacaatttagtgacaacagagcacaaagaacaataataataacagtagcatctagcatttttaaagccctctttacagatatgccttgtgttagtgctttagcctatcttttatatatttctatagtattcttacagattatactggagttaaggaaggtacctatgtaattaaaaaaaattctttctgtgttagaaaagtgaagaaacagaaacatcaggaattaataatttacatctaggtgaattataaacatagtaaggcacttactatctaccaggtacagtatttaagtgttttatataatataattctaatatgaggtagataggatcccattttataaatgaagaaacttgtgcttgtctgttttctgtcacttgtctatcttaagttactcaaataaggttgaaccgcgattcaaactgaggactgtctgacttcaaagctcactctcttattcaccatgctggcagtggtttccatgtattttggtgttcggaggtttggagggagaggcaggagtgatcaggagtgacaacttatgttgatttttgaatggaaaggagactaggtttcttatgaagtaaaggcagaagactcagggtgtggttgcacattcaaatccaaaacaaatagttatatctattaaaggtgctcacagcatgcctgtctgcatagtcctttgtttctaaagctgcttctgaaggaggaaaggaggtaggctgtgaatcctccaagaaaggtaggaaaagatgggatggtggatacttaatcattcacaagggtgtggtatataagtaagtggtagattttcctaatttcttattaataatcttcaaatgttgctacttgatgacatcaagttgtcttgtctacatacccatccttgtgttctactactgaacatgaacatgtagctcataacatctggatgtttttcactcatctctttttccctctctcttttttctgctaacctgacttgttgattgctatttttgtgtgtcttcataaatttatagccagtctgttccattctggactgtttatctttggcatgccagaggtctttaaacatcataatgttgtgtaatgagcataacttctgccttgacttgtgggtgttaagagcattagtcagtgcaaagtattgagttaaatattttcaataaaaggatataatgatctagcagagaagaagttataaaaaatcctagttaatggctttaatggtgagccatatatttagtgggttctatcagtgatgagttagagattcacagaatgaatgtaaaagcattcttacttttaattaatgagagaggagaaagaaaaacaataataagaaaaaaaggacttgattctcatccataccaagaaaagtgtaaacatccaagttcccagtgattctaaccctgattcattaccttgcatgtgtctttaactaccacaagaaatgtttaagatttccattgagatattatcgacagggactcctgggctgcatcataagcctgattgaaagcctttagccttgtaatgatctctttttggaggacaatcagggaattctttgcacctttatcagagagtcagggctttcctgagcaaacaaactaggtctttacctatggagctgattttatgaagagttttggtcagcattagtcattgtgaaaccatgggcctcctgccctggtttatctcgacagtcatctccctacagcagaagattgaatcctcatctctccatgagtctgagcatctaaagatgttagaggtacattggtttgattcttgctggggaatgtgtagtgggtactggtcttctgggaatagtgtctagatgaatgtttaataatcagtttaataggttgatgggctgtcttatttcctggggttggaggtttaaaccaggacaccctgtgctaactctgctctttaccttgccagcaatcctcagtcgtcctggtaaacaacctctgagttaaataccttttcttttctggagaggttaccaacaaaggaaaaggctttgatgtcagaacagggggcataaacagtgtttatggctgctgttaaaaatttctcatctgggtattttcaaaagaattccaagtcaaaatatatcacttatgggaagtatcttcttttccaatatgatatcttatgaagttgataattattttcatggtttaagtagtaattgatgacattttgggggttggaagatttgtgggaaggaggacatagattttcatcagatgtccttgcgtcctttccttgcgaggattattgatctctagtcttcatatgtaaggtgttgaatttatttaatgttattaactgaatctatagataaagaggtagttttggagccaagtaacctgttgatgtaaagtctattttaccttttatgattaccatctagcacctccctccttcctggctgaattccctgtcattttaagtaggcagcaattactggtttgctaaagaagccagctcctgctgccaaggatcctgttaattatcactctatctctaatttagccttcctagtgttgagagaaggtgcacgtaagcgtgtggcagaacgtctgcaatcgcatctttgtaataatctcctttctgagacggttcagtggactcaatgttccgccaaagggccaaggcagccctggtgagtgttttcagctctcttctgtagcttgtttggtcagtcgagtttggtgtgattgtcctctccttttgcttctgacctaagtaaaagctaatggttggcattaatcttgggaattcagacctattccgctccatctctgaagtcaaatgggacaccttgaaaatacttcagtggttttcccacgagctattttctctctctgtgaaaaggaaaccaggaaattgactctgtgcctgttttcaagaaggtaatacagatgataaccaaagtacctcagtttacaggttcttatatagcatgttttttaagggatgtcaatctttatatcgtatgaaatctttggttcttgttcataaatggctagattgctttctgtttgttttcggaaatgttcagttcacttgtttcagtgaacattttttcagaagttccactggatcatttgattaggtttggagtgcttatgcttccttttccactttttatgttatttttggcagtgttggtatttgaagctgtagaagtgattcactgcaaagtgcattaattttccacatttccaaatgcattttccagtggtccccaaatttcttttcctcttctcagatgattctgcagttgtccttctgtcattctgctggctcaaacataaatgctgatgtcactgaatttcttaaattacagctggtggggattaacagaaattgtaaaagaataccacttcctcattttgctattttcttgactaattattgtcttttcaagtactgtaggaacatagggatttgaaaatgaattctttgtcttgcagtttaaacagcaattttccttttcctttttctgttatacttcaaaaataatgtagcgcttaggatgcttttctgatgtgccctttaataaccccagacagaggagtctcactcctgattttgcactttggactgtcttctaccctgggtgaagggttttgaatacttcccttaagtaagtttccttatatagaatatttttactcaacagtttttctccgactcaaggccgttactggtattatgtgaaaggttgtgattaatttatttgtttgttcagagcctttgctcctttaaggaatgcttagctctgtcctcatcattttcttgtttaggatctgtgttatttgtgacaattttgattgctccagccctctacacattaatttttctggcttgcctctccttgttttaacagtgggagtctgggcctcaggctttcttatcacttggtttgtggtttgagtgatggttccatgaaccttttcctgggagttctctgggctcctgtgctggacgctggaagccatctggaagtgtgcacacaggatggctgggtgctgctgggtggtattgattgaactgcagtcccgtggaaacagaaatagaaagggttcagcattcccactttcctctggtggcatttttgcttattttgtgtatttagaaaaggtagccatatgcaaactgctgacttactattttccctggaatggaaaccatttggattatttcaatgagttttagcgaagatttgtttgttcacagtattagttttgttttctggtagcctgtttagaataagaccagaatgtgtctttttactttatggaaatgagtgcttacttggtgtttggaattttgcaaaccaacatgaatttgaaaagtcatatgtttattccagagtcaaaatagaaactctttagtgaaaattatagatatttccatcttggatcatttactttctgtgaaaaatttttttttgacaaaattgtttaagatttcagaggaacctcttttcctggttaattttcccacaaattaatttccctcatttttaaaaagaaaaataagattaaactgaagaattgcagaccaagctcatatgtgctggaatatttgctgtaagctggtgactgattctttgctgttatctttcataagagagtggatttagtttaactgttagtagttaaggtttggattaggaatacaaatatgattcccttaccataagaccttttaagcactgatttgcattgctgaggataagttatgattattcagtctcgggaaaatttgtattataagatccatatacacttagccaacattgccttctaacattgcaatgataagttcttttaattgagattttggaatggtatagctatctggaaaatatttcaaatgtcattgtggagcttttggttaaatgtgagttttaaaagtttgataaatagaataaagagcggaaaggaaaaatagttatgaatttgttgaattgtttgggctatgagttatctttttaaaaagaggttttatgtttgtgtagaaaatgccactaaatataagaaaatggaagtttaatagttgaacaaggtaagaattgcagatatcatgagattgtaatttaactggagtatgcattaaatgaattgtatatttcactagcttggtgaccatgaatggttttgtttgtcattttatctttcttttcttttctttcttttttttttgagatggagtctctttcacccagcagcacgatctcagctcactgcaacctctgcctcctgggttcaagtgattctcctgcctcagtctcctgagtagctgggattacaggtgtgcaccaccatgcccagctaattttttttttttttttttttttttttttttagtagagatggggtttcaccatgttggccaggctggtcttgaactcctgacctctagtgatctgcctacttcggcctcccaaagtgttgggattacaggcgtgagccaccgcacctagcctctttatcattttgtcttatcccagtaaataccatcatgctggaccttgtattaaaaaaatgttgaatcaatgaatgagtgaatgcacgttttgggaggcctggttgcagacctatctgtgctgctacctactcatatgaccctgtgggtctgtctcccgctatatacaatgaaggctaaagatgggatcagggataagtatgtgggattgtgttgctccctccttctgctgcagtacggtagatattgccaactgtcacttcactctttcctgtgaacccaggaggagccttgggcctttctgaatttagtgcatcaggctcccatgactcaccgtagatacaagagttaaaacttactgtaccttctccttttggatttggtccctgaagcccaattacaaataggcaatattctatgatgtttcttggtcagcagatgttcatttaaacaatagagacaacagcatgcaccattatccctccattcaataatttttctggtagatttagcagatatattaatagatagaacttaatgaatgggtctagacagtattcttccagtggagtaagatatgaagatataattagattagcagagtttttcacttttactctccaaagcacatgtctccatctggggcacagttatggagcacctcctgtatgccagcactatgctactgataaatggccagcctgtaattcatgggctctgccttcttgtaactcaaagtgacataagtatgatgctaggtctgtaattattcctttaaagacaaaagatggaggggcatgtaatcctggcactttgggagactgaggtgggtgggtcacttgaggtcaggagttcgagaccagcctgaccaacatgataaaactgcatctctactaaaaatacaaaaaattagctaggtgtggtggtgtgcacctgtaatcccagctacttgggaggctgaggcaggagagttgctggaacccgggaggtggaggttgcagtcagccgagattgcgccactgcactccagcctgggcaacagagcaagactccatctcaaacaaaacaaaacaaaacaacaaaaaaacaaaaataaaaaatgattgtcaaacagatgagaggaaagcattccaggtagaccgaggcatggaggtgcagcatagtgtggcactgagacagtctaagcacggagtgtggctggagcaccagggagtgcggccagcttcatacagaggaatagtgctctggctgccaaatgaagaatgggttggagggtggccagggctggtgtcacagaggccagttaggatggttccagctgaactgtctttgtgaggaacgatgatacacatgcatcgttcagccctgaagataggttgtgattgcaagagggtaaaaaccttgttaaagatttcaaggacagtgaggacaaaagtaaggctatatgtaaactgcttactgctgacaataaagtgactgcttgttcatttctttatcatgtaggtggatgcctgttctgtaccaagcacctggaaaatacaatcatgtgtaaagtagacatggtctctgcccacaatcaagcaaaaagaaaatgattgattactaagtagtctttataaggtgcatgagcaaaattcttagggtccatgctctccacagattcccctcctttcctgaagttaatttatagtctgacaacatgttctctgctttctataggaaattttggaggataaagttagataagaagataaacctcaaggtctgtgccttatatggagcatgcttgcatgtacacacacagacacatgctcacatacacaccttcctcccctaataaaagacacctgtcttcactccatagattgacaagcatctagaataaggcatatgaggattcccataagtaaatctgctccaagaaaagttctagatatcttctcatattttctgaacatgatattttacatggaagaatccgggctgttgagttcctgatccaagaagaaaagtcttccatacataatttggctttggtggctgcttcagattagccattctatctgtgttccaggttattaccggtgtttggaattcatgtgcagaagcaagaatttgccttgaggcagcaagactggtagacactagataagtggcttattttaaagtgatgttttggtacagaaatggcagtaacaacaaattcctccccctaatagaaatcttcctcacattccctatccaacccagaatcatttataataatgtggagtcaaaattcagctgaatgggtttgatacaaattcctaggaagccattgtaagttcaagcactgtgttttaaagatgaagcattcaaatttattaggatggtaattgcagctgatgtaggtggggagggcatgtgtcccattttgcatgatttggagaggcaatagcttgttgagactaaaactctggagtaggactgttctaggtttgaatctcagctgcactgattggtggctgtgtgagtttgggcaaatcactaagattctctcttcacctgtaaaatgaagtagtgggtaagcatgtaagtcctttgttaaatttgccaaggtttgagtctttgttgtactactgtatgacattgagcaacttgttctctttatatcttggatttcttatctgtaaaataataataacagtaataataacaataatgatgatgataataataattatggtccctacctcataaggatgtggcaagaattaaatgagattatgcacacatagggttttcatcttggtagtctggcacctagttagcactcatatcttactcaactatttttcctgccatcattatattgagctttctaaaaattattattttttgactacttattttgttctttctgaaagttagggcttcacaaagtgtagtcgttgctatgtgatttctttttttttcctttttgatacggggccttgctgtgatgcccaggctggagtacagtggctattcacaggtgcaatcctagtactaaccagcacgggagttttgacctgttccatttctaacctgggctggtttacccttctttatgcaccttggtggtcccctaggaggtcaccatattgatgccgaactcattgcactcaccagatcagcaaagtgcactacagcccggaactcctgggctcaactgatcctcctgcctcagactcctgaatagctgggaccacaggcatgtgccagtgccttttctttctttaaactggagactcaataatgcaatttctgaatttggggcagagttgccagataaaatccagaatgtccagttaaatttggatttctgatacagaataattgtttactataactttgttctagatatttcatgggatagcgagactaaaaaatattctttattcatctgaaattcaattcaactgggcattctgtatttgctaaatctagcaatgctagtttggtagtaaaacatactcctttgccctctcattcattttttcactcagatagatatttgtgtatgcttataaaaatgcagtgaacaacatccttggggcataagtatagaaatagtttcataaatttgaaaaaagatttcttagtatctctggtaaatctacctcctaattccttctccctgtgtaagccatgggaccatcaaattgagattatgttgatacttgagtatatagtatgatgttgcttgaaaattctgaaatgttctagtgttgcttttacctaaagggaatgattaatggtgacacattaatgggtatgcattccagagaatcctgaaagctttgtcatttttgaaggaaattacctcattacttttagagtcacctatccagggtaggttggtccctgtggttgacctggttttccaagtaggaaaataaacacttcaatggttaggttaataacttggagtgattttgttgtacttacaattcaagttaatttttaagtaggattggtctttaagctactagactagttggagactctgagagaattgcattctaagagtgagatcctttcaattcaatcagcatttactgtgtattgactgtgcaaaagcaactgcatatgaagagagaggaatttaaagtgttttgagttcctgctctcaaaaaccttagtgtttaatggagcacgaaagcaagaagcaattatgacaaaaggcaagataaataaggtcaaaattgaagtctagtaaagctaggtcccaggatggttgaatgtaggaagtggttaaatctggaggccaagtagagtaggaatggcttttattaggacaggtttctttgaaggtaatatgtgagagaactattcaaagataagaatgatttcatttgggaaatgaaatgttctaggtgtgggcttagcattaacaagtatccgaaggtggccacattttgaaatgcacgtgttacttagacatgacaaaaatatatacagcaccaccgtaactgacagcaaccgcttctctcatgtgtgactgtttatgatctagaatttccagatcagaaacttgattttatgtaggtggacctggattcattccatgttggtttcctaagtatttattgtgcacctgctgttgctatgtatgagacagccagagagacttgggcaacatttaggaattcttttaggtggtcacttaaaccaactgaaagttactccgtttaaacatgggtttttttttttttcctgaaatgaacacttccagtgagctctgatttaaattgggcaaaatcaacagcaaaagaattccatgagaagcatcttgtcaggcgctctgactttgagtatttgcttaaatgactttacaagccagcttaactcatttcctgttggatgacacttgtttattaaacttggcccaagtcagagttaatagccttaatggttttgaatggtcccaagtgattctccagcagtgtgtcattagtgaacggggaggattctacagataggatgcaacacacacatagctgcttcagccatcatagatttaagagaatacctatagccctcttaaatttagctaaggaaattgagaatactggaaagtaagtgttaccattgcagtaaatgctaaaatatttttcaacagttctagtagttttccttttttgtttttttgaaatacttccatgtgaaattaatgccatttaaaaatggcaccagcattcagaacttgaatcatcccaaattctctagcaaatgaattaaaatgtgacatggggttcatgttgattaacagatgtgtgtagagaattggactgggtagcctgccatcgcgatgcatgcttgatgcatgagagggattgctaagattgggaatggaaaacttttctacttttccatttatgtgtgtgttgggctataaagctctaaattagactggaaattggtgatgcatttggagatcgttggtttttaattttcatcaattaggattgatgtatgtcttttaagtttggacaagttgttctttgtggatgattttgctatttcaggtactggtggggtaagagtagcctggatgcaaacctttattgggttcttaaacatgaaagagcataaactgcttatgttagtttgggtctggttgaatgttattaattttttttccttgatggccaggccaaatattatgtagttttaatatctacccttggttcctactgccttatttttgggcactcttaatatcttcctttatatatctgtcattaagttataattgaagcttcatgttttatatttagaatggtgcatggaggctcagctgtgccagccattcaggcctaatggcaaatgttggttcatgccagaaagtttttggagtctagtctcttttttgggatgtccaatctaagcaaaccatccttttctgtcttaagctgaggggcacagggaagcaatttagaagtgatttccacttctgtgcatgtgacagcatcttgtttctgataaaaattatttacttgctagttcactctttaacccagagagtcatgcagccttaaaagggattgctttgacaagtctttatgtcacttcattccttagtttactgacttccatgcggagtatcagtgagtgtcagttaaaagtgggtacatagtgatagtagatgacacccatgccaccagctgcttcctatgggctgccagatgctagcaaacgtttcacagctcttgaattctctggatttgggccactcttgaactctatccatcaatccatacacccacttattgagctaatatttattgaggttttactatgtttcaggaagttgtctaggtatgaggaatacagcagggcaccaaactgttgaaaatctttgtattcatggaacttacatgggcaagcagatgtagaaataaatatgtgaatgagtaaaatgcataatatgctaaatgctggtaagtgttatagagaacgataaagcatggctgggtttggggtgacttgtaatttaaaactgagtggacaaggactgcctcactgagaaaatgacatttgagaaaagacccaaagaagatgagggagtcatgccagtatttgggggcaaagcacagcagacagaaggaagagtaagtacatagtatctggacaggagtgagtctacttcagtaacagcatcatggccacagcggctggaccaggctgagcaaagtggggagttccaggaatggcaggaggtggggtcagtgaaggaatgggattggggcagaggcagacactgtaagggtttgcaaagactttgccttttactcattaaaaattgggagccgttgcagatttctagctaaaggagtagcatgatctgattaattcaggtagcagcccagtgtggtgggggaaaacaggggtctgtgaatttggagatcatgtaaaccacggttttgtcactaggtaggggcaaataaattcagcatccttagcttcaattttattccttcttataaaacaatgcttgtgggttggatagtttttcatgaccttccaggttttgatactgttaccctggattagttgccttcctgtgagtatttcatgtgtatggctgattacatttctccttgagtatgcatagctggaccacagatttgtaaattatctttctgtgctttatttacttaaaaaattttccataaacatctcaaattgaaaactatgaagcattaatacttctatatattgatgttaaaggttgcttgaaggctaaatggtaagggtaaacacagattataagctttatcactagccttaatactattttttgttatagaaaatagaattgatttgtagagtattgcactgagctatcagttgggatacagtgataaataagacacagcgtcttaaggaattgagtaggaggagagattcctggataagacagtaactcataaagtgttgttaatggaggagacagtcctggttaagacagtaccctacaaaatggtgttaatggcagaaaagagggccagaagccatgactaggtgcaggcccatgggagcacaggcagactaatattcaggtatgtcttcataccaatatcctttaaaaatgtttaatattttcaacaaccagttagacctagtgccacacatgctaggaggtgccagaggcctggcaggctttcttctacagccctgagcaatttggctctgccccaaagttgcatcatgatgtttggcacaccaaggtctggtaagtaactcttattagaagatggtttagggaccgtcttttattattcaagaatgtcctttggacatcttaatcttctcccttccaccagaatatttcttctacttcctgtgatgttatagtgctccttctagactggtaccccaggtagcaggatggctagtcagtttctgtatttcctctgtggagaagtattgctttagtcttaccttgtcttcaggcctccagtatgaactctgttgggagtcacgtggagccctagtcattttatccactgacgcaatgtattccttgtgttctgttaactggcttcttgggcagcctaggagtattctaagtttccaggtcaaagattctggaagcaactttccaagaggtagaagggctgccactttcccagactttccccttcaactgaggctccctgtgtatgttggggtgtggggtgctagaggccttgctgctgaggaaagttgccatggttaccagcaccgtggctctcggaaggaggaggctagcatgttagcacctcagctgtcctgtggtaatgcttagggggcaaatgaccataccaatgagcactgttagagctggaggggaaactgaggttcagaagttgacgctggaaacaggaaccaagagcccttgactttcacattgcattgcttcctttcagttattttacacctcaggccttcacacacattcttcctgccatcttgaacattttcctgccattcttctgttttctttctactcatcctttagtctccacttaaaggttgcttcccaacccacctccttgcccctcatctgaattaggttaccatgcttttcttttatggtttcctaatcttatccttcatgctgtttacataattattctatatgcatccgtatgttcagtgtttgtttccctactccaaagggccaaggagcacagctgttttgttctccattttattctcagaggttaagccaggctgtaacacagataggcagtgtatgactccataagtgaaagggtaaatgactggaaagaagactggttttctctcacctatttatgtgaaatgtctctgcctgtctcagctgagggtaacaactgttattggttttgtgtattattgaggatacagaagatgtgattcttgtctctaacatcaccaagtctgtggccttctggaattttattaagggttgtctctgcaaaaaccaaaacccaatgatacacacaaatcagcattctttaattggtataggcttgacacgaggggctgtgatttgtcaatttattttacaatatttgcatttttatttcttaattctgtttccagaaatgagctttaatgccatttggatcccccattctttttattaaaaatgaatagagaaaataccacttttcattaataggattcataatccttttttggagggatttgttttggcttgtgtaatggaacttttaagagggtaggcatagaaaactgactgggactctttgtagaagaaagagcagagttacctactgtgtgtaaaaaagaaaagcaggaacagtggactttctttatttctaaaactaaactgccctaattgttcatatcaaaagatgggcttttcccaagctcggttggcatttttaatttacagagaaagcgtgcattgttttgcagtgtgcattgcggttacattggctcccagaagattagctcaaaggtatctatgaatagtcacaccctaaattatatgaactgaagagttttaaagaggtggaaaatctgatgcatgctatttcccagacattcatgccttaggaaaataactagggaagtgggagagtgaaacttagaagttgctactttatattcaccaatgtggcacttgtaaactgtgtgaccctgggccactgaattaacttctgtaagcctcagaattgtaaagtggagataaaaataccagctaccttcagaattattgtgaggatttcatgagataatatatgaaaagtgtcacaatgcccagcacattataaatgccttataggtaggggatagtacactacataggataatagttaagggcacagactctggagggcctggcttctgaatcctggacttgcactcaggggtggggccatcttgggctggttacttgacatttgcgtgtttgagtttcctcatatgcacaatggagatagtaataatacctgctacatagggttattatgaagattaactgagttagtatgtgtcaagtgttgataacaacttgtggttcatggtaagtgctatatatacgtttgttgcgatgaagaagtctgggtcttgcagacagttagtctgcaagttcttgaaccagacttcataatgtaccaagtatgttgagcttcaattttctctttttgtaatatgcggatgattctagttataatgtcaatttttatgagaaatcggtgagataatgcatatgtaaagtgctcagcataggatttggaacatggaaaatactcactactcatagcaaagacttttcttgtaattgctactaccattactatgattatttccattatttttagtcctactatgaatatgcctctggcttatatagaacttatattcgaagtgaattccacaaacactctgtggaaataaaaaggattaatatgtagaaaataatgttgagagtaatgttactgttggtgtatttctataaatggagctgtttcagcaaattgaaaaatatccagtaaaagtcttataatcatgcatttgcaattttgcagatcacaaaagatcagagttagtcagggtcagtgttgggtggacagttttatattcatggaaaatgactcataggaaacatcaggaactaaaatttccaaaataaaaaaaaattaaaaagtcatcatataaactgtgtttaagtcaagtctatttcctatcttaactgagattatgttcatggagtaaagttttgacatggtctaaatttcaatgttatatcttgtttgtggcatcactggaaatgaataagtcctgattccagtgatggtaacattttccactttagtcatttgggtcattgttgctacaatatccatatttaaacctgtgtgttgttttgcaatatatctttaagttcaacttccttttttgtttcaagtgactagggaagaaaaaacagtgattataatacagagtacaaatgatgtttgagaaaagcagggctttgagtagcattggtcctgaagtcctctgtgttttaatgaagggtgggagcttgcactgagaagtcaggtgtgcagagaagtgctaatggtcgcatcaaggcctggatgtcagatcctttcaagtcaaaatatggaagtgctgatgaaattcctagattatatgatctagaaggacaagtcaagttatcccatcaaaaatatatgggggaacttccgctaggcatgtgcatatctctgataacagtatgccatggttggaaggcgggaacctggaagggaagataaattcaagttcagtatcactggggccatagaatgaagtactttttaagccatggtaagaagggtgggctttattagaaggccaatagagaggaatggaaaggttttaagtgggagggagggcattctattcgtgttactgaaagatcactctggcggtgccacagagaatgtattgtaggagatggtgacaaagaaaaccaataaggagcagtgtaggcaagagctggggtcactcgggacttgcctgtggagatggagaggaggtggagctgagagatatcagggaaggagaatcgtagggtgggtgattcgttggacttaagtggtaagagagagcaaggagggaaggatgtcttttagatttctcacatgggcaggtggttagaacaatggtgctgttcatggagatgaggctcttggtagacaaaacagattggggaggatgaatattaattcttcctcctatatgtggtagagtagatggatgtttatggggtataatagatgagtatagtcatttgactgttttagaacgagtctggttcttggggtagaacctgtgtttcagtcaggtttgcattttcaagcatgaaattaaattgccaattaacagttgtgtaaacaaatagggatttatttatctccatacaagaagcccagggctctgtaatcactgccgttgtttagtggctccatgatgtcagaaccagcatctcagtgatttgtcttgacttttttctaatatttgtcacctcatggttgcaagatggctgccgctcctctgggcatcacaactgctttacactttaagaagagtgtaaatcaagaagggagaacaagctatgatttcttattaacatatacagtatgaagtgtgcttaaagtttgactatatttttcttagataccttctaacacatatagctctgagtagtctttaaagtatgttaaatacatttttccctgattaaaattctcaacttgcaaaaaccatttttttttctctcagatttattccaaatcttccttattactaaattctcagtggacctctctgggtttcgagcaagtgcggaaaattccatttggtgttcgccggctgatgtgcaagtaaaagcagggaatgtatgatggaaaatgtcataccctttatgatgacttttgatctgtgaagaatataattattctgtgtttaaaactacagaagggaaatgtttattcactctttttgaaggtaacattattcggggtatcatgaagtgcaaatatttgtcctttgctgcagtttaattcaagatagtctcaccacctaatgtttgcagaattctgttggtgactgttttagctaacagtcattctgaggcatagcagaaggtgcagagatttttggaaagagacatctcaaggtgtaccccgatgctgtgtgattttctttaacttctctgaactggtttgttctgtgaaattgggtgaaattgggataagagcaggagacagtctttacatccttactacaaacatacacaaaaatgcctctgaaacaagggtggctatgacacactgaaggtgcaagttaaatatgatggggtgtggaatagggaaagattaatttctgctgggagatattgtgaactccatgttggagaatgcagaagatttacaggataatggaggatggccccaggcttatcacacacatgtagtgtgcaaagtacattagaagttttcaggatttactgtttctgataagggtcaaaatgaggagacccttgaaattctggctgagcgagcttgaactttgttctgtatgtgatggggagcaactgaagacttaaaaattcacggaaacttaatgtcgatagaagtgaaattgggggtcaaaaaatatatataattaaaattaaaattaaaattttcattttgatataattatagattaacacacagttgtgagaagtactgagatatccatgtatcttttatccagtgtcacccagtagtaacatttagtataattcacaaccggtaaatcaactgaagtcttttaaagggaaatccatgatatgctgaagtctgtgttaagtgggttgtcctagtagctgtggactagaatggattggaaaaagaacatggaagctaggacacctttgggaggctcttgcaataatctgagagtaggggcataacaataggattgggaagaagggatatttggcaatatggggctgataagagaagctgatgctctgtgtagttgctcaacaaagaggtattgagggtcagctgtgtgccatgcagtctggtaagtactataggggttaaaagatgatctaatagagacagggcaatgcaactgaaggaaaatgggccacgtggaaacgatgttaggctggacgagacagtgagttctgtctagagggataactactattctaccactggttgttaccatttgtgactataggtccggtgtggctggtgttttgatttcttagatgccagaaatctaaatttctttgtgaaatctctcaatttttaaatgttacctaatataaaattacaaagaagatgcatgccaatgagcagtcatctgtgagctagattcaccctgtgggttctttgttttcttgatggaatgtttagagcttatttcagttatctattactgggtaaattgagtggcttaaagagataactgttttatctcacatagttctgataattgactggggagcagttttcctggtctagcttggggtctctcatggaattgccattagatgatggctggatttggagacatcttgaagcctgccttgggctctaagatggctataactttctctttctccgttggtttcaggacctcttgtggcctctccatgtggcctttctagcagggtaaccagactaattagatgttagctcagaactccttatagattgtttcaacagggaataaatagaagctactagtctccttaaggctaggtccagagttgctagcacatcactcttgccactttctgttagttaatgcaagttgctccagaccagattcactgtgggaagggactgcacaaagcatgaatgatgggaggccttgtccattggtgaccatctttggagacaacctaccactgaaatcaagatgtctagatattggtgacactgtttatcaaaggtaaatgagggacatagcaaattctcctgtttagcattcatgttactttgaagtttttagaaaaccacataatagtgagttttgtttttttttttagtagtaactgtgattctggagaaacctggttgttaatacagtggcttcctttggaagcataattcatttgtagctatttggtgtccagttcattaaaaaataatactattaagtgataagacagatcttttctgctttgggtgagcatgttcttttcaaatacgtgaccaggttgttaatgttgggtccataatcatgtatcttttcagaaaagagcccctcagataaagtctgttacataagacttccaaatgtttattagcctgaatacatgcaactaaaatgtactttatcatggcgctttttgttctccttagactcagaactggctgcaaaatttgcaggtcccagtgcaaaatgaacatgtggagccccttgttatgattgtaaagacgacaccagcgagcattaaaccaagcccagggccctgtgcacctgcatagatctcatgcctatgaagtcatccctgcttagatttttgaaaacgtgtacaaaatgtgggagtatactgtatttttccgataaagggccattaactctgatcaaattctcattagattttgacacccccaaaggttggtcctactgcttatgcaaataagaaaagggtgaaagctctatgtttaacaagatctctgttcccaagcagtccctgtacctcctagccacagcagcaggtgttggcaggcgttagtctgagctccctgctgttcaggctttctgaatttgagtgattccaacacagttaggaacagcatatctcttgtcgaaggcttggcatgcttttttctaaatgtactttctacccctttactgagctctgttcctgaaggatccagaatagattgcctgtctcgttgatgagttcctaagttcatttggaacagacactaacacagttcattgcactaaagatttagggttcaacatctccagaaggtagttgatagactccagacaggtttgcaacattgtacaactgcagagagcatgctcagatcatggcctaggaatggcagcccctggcattgtgcagtgcacagcctgagtggctgtacacagaggccctgccctataagaatctcagtctgctataataatttagagaggttgttgtacagctgactttttaaataaggcatgagccattttgaattacttgtttggccccctgacctgtggcttcataagctcttaatttttgtttatcatctctatcaatcagtggatgccaaggccaaattagccctatacccatacacctgacccttataatagaataatagtagctaacatttattgaatgcttattatgtgctagcgactctgcatgcattatctaatttcatcttcacaacaagtctattagttgctgttattcttccatttaattgatgagaacactgagattaagtgtggttgtgtgagttactcaaagtcacaaagctaattaagtgataagctgtgactcgaacccagtcctgtctgatttctaaacccaagcagcattacagagggtgtgtttttagggcaatgtttgcacatggcagtattctctatttgaagcttgttttattgtaggccatttcttgcttctggagcattccctgattaaatattctctacctatacttatttctcaggatttttagttctttcaaagtaaccatcagacctttcataaattttgaatatcctttattactatctacttcagtaaatctaggaatatttaatctcttaattggagttacaaatggcaaatgctgaggggattatgttctaggtgagtgtttttgttttgcacatgcctcagagaacataaaaattaacacatttccttaacagagatgagaatagagtcctaaacatcaccagataatttcctactagtgataagaaaaattattctcatctaatttttactgctttcagtataatgtactgtaggatgagaggaacagaccagttcccttgataaacaccttttgaccttattccatcctttccaggaggtggaaattctgattttcccttggagtgatattccagttcatttaatgcatgtgaacagacaggttcttttccaggtgtgagaacaatactggtttggaagtagagacctaggtatcctctgacagattgtggggaagttgagatacctgaaattaccttttgcttggatgctccttgtctctcttgcccatctgtacagtattagatttctaacaatgtgatagactcttctaatattcctagttattcttgactgatagtttttgttgaacaaatagaaaagaaaggtaaggggctttatctgaatacagaatacttagtcaagtgtttgtatgtgtgtgtgtgcacgtattcaaaggagatatttatatatgatatgtaggatatatatatatatataatttatatatttaataaaggagattatttctcttttattaaatgccaagttgggttatgttgctttctgcaccacagataatgactaaggacctacttactctaatcgaatgatctgcccaaagactaatggtatactttattatacttatttgcaaggttctgatagaggatgttttaaattatccagaatatgtttttttttgttcgtgtatgtgtatttctaaaagtggtgtttcacaaagtgtagtttaagagttacctgtgtcagggtcacctggggatgtgttaaaaataggaattcctgggtctttggactccagctgtctctactgatttgaggttttcaggaatctgcatgtcgctcagcttctttgtgatttttgtcccactatagtttgagaaccatggtctgaaatgtgtcagcatagggataaagattcaacttaattttgtctttttttgttcccttcctctttcctgtctctctttcttctcccctttcaaatatattagagacaactattttaaggggtattttaatggcttgtgttttttatttgcgatgaaaggcttttgttaatgttagcaatatcacaattccatcttttcctttgtggtctgtataaaaggagccattggggaagagttgctttttgttttgttgttgttgttgttgttgttgttgtttaaatacccactattttccatagcaaatctccaggaaggaacaacatactgtttgttcttttttcaggataactctggctttctttgctagtgggtgttgtaatcaatgcttttcagaagcaacttaatactcctccttactataaatcccagaatttaatgcaaacatttctaacgtttatagaggctactttttggggtaagagaagggaggaatgaaaatcctttgagaagacattttgaggattctctgtgatctcagaataggtagtaatgactccctgagttttagtgtcaaagattttgagatctcttagtatagaaaacagttacaaagctagaagctttaatggatttttaaaaacacaaagtttttaactgaagatattcctgaaaggtaaattccctccctccttccccctcccccatattagagaaattacttttttgaggaagctgaactagccagctagtctccactctaatccatggtagataactagttggattattagagattggaacttttccaggtgacttggatagagactccctgaagatatattaagccaggcaatgaatttagaggcagattcttctttataaaggacttcttaaaataggaaaatgatgatctaagtgtcataaagttaagaaactattgtggtgatttcttctgaaggtcagatccaaggtttgtgtttcattgaagatccccagggaaatctcaagggtcctgtgtcccattctggagagactggcgtggactgtgggcccctgcagccagctgcttgccttttgtttattttccttgttatctttgtcaaagtgctgcagttggattttttttttttttttaaatagcacaagatgattgtctttctgctgtgtcttccacgaaagctttgtattagtggagaacttttggctgcagagctgggctgatctgtgtggcactgagcataattcaggttctcctgcgggcacttgaacattcttcatgagggctgaggcaggcaagctgagtggagcagtgagtcacggcgtgctgcggcagtggtgtcctgaaataacagcaagcagcagcagcagcagcagcagtaatttaacagcagtagtgagcatttactgatgcttcccatgtgccaggcactctgctcagtaccttctgtgcactatctcatttaaatcagaacaatcccatgagctcggtaccatctttcatgtcagttttacagatactcatctgcaggtcacatgaccagtaagcaatccaagtggggcttgaatgctgattgcttgggtgcccaaattcatgcatttaaccatagtaccatactctttgacagaaatgcacgttgttactgccttttttgctttgctttttccttaaatcacatcagaactggtttttgctttttccttaaatcacatcagaactggtttttgcttagtaatttaggctccatgacctgaagattgtcttttcttatttttatgagttgaggttttgagtgagagggaaatacaacctgagaaagttcatccttgggaaattgagcatggccttttgcctgagaccatgtccatctactgaatggtcaagggagcaaaaaaggaatcgtgggaggtgaaaggtagaaagattgggctagagaaaaagagatggacaggtagacacatccagggtgatctgtaccgtggatgaaggaggaagagggatatgaaacatagttcaagaactagagttcaaaggtcacctgggtaataatgccatatagggcttaatgggggaaaaggaaggttcagtgatcaaataaattggaaattgtacattctaacatctgtttggagaacaaaaaaagcagtgcagcacctaacacttcttgagtgcttcctgcgtatgctttaagtagcacattccactcttagattctaaggtggagtgagctttgccaaaggaggtttgactcctagagggaaatcagggtagtttccaaagtaaatgagaatggatgcagatttaaatagttgggactcatgccacaatttacctgatgtttttctcattctgcaactgcctggtgcctggtgacctttgtcagtggcttcctcttgttgcctctagggcatgaatccctgcttctgtctgctttacgggattgttgacagtaaatgagtatgaagtcctttgcgctctgtagaggtaagacgcttttgaagttcaaggtcttcataatgttcatatcaaatatctagagttccttcaatttagttaacatcgtaaaatgaatgtatatccttttaggacagattaaatacccttagcttactcaggagaggaaaggaaatgcatctaaaaagtgtttactgctctcaggagacatatcttcaagttcttatgggttgcaccgagatgactggtgacaatcctcgagtaacattgttatggattttatataagactgtggaaaatgagacgtgtttgcttgtatgggcttatccttttgaagcccagttatctggggcatacatccgtggaaataccgtcatttaaaaacaatttctttaaaattagggttggaggagcatattaggtaaaaatccattcagttggaaatgaccgaaagtccaactacagcaacaaaggagatttattcattcatttaggtgaagagtccacatccttttggacttgctttgagtatcatggttggattgaccataggcctggagttatcatcatgtacctggtttctcatccaatccactctgccttcatggtgttatgtcacttttagagtgttgctggttccacttcgtgatgataagatgtctgccaaatactcctggggctgcttattctctcccgcatgtggtgagagagagagagattgatttctgggagctcttccacgatagcaaaggagaagctcaaaccgttcttattggccacacttaagtcatgttccattcatgagccagtgcatgtgatgaaggaatgggttttaggctggttagtatagacaccagaaccatgttccactcctgaattctaagggggactgaacttcaccaaaggaagtgtgaaacctagaggaaaatcagggtagtttccaaagtgagaatggatgcagatttaaatagttgagactcatgacacaattgacctgatagttttcttgtattctcatgttagcagttatgtgtgaaactggctttttaatgaataaacgactagatcaaggtttaacttgtaaaggatcttgttccaagttcctctctgtttcttagtagtacaggctagactagaccaaattgaaggattctctttctttccactttttgaaaagtcttggtgtttggtttttgaatttgtaaagcattaagttgaatctgtatctggccgtggttttctattccaaatgccttttggatgagtcagtgtgaggtttcattagggcagtataaattaccctcactttttttctttttttctcttcttgatctcagtatgactgctccttatttctgacattgagcctcatgttttaatacataaaagattcctgttttcacatggatctcctacgtgtccaacattacattttatcctacaaaaattacaccactgataaaaataaaatagttattattgaaaggcataaataacaagaatggtggtggtagccagaagttactgagtgctgactgtgtgctgggtaagcgctgtgctaagtgctttatttgcattgttctgtttattcatcacagcaaccctgtgaaggagatgctgtcattatctctgttttgaagatgagaaaactgaggttaaataaggttcacaaggctgcatagacaggcagtggtggagccaaaacttgagcccagatctctttcattctgggacctgtcttcttaaccactattttctttttctttttttttttaattattatactttaagttttagggtacatgtgcacaatatgcaggtttgttacatatgtatacatgtgccatgttggtgtgctgcacccattaacttgtcatttagcattaggtatatctcctgatgctatccctcccccctcccccgaccccacaacagtccctggtgtgtgatgttccccttcctgtgtccatgtgttctcattgttcaattcccacctatgagtgagaacatgcggtgtttggttttttgtccttgtgataaccactattttctctctcagagaagccacgatactttgagtatgctatatacctaatgctaagtttaaaatttctggaaagttgcattatgtctgtaaattcttctgcagttagtgcttctgtatactactagtggtagaagattgaaagagaacccttaacatcttggaccttggaaaaacttgacccagaagtctttcaccaaaaatttgcatttacctgaagagccaaagcaattttgagaaagaagaacaaatttgaaggactcacactttctggtttcaaaacacattacaaaactacaataatcacaacagtgtggtattgacataaagacacacaaatagaccaatgtaatagaatagagagctcagaagtgaacccttgcatatacggtcaaatgatctttgacaagggtgccaagatgattcaatgaagtaaggacagtctcttcatcaaatggggttgggaaaactagatagatgcaatggaatgaagttggacccttatcttacacaaagtacaaatattaactcaagatggattcaagacctaaatgtaagacccaaaactataaaactcctagaagaagatgtatggaaaaaacatagtgatattgaacttagcaatgatttattgtatgtaacaccaaaagcacaggcaacaaaataaaaaattgacataggacagtcttctaggtgctagaaaaaaaaagaaaacagatgaatgctactccattaaacttaaaatcttttgtgcatcaaatgacacaatcatcagactgcagagacaaactgcagaatggtaaaaagtatttgcaaatcatatatctaataattggttaatatccagaatgcataaagaactcccacaactcaatcacaaaaaataaaataacctgattaaataattggcaaaggactttaagagacatttctccagaagtggtatacagatgaccaacaagcacgtgaaaaagtgctcaatgtcactcatcatctaagaaatgcaaatcggaaccacagagaagtatcacctcatactcattaggatggctactattaaagaaaaataatgactcttgttgagaatgtaaagaaagtggaactcttgtgcactgttggtgggattgtaaaatgatacagctgctacggaaaggagcatagaggttcataaaaaattaaaaatagtaatcccagcactttgggaggccaactcaggtggatcacttgaggccaggagttcgagacaaccctgggcagcatggcaaaaccctatctctactaaaaataaaaaatttagctgggcgtggtggcacacacctgtagtcccacatacttgggaggctgaggcgtgcgaattgcttgaacccaggaggcagaggctgcaatgaatggagatcgcaccactgcactgcagcctgggcaacagagtgagactgtgtctcagaaaaacaaacaaacaaacctctcatgtgatccagtaatcccagttttgtgtgcatgtatatatatatatatatccaaaagaattgaaagcagggtcctatagataattgcacatccatgttcatagcagtgctagtcacaatagccaagagtggaagcaacccaaatgtccatcagcaggtgaatggataaacagaatgtgctgcatacatacaatggagtattattcagccttaaaaagggaggaaatcctgtcatatgccatgctacaacatagatgaatctttaggacattatagtaagttaagtaagccagtgacaagaaggtaaatactgtatgaatccacttatagtaagttaagtaagccagtgacaagaaggtaaatactgtatgaatccacttacatgaggtatgtagaggagtcaaactcatagagacagaaagtacaatggtggttgctagggggagggggtagtgggaaaaggggagttggtatttaatgggtatagagcttcagttttgcgagatgaaaaagttctggagatctcttgcacaacaatgtgaatgtaattaacatcaatgaactgtatatttagaaatggttaaaatggtaaattttatgtaacatgtttgtttatttgttttttaccacaattttaaaaatttcacatttatcacctggcactaattttactacttcattgagtatttcaacatcttacttgaagttgcaaaccccaaggccacaggctgaatgtggcccatggacaatcagtttttgacaaatgtgaaatagtggtcaatattttttaaaaattaggaactttcacatcaaaacccctatatctcgcttctcttggaaaactggagaatctggaaattccaagtccctagtctgtccaatcaacaaatggctgtagctgaggagcagcaccccactttcagtcctaggcatgaaattcagattcatttctctcactctcgaatttcttatacaagacccaagtcctcgtgcagatatactaacttcctggccacagtatttgtaggtttaagatattaaacttcttaattccaaatgcatccaataataatagaccgtagatggtggatgctctgcgagctcccacactaacttctttttagagacactaatttctaggtttctgcttctgtttgaggtcctagagttatcatctctgtatttctatatgaacaaatatagtcccaatgcccttttttcttttgccattttgcgtacagcaaatgtcctgcaagtcatgttctaaatatagatgtgttaaatttcaaatgtgaaagtttttgaagggtctaaagccagtttgctaatcagggaaatgctgtgattggcgccagcacttgcagtccctgagggggattgtgaaatccggcctccgcaactgtgattcaagtctgggatgaaagaaaactccatgatcgctgaagagctctccaagttgttttcttcttaacagcgtggtggtggtggtggtggtttgagtgtcataacagagaaaagacaaatacatgttcctgagttcattttactagtactggattaatagtatggtaacaaatcattattttgcaagcaaaaacaaccatgttttgcaattctttatgtgcaagttgtaagaaaatgcctgtcaatagaaaggaatctagagacccaagaggctcaagacctcttcatggcaagttaagaagaatggctacttatgcaaaatataaaaaccttgggtatttgaaagttcaaactggcacagttttttctcttttaaatcttattattctgttgtttttcaagatagggctggtggcatctaatggcaagtagaggcaaaatactggaatgcagcagttgtgcgtttttcaaagctatgcactgcatgacatccctgtgtgtgcatttaagtgtgtatgcaagaggcattattagaactgcctatatgtttcatgctgggtctatttcattggtgcagtagaacttggaaaatgcagtttcatgctttgaataatagtgaacaacagtagaggaggccttagtttccaagactggtggagcagaggtattcggggaactttctgggaatgagacttggataattaagttgctgtgccctgagagttgctccttgaagtagagacggatgtgctgaatcctcatctgtacttgccagaagtgaagctgtcatctagcacagttgctgcctctgtttttgaaaagagatatgactagttgattccatcactatctgatgcagaattttcaaagatgagtagtggatcagagaaacgaaacaaaacaaagccaactgaactaaactgtgttgctagctgaaagggtctgatagtgagcaaagggccagatgtttggagttgctttcttcaattttatttcactgcttttatccattaaattggtcaacagcagcactcactggtaaaaataggaacaacagattcaagttttcctatgtgctgttacagtgatgccctttttttctttcctctctcatctccttgctttttccttccctcccttcttaagctcaagctttcattatatgattttttttttaaattccaaaagaataacgatagtgtatagataaaatgtggttaatttccctactcaccatccctaatcctactcttctaaagaaatcaatattaagagtttggtttatatcaacaatccttccccaacccatgcaaataagatatgtatctagagaaatttgtttttctaatttttacaaaagtggactcgttctgggtacagaatcttgtaacttgacttccctggcattattttattggcatctctccaaatcagtacatttagctcaaaatcgctacttttaatggctaatttttttaatagtatagttttatcacaatttattcataaaattccttattgattgattcctctgccccactaaaaatttcctctcctccactaaaaagatagcattgcatattttaattacacatacatatttttaaagctttaccctgtataatatttgaagaggaaaattaaagggtttctaaatgtttcatttgctttattactttaaattttttcttgttttatgggctaaagtctttagctttttttttttttttttttttttttttttttttaaacagggtctccctctgccacccatgctgaagtacagtggtgcaatcaccgttcctgggcaacctcgatttcctgggccgaagtgatcttcccacttcagcctcctgagtagctggaactataggcgcttgccaccacacctggctaatttttttgtattttttgtagagatggggtttcgccatgttgcccaggctggtcttgaactactaggctcaagcagtctgcctgcttcggcctcccaaagtgttgggattacaggcgtaagccactgcacccagccagattttctaatttgctgatttacctctttgaatttttgcattatagctatctatgctgtatagtgaaggatttctcaagctcggcattttagtcattttaggtcatatagctctttggtgtgagtagctgtgctgtgtgttgtggaacacgtagcgtccctggcttctacccattagatgctcatagcatgcaccctctcccaatgctcatagcatgcaccctctcccaatgctcaagttatgatgaccaaaaatgtctctagtcactgccagatgttccttgggtggaaaaattgctcctgttgagaaccactcctataatgtatataaggtatatatttaaaaacccagttatgtggaagaacactacttttctttatgtattcaccaacacttggcaacatgaatgtaatgtcacatgcattagaagtgaatctcagtattgggccccagatagtgagcttcacttagttcctgtgtacaagccagcactggaatgatcttcagtttatgccattttggtatccataatggcacatagacaacagtgtcctcatttataagttgtgctatctcaatcagacagtttgaatattttctggctgtggtggggcaacacctactcaaatgaggcaggaatgccatttgcgtctgacatcattttcttcgactgggatttgagcagttcacgaggcacccattgtcccacccatgtcaccccagctatatgaagtgtataggaggcagtggcatccaggtagccaacgacctctttcctctcctagtatcttttctacagagtctcccccaacttctggccttgagcaaaatagccccattgggaagatcactgagggaaactgctgtttccacatattctataatctttttctgtgaaaaggtgagctatatatataattatttaagtttcttcacatttgcaggtggctattgtggttggtctgcttaacgaaatagggtgtggtgttatgtatgtgaacaaagctgggcatcaggcccttcatcagaaatgtgaccccttattaaagcattgttttttgtttttacagaaagtcagatggctttgtgttgtttgacgtggttccttttccaaatagatgactgtaaagatgacctgatgatcctatggactgggctataaactttgtgcatctcccttcttgtgccttaatggcaaggtaagatgctggagaaccaattctcatgtccttggttggcattttaatcgtggtagcttggtcatcagggtaatggcaacacgttaaaattcacatgcattaaaaaaatagcagtgtcatccaggctgctttgcatttgttatttgtttatttatttatacatagatacacatccatgtagctactgcccaggtcaagaattaggacatttccagcacagtagaagattcccttttccccatcttagccagtaagcacttcccgaaagaatccattagtctgacctcaatcactctgacttagttttgtctattcttgaactccacggaaatggaatcaaatagtatttgttctttggtgactagcttttttagtctaacagtatagctgaagtacattcgtactgggacatgtaacagtagtttgtactttttgatgctgtgtgagtagtaggctctgtatgaataatttattcaatctttctactcattatggtgggcatttgggttctttcctaggtgaggatatgaggaacaaagctgccctgaatatccctgtacatgtcttcagtggatgatgtattttcttttgggtaaatacctgggagtggaatggttagctcatcttttgatagatttattcttagttatttaaatgttttgatgctgttgtaaatagattttcttttaaaatcttaattttctcccaagcgatgtattatgttttcatttgcaaactagtatattttaatagatgccatgaaacatgcattaaaattaatatttgcctctttttaagagagcctgatatacgacacttctaatttttaaaaaacatatagaaaattacgtgataactcttgatataaatattgcatttggtttttaaaaaacaatgaactgtcttacattatttaaaaataaatctaggctgggcatagcggcttattcctataatcttagcactttgggaggccgaggtgggaggatctcctgagcccaggagtttgagaccagcctggacaacatgacaagacctcatctctacaaaaattttaaaaattggctgagcatggtggtgtgtacctgtggtcccagctacttgggaggctgaggtgggaggattgcttgagcctgggaggttgaggctgcagtgagccctctttgcaccattgcactcctgcctgggtgacagagtgaaaccgtgtttcagaaaataaaaggtaaaaaataaatctaattacaacatgcaaatattttcaaaatatttctcatacaaagctaatatattaaatcaatctaatttcaaaggcacgtatttaaaaaatataagtatataatacacatttttagattatctgtgatttatttttgttcatatgtataccacaacattttatataggggtcttttacatcataaatcaaatccactgttatgaagcaaaattttaatcttttgttgctatttttgtttttgttttttgagacggagttgcgctcagtcgcccaggctggagagcagtggcacaatcttgactcactgcagccgccgtctcctgggttcaaatgattctcctgtctcagactcccgagtagtagggattacaggcatgtgccaccacaccagctaatttttgtatttttagtaaagacagggtttcttcatgttggccaggctggtcttgaattcctgacctcaggtgatctgcctgcctcggcctcctaaagtgctgggattacaggcatgagccactgcgcctggcctctgttgctatttttgaagattgtgtttagtttgtattcattttagaaatatggcaaagcattctttcttatttagaaaagggaatctaatctgaaaggatttttttttcttttagtgcctatgaggaatttcctaaatacttttgcaggtagtaaaacatttaaagctgcttgaatgcacagcagtttgtgaagcttacaaacaccgtctttctttttttttttttttttttttttgagacggagtctcgctctgtcgcccaggccggactgcggactgcagtggcgcaatctcggctcactgcaagctccgcttcccgggttcacgccattctgctgcctcagcctcccaagtagctgggactacaggcgcccgccaccgcgcccggctaattttttgtatttttggtagagacggggtttcaccttgttagccaggatggtctcgatctcctgacctcatgatccacccgcctcggcctcccaaagtgcaaacaccgtctttctaagatagtcatgaaacataacctgggacagagtgatttgttaggccatatctattgccttgacaacaaactaaacatttcaaaatacttgagcaaatgccaccaacaagtgatgtgtaggggttaagtggttaaagcagaagcaccaagaccatgtttgtgtgataaaggttgcagaaactgtacccattttataggagacttttattgcaggttttctgactctaacataagctaaatacattagcaaggagaacatctactattctaagtttataaattatttttaatgggagtatgcagggatttgtatcataatttagtccagagggtatacctctaattcgctcccttcaagccaatttaatgccacatgtgaatggaaaattgtattacacctatcccaggtgctgaaggtcagagtgatacaggaaatctaaaataccaatctttgtgctcaaggagtttgtttgagttttttaacctgtgttctcagattgtacatattcagagaggtattttattttttgtctcgatggaaatttctacaaatcatataaatgaagacttattatagcatctactgttatactaaagatcatttattaaatattttctgggaatgaatggactacagaaaagaaatggattcttttggccagacaggaaagattttctattttggtggactaaaaaaataaataaataatacaatattatttttgccttagattttgaaggggtataggtgtgatggtggagtaattaagaatttagagagcccatttcactcttttctgttttcttgaattctcatagtttaatattgtcctctttggttgaaagcaacatctactttcagtcttgattttaaaatgctgacactttcactgtacattttgtgaagaataatacgattccccaaggtgacttgattgtcaaagtcatttcttccacccatgttggtggaaatacccaacatttttcatctataaccaaggttatctttatctttttgcagtcagtgccatggtaacaggtagtgatacaaatctgggacccctgagtgctgtgggtcagagattacaataaaaatataaatgttggttgcagaagcaacgtacattttagatgtttatggagggctttaaactgatcacagataaagtggtgactcatagttttcatttttaattaatcagcattcaaattgaagaggaaaatccatccagaactttttgttggcttcagtggatctgaatcccagtactgtgactctgagctgggatatgtgtacccaccttaggcctgtaactgatctggttctgcctcagtctccccatgtgtaaagtggggataatgctacctacatcatgcagttgggaggattaaaagcccagttgatagaaatgtgcctagcacagttcctggctctatagtagctgatgttcttattatttttatagtgaggaaaccatgttgtattagtggaagccaggcagatcgactttattgaattccttctatatgtttttgtcagctgcacagtcttggccaagtaatttaagtcacttagtccccttggagtcttggtttggtcacatgcaaaatggggttcatactatttatcattcagagttgttgtgaggaaaacacaatatatttaaagcgcatagcatggttcctggcacctaataagcattcagcaagtgatagctgctactattattatgattgtggttgttattgtcattttcatgattagactgtgtgtccacatctcagtatttttgctgctatttttatagcccagctactatcatctctctgtagattattgcaacagccctctaacccttccccctctgtttctataaagacccaaatggtctggcctttgccaacctccctggtctcccacattgcctccccatagtgctttagcaacagtggacttcatttattcctgaaaatgcattatactccttccctgcacagggcctttgcatatgctgctttttcttcttggaatagtctgacctctttctacctctccttccaccctttcactctcctactcatccccttgttaatacactcataggtcctgatacatcaccttcattttgccttgtacttaattacttaatttgcttgtccttttacatttatttgtgtgatcatttgatgaattctgtgtctcatcctagactctgatgccctaggttctgatacagcagagagagcgtcagacttggattaccatggtatgtttctttagttccccaacacactcatttgttgagggagtgagtgaataaatgaatgaatgattatgatgataatctgatgataatataaaatatctgggcaacaattgaggagatagaggaggttttaggatgtgaggttcatccttgggagaatgcatagtgagaaggcagatttgctaatgatttgggacaccagtgaggaaaaatggtgtgtctgtgcaggaggacgaatggttaaatgaagaaatgcagggagggaggaagaagctgagcaggaaatagttgtggagtgttggaaagaggaaataactgggaagtgacctgacagaaaattgggcatgtatttcctttgctacagtttttatttctctgatttaagcattgtcacattggctctttttgttgttgttgtttttaagtctgatttacaatattctttttacctgtaggatgccacgtctatctgtttacatggacaaagttatacacccaaaacgggcaaagacacagtagcagtttagcctttgttttgtcttcctttcctaggacaaatgccccctccctttaaaacagtttctttcacactgtcttatttctttggtcaaaaatctactgttttttgtttgtttgtttgtttttgtagttctctactctgatgtaatctccttagtatgctcttagggtaaactgtttctcattgtttaaagtttccagcattggtttctcatttttgttgttcgtgtcactgaagagagcaggggggttttcacaaagaaacctatactgggaccactatcaggtgctgtgtggttataaggggtgaggaactaaatagacatctataaatttagtgtttttcagtctctatgtttttcttttagcataattttaaattgagatgtaattcacataaatgaaatttatcattttaacatgtacacttcagtagttttaaatatattcactatgttgtgtagctgtcaccattatctaattccaaaacatttccatcaccccaataagaagcttcgtacctattagcagttagtcccaactcccctgctcctatcccatggcaaccattaatctactttgtcttcatggatttgcctactggacatttcatataaatgggattatacattatgtggcctttcatgtctagcttctttcacttagcatattttcaagattcagccttgaaaggaatgacctttttatggtcattcctttttatggacaagtaatattccagtgtagggatataccacattttgtttattcatttttcagctgatggacatttgaattgcttccacttttgcctgctatgaactttcttgtacaagtttttgtgtgaacatatgttttcagttctcttgagtatttacctaagagcggaatggctgggtcacatgattaaacataccatagatcatcacatggtatgtttaatcttttaaggagctgccatgctgttcttacagcaggcaaaccactttgcattcccaccagcaatgtgtcagggtgccagtttttccacatctttgccaacacttgttattttcagttaaaaaaaaattatagccatcctagtgttgtgaagtggtcattgtgtctcttttattcttttgtggtgactcttcgtggccttaattagttcctccccccttttcatttaaaaaaaaattggatattgttcttgtcatttttattagctctaaattttgaatgggccctctgtagcacaggggaaatataaaatagaatttgaaatactactttataactgggaaacagcatgcttagagaaagtgactgaaccagaaaaaggcagttatggcctacaaattaggatttattctaccaaaggagacctcaagtaaatattcttatgtataaattatagaaacctctcattataggaataaaagtcagaaaatgaaattggggtaataacaattcctctttatggtttgttgttttccttgtgtaacttttttttttttttttaccttgaaatgctattccttatatgctgttaccgtgaaggttgttcatttgtacactaatcttggaagatctttgaaatcctgtagaaaaagctcggctgacgttagccaagctcattttgtattccattgtttcgagtggctaaaatatcaggactaaaggcctggaattaagaagcttaaataattatagattccctctcctcccattcattagatgtaatttagtactgaaaaaaataaaattactcaacttggattgaagttcagcggtcttaaatccttctaaaattctgaatatgaatttttcattgtaaactgtgacaatgtcaaatcaataacagtatagttttcttatatccagggtcaccatcatcacctagaaatgcgtaatgaatactttatttgtggtctctgatttctaggaacttaacagtggaatatagaccgcattgatgccaagagatatcaagggttgtgaagcattgctgcatataccaggcagcaggaagtcattaattataaggttggaagaggcaactgtgatatattttacatgagtactttaagggaccattttagattccatgcagtaggaaggcataccaaactgtgattattctaagaaaagaaaattaagaaaaatgtttgaaggagacaagtatttgttgagggcctactgggtgacaaactgcattggaaaatgggctatagagtatggtggagagctcagggccttggagtcagatgacttcaatttgaattttggctatgacaactgctatttgggtgcttatgggagtaagagaactgcaatctatatgattgtagtgaggattggagggaatcaagtgatttgtctctattctgtgcctggcatgtaataggccctcaataaacatgggtcttattattgttagtattgtcattattattatttttgtaatttaattattacaaccattacttgaggaaagtggtattgtacacattttcatatgagaaaacaaggcttaagtaaccaagagatttgcctagagcagtggctctcacctgaggatgattttagctcccagaagacattgggcaatgtctggagagctgtttttggtggtcccaactggcagcgcagggtgttactggcatctcctgggtataggccaggggtgctgccgaacattctggaatgcataggacagcctctgcaacaatgatccagccccaaatgtcaatcgtgccaaggctgagaaagtctggcctagagtcatggacctgccagatcaaggagcagaattcgaattcttttctgattcgtgcgtttagatgttctccctgaagctattccattccttcatgaaaatccagggagtgaaataaagttagtttttggcaagtccctttaacttttcagataatattctgatggcttgagactcaaatatggtgtcatggggtgggtgacaggccaagtacagggaaactgaggtgatgtgtgagggaaccgccatccattcatttttcaccattcatttgtgtattgaatcattattgatcattgacttcccaaacacttagtgagcacctactgtgtgctagtccacagtccatattcttttttttttttttttttttttttttagaggatgtttggctcttattgcccaggctggagtgcaatggtgtgatctcggcttactgcaatctccgcctcctaggttccagtgattctcctgcctcagcctccctagtagctgggattacaggcatgtgccaccatgcctagctaattttgtatttttagtagagacggagtttctcccctcagcctccctagtagctgggattacaggcatgtgccaccatgcctagctaattttgtatttttagtagggacggggtttctccatgttggtcaggctggtctcgaactcccgacctcaggcgatctgcccgcctcagcctcccaaagtgctgggattacaggggtgagccaccgctcccagcccacagtccatattcttatgcagcttctgttttgccagccaaaccttactgagaaatgaaagataacatttctgacatgaaacataagaaatgaaaaatatgcttcagtatacaaaagtccagtttatgaagctgtgtgtttggaggcctcacactgatatttgttcatttattcattgactattcaaaatacatttgtacactgccgtcttcttgggtatataccccctaagaaactctgttgtctgtcttttcataaaccctatgtttaatggcagttttatcatttcattgcaagtaaaaatcctttcagaaacaggggctgtatttttctgtgtctctgaggacttttggaggttaatgcttggagaaggaactcttccttggacatttcctgagccctgtggtttacttttaataattattttggtatgaaatagtttgctgggttttgtggttagtgtcataaagtacctaatttccctaaagaaaaataaagccttgacatattaaaaaaaggttgaattgaataaaagtaaatctaattttttaaaataagtgtctgttattgtagaaatttctttaatgacagaaaacaggcacatgtgtgtgcacacacatatacatctcaaaacgatacatctaaggccttgcttctcaacagtttgtaatttcctcctaggaaaaaacaagaattgctgctgctgttattattcttatgaactccattgatctaataactcatgtttttttttttttttaaattaaccacaaattttcctgtagtgaggaagaggtaaacagtttccttgatgttgggaagtcccttttttagaagtgtatagtcaccgcaaattagctaggctgttaatttttttttcttcttttctgttcttgtctaaatagaagaatccatgaagcaaatgtatcctgtgctgggcttatggaagaacttgcggttgaacaccacaaaacacagtttccttggtcactcctttgtagtctgaaatgtttgaacagtttaattgtatatgaaatgtctaaatagtttaattctttgactcatgggacagccaactctgtgatctttctgaagtactaaaaatacatgaacagttgttacgacagacaatgtaagattttgtttcttgatcaagttttgttagatttctcttctcttcttccctctcctttgttcccctcccatctcttctctcccatttccctccccttcctctcccctaccccctttcccctttactccctctcttctctcctctcccttctccaccttttcctcaacagttaatctctttgaaccctttgcaccctttcggggttgaggctccctcttttattctggcgtttccctctttttccacattctttaacacttaaccttttctctctataattcttccatgcccaacatttactacatttttgtgaataaatctcttaaaatatacacttgatattaggatgtttatttttttacttgaattttggaaagtttatgtacgaaagtgcagttaagaattggtagtttcaagatgtggtttgcttttgtgatatgagagcaagtgtttttatttgactctaacatgtatcatttcaatttctttttgttctgctttcgagggtctctgcagggtctcagagtcctggaggggcagagaccatcttcagtgagggagctctgagtgaaggaagatctgggagttggctgtcttgtggaaggtcagcgtgatgacgtctctagacttaatcatgctgaatcctgtcccttgaatttgaaaggctatacaataattttgtcctgcttatcagagccataaaaccacattaaggtatagatagagggcacagctctttcacacatgtgtattgctaatggttctgaatctagtttttaaataaagcttgtcattttctgggtgtattgtggagacatgttataggaatcatttgctgactcttcatgttcattctatttaaacaaacaagaaccaagtctacaatatgacataattttgccttgtaactttttttctgatcttgcaatttccctttgtcttcttagctaaccaatttaagttaggaagataattgatctattgccacgtgtttcttaacctcctctccatttgtaatcctttcttctcggttggaaggaaactagaatttaaaaataactaatattttgatgaccatttataattttatctaaaattttaatggtaactttgatgttttaaaggtattccacacctcagaatccccctctaataatttttaaggatttcttccttgggtggagcaaaaaagaatgaggccttccctgaccatctcatgttatggtaaatgacagctacctgctggtttcttgggtttttttgcagtgattaagaacatttgttatcatgtattttaatcatctgtgtatttgcttatttgttgttatcttttccgctgtatattacaagggcaggaagaatgttagttttgttcacaatcctctaatatttaatatgtgcatggtatgcaacagacactcgataaatatttggtgagtgaaaaaatgcatctttctttttttaaatgacgaggtcgttctctgtcacctaggctggagtgcagtggcatgatcatagcttactgtaacctccaacccctggcctcaagcaatcctcctgcctcagcctaccaaatagctaggactacaggcatatgccaccatgtctggctaattttttaaatttttttgtggagacaagatctttctatgttttccagactggtctcaaactcctagccttaggtgatcctcctgccttgttcttccaaagtactgggattataggtatgagccaccatgcatggccaaaaatgcatttttagaagaatggatatagagctgttatgacttagtccatttaatatagactaattatgtgaaaatctactttgcaaagcggatttggggtccacggtatctgttagcagagccaatttttttttttttttgagacagaatctcactctgtcgcccaggctggagtgcaatggcatgatctcggctcactgcaacttctgcctcccgggttcaagtgattctcctgcctcagcctcctgagtagctgggattacaggtacccaccactatgcctggctaatttttgtatttttttggtagagacagggttttaccatgttggccaggctggtcttgaactcctgacctcaagtgatcacctgccttggcctcccaaagtgctgggattacaggtgtgagccactgcacccggcccattttactaatttttaactgaagagttggttttcaaatgaggaattcatttgataatgagaaaggttttttttaactttgggggtcaagagccaatgtataatttgaagataaaggtcctttccccagaaaaatgtagttagaccattacaaatttttgcatataatcataagatttatggatctttagaggtgggtccttgaactccagtactaagaactcaggctaagaactcatatgtaacagttccacttaatttttaggttgggtttgcagcaatttatgaggataataattcgtgctgaagatgaaagacaaaagtgtcagatgcccggcgaggacagtgctatccactaaggggtttaattcttgcctccattctctctgaggcttttaaaataaataacaggattctgataaagattgagctgtttcacttgagactctgtgggcctatggacttgtaatgaaaaccacagttattgttagtttatttccatgtgtaattaaagacaggaaaaaaatacaagccagtaaaatgagtaatgcaaggaaattctgatgcacagcttccttttgaagatggttttacacattcattcctgtctagttccctgttgaagattcttatcttggctgcgtagattgttcagaattttcaccccataggaaaacaactaaactggtttgcctcttcttggctgggggagccctccaagcaggtattctggctgagctaggccatattctctcttaagttacatgatttcacctatcatgttggttggtggtcttattgcctgacttctcttttatttacaattcctgtggtacattatagctttctggagccaggttaagaatgagatagtctgcccccaaccccaggaatgcttggatgttattttctggtcttggcaacctaaggatctcttaacttctttaatctgattaatggggaattcagaactatagttacaaaatagtttgcctaagctattactgctttgatggaattaatgatcaaatattggctaatgcccaaagcagattcgtgaactgtgcttaattttacatttcccttctcaaaggcaattgtggaacaaagaccttttatgttggttgaacccaattaatgaatggaaatgtaatttcatttcttctacaactatggttgaatttgatgagtcttgcttgtctacaacaacatgcatacgaatatcactttgtttttactaagtgaagttattaaggcaaaacactttttgttgaacttctatggtggataagccactttgatacctttatttgggtcaaaatgttctttaaacagcctttgaggcattgacctcatcaaagcagttaattttccaatgacccattttggagtaacatggacacaatggcagcttctctagacttgatctaaagtgtagcatagttggtaactaagcttcgtgattgcaaatgccagagactgttaagagctggttgtatatttgatgactctgtttgtttagcagtttgttagaagctacttggttgatcttggctttttgcctgatgtacatatgtatatatataaatataatatgtaaataatatatagacttaacaggtcagcctgttttataaataaaaatgggagcattgctcagaaaatggcaaaagaatgagacatagtatgtatttatatatacagatataaaatataaaaatatagatagtataatatataatataaaaatatataaatatatatataaaattagagtgttctgttacaagatttgtactcattaataagtcaatcaattttaatgactacttgatataattgtaaaagtatttacaggggattcaatgatgaactgaaaccagaataaccgtacaagttttagttcagttatatgcctttgagagtcaaggggggcacttttaagtactctagggcagcaggtataaactggaactatctcaggaaagttgagatgaatggtcactgtaattaaagcatacatattctctgtcatggggcttgcaggcaacgggggagacatagacaaatccaataatcagatagtgaataccaatttatagctgtaaaaaaatgataaagtgcatatagtaagaggagttgatctggtcatgggttagggaaggcctccctagggaggtaaagtgtttgctgagctctggaagaagagtaggagtggagtaggggagaagggagtacggtgtgaccaaggaattgccagaagaccagggagactcactcatggacatcagagcagagcctggtgagggaagaggctaggaagctgggtagggttcacaccatgcaggaccttgacctccctgggaagggtttagatctttaccctaactgccatgggaagccattacagattttagtggaggaggtgagggggagggatttttagatgggtgaatcacatgatcagatgtgctttgggaaaagatcatttgggctgtaatgtggagaagagattgaacagggatgggtagggtgaagtggggctggggacaaaagtaagtttggggagagtggttcagtggctttgcattaatccaagtgggagactatgatgactttagagtagtaacagtggggtggagcatatggataaatttaagagatattttggagcaaactcaacaggactcttccaaacttaagagtttggaaacagactcttatggtgaaggaagggtatttaaaattattttgtgcctcctataataatattacagttttgttgtgtctggtcagcctgttttataaataaaaatggaagcattgctcagaaaataggataaggaatggggtgaatgtgggggagagtacagagttttaagttgttaggcaagagttgaactgtagcatgatctcaaccagtattgctgtgtcactgatttcttaccctgatctctgctcaattagccttttggacagcaggtccaagatatcatttaggatgccagaacaataatcttctaaataataccctggtgccttgaaggagttaaggtatggattcccagatgctttatctataaccagcctgcatcttagactttgggcccaactggtagatcacataattcttttataaggctgttgctcatattaaagtatgatgtaataaaggttatgaattaaaaacaaaaacctacagggtcacatgaatgtgtataaacatcaatgaactaagtacatttttttttttttttttggcagaagacttgctattgcgtataacatagcatcaggctgacaatggtatttaaatgtaaatgttagccaagtaatgagatgttgttgtttgcttcttttgtgggctttggattcttgtgtcattcattctgcctttattgatctacatggcttttagcattatggcattctaaatttctgaagataataccatgaacattcttccaaaaatattctcagttaaacaagaagcggagactctcttatgcgtctctcttcttttgcttctctcttgaatcttgacaaattatgaaatttcaactctagtttatacttagagattctgttttcattagcagtctcttttgcttgagttgaggtgaggaaggatgttgttagaaattctcattttcacctactggctctttctttttcagttttcttgtatgtgccctaagctgagtattcattttaagcacgctcatctacccttggtcctctgtcctgagcctcatactgactggccagaaaaactggatgttatttttcaaaagcttagtacagattttgatatcttgttgcagcatttgatactaagaatgactgaggccggtgttcagggatgctgcaggtggttttgattactgattgccaattcatgtctttacaaagcgttgtgtcatattttatcttaaatgtggttaattttttttccattcatttcttaaatctttcacactgaattggataggtttttgaagttcaaactgcgtttgctgtaagctgggttcttggattgctgtccagtgtgagcttgggcagtccagggatttatttgatggcggtgtgctcagcttttgaaattaagtaatagaagtaggatttaaaataacttttttaacatactagttttgatcttttatcaaaagatcagttttgattaactccctgaaaagacatgtaatttcaacattatctgtgtgataggtggaacacatatattgctttaagtctactagtcttagcttaaaaatccttatcagtgacaaggaaataataatgcctaccttcagaggccactgtgagggataaatgaggccattcatgcagttgttcatttgacagatatttacgaagcatctgcagtgtacatgggactggtgcttaacactggaaatgacagagaacaaaatcaaatctttggccttcatggagcttatattttacctaatatttgtaaaatgcatgatagatgatcaataaatcatagctctaattgtcactacctaaaatttggataaaactttgagatctaaaatatattgttaaatgatttcaggtcttcccttattttaacttcaaattaaattagagatgttgaagaagttctgtagatatattctgcacattaattttaaggttctaaagcagtggttctgaactctgacaacacattagaatgaccctggaggcttttcaaatactgaaataccagcgttgggaagcttctctcagagattctgatggtggtctaaggtgggcactggtatttgttttaaaagctcctaaggtaattctattgggcagctagggttgagactctctgaaatactttacgagtatttacatgttatggctatttatgtatcaaggtacatagcttgatatgagagaagggctatggcatttgctatggattggacaagtttgatgataggtttccgagcaaaatatatggcttctgagaacccaggtgcatggactgtaggcatgactgccacagtgcatctctgtcccctggatcaatcactgtaccacaaagccctcagtattctcatccataaagtctggttaaatgcagtgaggatgcctgccaatactagcagtttgctgctctacagggtattgatttaataccccagtatatgaattatctgtttcccagaatggtttccagcctgctgcctcgttcccttcctttgccacagctaatcaagccagtggtgaacattcagtcaaagcctgccagatcttcagctggcaaacacacagctaactcattctggagagactttgagtaatgatgcaaatgtcattatcatctgggaagcatagaatgacaaggaaggtatgggagagcttgattaccaccttggtctttgtgtgatttgaggaagactgtgtacacagagagaatcctagagtaggtgtgtgaggcaaggtgcatgcacattccacagggctgcaactcgatggcccatgagacagagagacggacaggagagctttgtccctggcctggttccagttccagtcctcagggccccacctgtatttaattctgtccttgggcaactgaaatttcttgctgtttccttatcattcctccttccttgtacttccttcagtgggtttctgtccttatgcaaccccagatgctttgagtagaacattagattagtagaaacttttcagtaaccagtggggcagtactaaaaatagaaatggggtaaggagaataagcaaaagagtgtgatgttgtggaaagaatgaagacagtaagttatagtcttagctctgtcccaaaatagctcaatgaccttccccaaggtgcttgactctcccaggtttgtctaaaatggaaatggtgcagtctcatagggctggggtaatgaaaaaaaaatagattatagttgtagaaatgccttgaaaaggtaaaatggcacaccagtaaggagatcatctcgtatcccctcagacatttagacaatgtgagatttgagttgtttgctttcagagacagagctaggagagaagagaaactgagtcataataaaatatgcctgaggggcaaagtttttaagtgttcattgaattctaaatggaatacttctttacttctgtcaacttttaattttcacagctttattattctcccaatggctattatttctttctcagaatttctgattatttgctgcctcagttgtctcagtttttcaaatatatatttttagatagagttcaattttttcatgaggttctgctcacaatgcgggtgacatagttctttgtgttatgaattcgtgataaagttactgattttctttctttgcattcagcaaagaacaagaattagggcatgcatgtaaacgatttggttggttggccttcttgtcctcacttggcatatcctaaaatcattttattgtctcctacatagtggattgggcaatgggaaaggtttacaattggaaaggaaagttggtgtaggtctttccagcagtaaaatctattaaagatccttttacttttgcctctcacataaaacgaatgtgtaagtggctctgagaaaggtaatgatattaatgcccaaatgtacacttaaatgtactattataagtgtacttactatgagccacttacaatgtactattccaattatacaattggaatagaaagggtgtcaagcattcaggactgaggaaaattggcctggcagtgaacaggcttacttttggacactgacattaaacctgactcagaagattttctcattccttaatgttactcttcaagataacttttcattgacacagttaggtagctaagggaagataaagtaaaatcaaagaaagattggatctgtcagtaggttgaatgtgcacaaaagctttccgctcttttgcttccattatgcatttacaccaagtggaataagtctccctctgggaagcgctgttgcaattctcagtacctttgggcattaatatcattccctttctcagagtcacttacaaattcagcttatgtgataggcaaaagtttaaggatttttggtagagtttactgctggaaagacctaggccaactttccttgcattccaaactgtttcatattgctttagtggaaaaggaagatcactgctacttgtagatctgacattggaacacaagtctcttgaatcattagcttttctggagttacgcagcttttgtatatttgagatttctttaaaaggtgtaaagttcattttcagtgaagtatgaatggagtatacaataccgttctttttaacaactgacaaattgattagcatttattgaattaaatctagttgaaagtcagtaatttttaaagagtgccttttaaaaaattggtgttatgaacaaaaagtgagaatacttaaggatcttagataaaattgtgaaatggacttaactaggcaatgaaagattgcgaatccattactttctggagaccccttaaaatctatgggaacttaatggagggccactaggtgtttagatgtccctggaagatattagatgcctatcaacaatatggttcatcattgtttcatatgcccttcagtccatgaggtaaatggtggtatggctggctcatgggaactagggaaaacattatatgctattggtcaggtcactgtgtcactgggcagcttcttgatttccttttcgacctatttcctgtttataaaaaaaaaaaagtgcaactctctgccactgcggtattctcaggtcaaataggaaacaggttaaataatcaattctccatatacttttggccatcttcccaaatgtaatgagttcacagtgtctgatgacccaaccttgtggtatagtttataaggaacaacttaagtattgactcattcattcattcatttaataagtcttctcccattctatatatttttgttattttgatctcattctgtcacctaggacggcgtgcagtggtgtaatcatggctcactgctgccttaatttcccaggctcaagcgatcctcctgcctcatcctctcaagtagctcgaactacagatgcccaccattatgcctggctaattttttaatgttttgtagaaacggagtctccctgtgttgcccaggctggtctcaaactcctgggctcaagcaatcctcctacctcggcctcccaaattgttgggatgaaccagtgtgcccggccccattctatcttttttaacttgccagctttactgccatttgtgtgtgtgtgtgtctgtgtgtgtagtctgaaattttggtatctttgtataccaaagaggcatgccagttattaatctactgcggcatgtaaaaagaaggtgcaagcttccaggtgtcccctcccagtggagtcacatggagatttgcttgattctcccggcaacaaaggctaagtattaccagccaggaaagctcactggcactttgatgttcagggattttactggagatcatatagtgtctgtgtaactgacctcaactacttaagacttcggctcttcttttctccctgggcaaaaacaggtgtttgccctaaatcgcactgtaaggataaacttttctggtaaactggtacaggatggctcggggcctcaggtttataaaaacagatgctaaccataaatacagtggggcccagggcctcaggcatacaaaaacaaatgtttaccataaatacaatatgacccaagacctcagacatacaaaaacactgaacgaagcagaatattccaagggttcagaggttatctcctaggagttaacaaggtccagtcctgaagataggcctttctttggtatgtgcagagttctagcaacccaggcctaccaagttaaccgtttcctgctcacattgtctagtaataaggttgactctggacaacacaggtctgaactgcttgggtccacctgtacgtgatgtttcttctgcttctgccacttcggagtctgcaagaccaaactccctcttccttctccccctcagcctactcaacatgaagatgatgaggatgaagacctttttgatgatccactttcacttaatgattagtaaatatcttttctttcttgtgattttcttaataacattttcttttctccggcttactttattgtaagaatacagtgcacaataaatgtaatatacaaaatatgtgttaattgactatttatattattggtaagccttctgatcaacagaaggctattccccgttgagtaagttttggagagagtcaaaagttatatgtggatttttgactgtgtgtgtggggtaggggagttggcatccctaacccctacattgttcaagggtcaactgtattttattgaatgctagtcattgtgaatgttatgctgtgtgtctctggattttatcattttgtaaggagtgttgaattttgttctggaaagtggatcatttccttgggatcagcttgattctttcaagggctgtctttaaattttctgagagtggatctaaagtcgtcttattgtaggcttagtttagccctatacccaagtgtggtctttctgggatctctacagaacactcctggtgtttaaagaagtctctccacttctgcaggttggaacttgaatgtttcccagcccttgatgagctctgaaagttgttcagtttataactttattacagatgctctcttcctggtagtcattctttctctagtagttgctgtttgcccaggacagtgacatctcaccctctgcatatacacattactattcagccaaagactcagggacacacctagaaagacttctaggtctcttcctttgttgtactgtggcctgcatattccagccatctcattctccccaaatgtaaaccgtttctttccatgtcattgagactcctctgtgctgctcaggttccttctctctgctgcaccatctggaaagtatttctagacagaaagcataggtgatcacactgctcatctcatttgtttttcttcctttgggaaccacagtcgtgaactgttgtttaataactgaaaactcttgtttcatatatttttgtctgattttctagttgattgtagtgggagaaataatctggtaccagctgcttttcatggctgaagtgtaatttactctaacaatttttatgtaagaccaggggtttgagaatcagacatgtggacttcggatttggttcccagcatttgctaagttttgatctttggcaattagttaacatctctctgacttagctgctttattgtaaaatgggcatggtagtacctaattcataggggtttatgagcattatttgtgatagtgcaagtaaaatgcttagtatagttccttacacatattaaggctcattcattgatgatgatgatgatgttgataatggtggtggtggtcgtggtattcagctgtctgtattttcactataagtgaggatgttacatagaaaaaaatgcttttgttatgttacaaagtgaaagtgctgcaagtcttgtggcagttaattgtcacaaatgtgataggatcaaggagagcttagacactcttccttttcactgcttgcagaacagtcacagaagttacagaaaaattcattgatgacttctgggtgtggtagccagaagagttgatgctttttctgaaaatactcatataagtttagggatacaaagctcctgaagactgtatttaaaatgcctttaaaagtgaacctgattatatctttaatgttttgctttttaagctgtgtggtgcaaacataggtgtgtttattattattttttattctatttgatattttgatatacctgaaatggttcataattttccaaacctgtctcaccccctcaaaagcaggcctttttccagagtcagtctgtgctataagtctaatctgttaacatttgagtggatcaaatcttaaaaccatgagatagcttctcattagtactagtgtacgtatttgagaaattgttgaattaaacatgcaagttgcagtatgatgtgtacaatggtactactcaggtaaaattttaaaatatgtagaacattactgtatactctggatggatgtgtgtgtggtgtgtgtgtgtgtgcatgaaaaacttggtttggaaagaaacatgaagtttaggaaaacaattattttctgagaaaagagatgggagggagagcaggcaagaattcaaaatagtcttaaattgaatccatcatatattatttctgaaaaaaaatgaatcaaatattccagataacattttagaatctgaatggtgcatgtatgggtatgttatattcttctttgtatttttctatatgtttgatacttgtcttaaaaataaatgtaataacaataatgtacaagttggtaatggaattaaaacttttggctctaggggcttggttcatgtttgatcaatatcaagccttttggggttatcttcaggaatgtgattgtaatatcctgcattgtgtcttactctgggacaacctcagaatgtaaagttatacttaggagtccagaacaccttccttttgtaaacacatatgcattagatattgttaggataaaacttcgctgatggttttatcagcgataaacttcatacttaggtatgaagtatgaatatttaatgcagtatgaagtttgaatattgtaatgcagggactttttcctgggccagtctatactcttaagtctaatctgttcccctttgagtggatcaactcttaaaacccttaaatagcttctcatcagtaggacaaagttcatgcaacttaaggggacctaggaagcctgcttccccttttcccctgttgctcctcccaccatccttttttctttctttctgttatccaactatactagactttttatccttcttctgtttcctcttaggtgtcctgttcattctcttgaggaggcattgatttcccctttcctctttaactccgtccctatccctcagtttttctagtggaccgctctacatcagtcaaatcttagcttcagtatcccagtgtaaccacgtaagttccactactgtatgctttctacaattttccaatattaatgctcatatcctcactgttattactcacatgcccacctttccagtcttcaatttaagccctattaggaagaaaccatgtttatctccatttctctagcacctatgtagcatttataatataagcactaaataaatatttgttgaatgaaaacatgaattaagtacagtttgggcttctgatgaatatatactcactagatacttaaaatttttaatggaaaatactggatttaaagaaaacttttatgaatattttaatgaacattttcataaaatattgagaggatttatggtcaaagatatatttttaaattggagaagtaaagtgtttactcacaaggaaagcaatgctagagtcccatgggcattaacaggttaattttcttctttaaataaattaattaaaatttttattactaatacacgtgtatggaaacaatcaaagaggactgaagtgtttaaaatgaaaagcagtaatcatatgcttcagtgttcctcagttctatctgattaataagttaaaactttaataagattcaccttcaagaagaaaaatgtgcatgaacaaaaacaactatagttgttgagttgaaggtagaatgggaataaagcctcacactaaaggggctttttaagtcatgatttgtttttaaaaatgccatctgaagggcacagtgattcctccagtgttagcttgtgttttctataaccttcttcctcaaaggcccatcctaaaaaagattcagctttgcttttttgcccctctttccaaagacaggatctcaaaaaatggtaactaatttaagccctgctaaatgtccagatgcagcacctgggaaaaatgaagttcagaagttcagaatttggaagcgcttaagctagaagaatcttcttgctgtggttgcatgtctggttctggaagctagtaacttctttcaggcaggcattgttccattagaacagatggcccgaagtgtggctgtgccagagagcagagaccaagtgtgaacttgtccaggaagttgaaacacttctcagaatatcttcttctcctggtaatagccgtgccattgcaactagaactttctgggttggaagagtgaactcaacaaaacaaaacaaaacaaaacaaacaaacaaacaaaaactacaaaaaaaccatgagactgggtgccatggctcatgcctgtaacctgtaatcccagcactttgggaggctgaggcaggtggatcacttgaggtcaggagttccagaccagcctggccaacatggtgaaacctcgtctctactaaaaaaaagtacaaaaaaagctgggagtgatggtgcatgcctgtattcccagctacctgggaggctaaggcaggggaatcgcttgaacccgggaggtggaggttgcagttagccaaagttgcaccattgcactccagcctgggtgacaagtgagactctgtctcaaaaaacaaacaaacaaacaaaaacataaaagctagagttagagcattgatgtccaatgtggtagctattgaacccttgaaatgtggctagcccaaattgagacgtactgtatgtgtgaaatgcacaccagacctcatagatttcatatgaaaaaggaaagtaaaatatcttgttaacaatttttaatatagattcgttttgaattatgttttgggtaaataaggtagtaaaattgacttcacgtgcttcattttgtttttctttttaatgtggctactagaaaattgaaatatacatgtgtggctcattttgtatttctattagacggtgctgcttttgagagaaactttaccagggatgttcatggaactctgtccaagttacactttgatgtgactctttactctggagtagatcagatatggaatccaaaccttggaatttctaagttagcttcttagtaacttacagtttaaatgtagcaatgaaaacaagagtaggatttttttttttcagttgtaaaagaaatttctagaaactaagagctttacagagcttaaaatttattctcattgttttatttttaaactctaagtttctgccaggacaaaaatgttcagttctttttggattctgatggcctggtaaaacttctttgtaaacctaggggatgtgatagaattggcacaggagaaaattaatttggttgggatccatgaatggaatggaggtgatgtgcaggccttgcagtctgttgtaatcaatcattatagaagttttgctgcgatgctggcctgcccaacactctgcactttgggcaacatcgtgaaaagatatcttcctgtagatccctgctctggtgcaatacaagtgtcaacatagaaatagaatgtgtgttattataggccacatatatacacattcaataaaatgtctcagcatttactcgtgtgtgtgtgtgtgtgtatgtgtctgtgtgtgtgttctggaaaaaagttaaatgagattttccacaactttttaaaaaaatttcagcctcgttgtaggatattttccaaacccacattttccagcaatttgagccccaaacttatagcaatgaggcactttcttgacaaaggtgagtcaaaaacaggaaccctttgattctgtttgtcacatgatgctggatgttataaaataataatagcaaggagttcatttctttccctttgatcgtcagacttttagctgcttcacttccattgctaaagccaggaattcagaagtgtaggtcagatgctgtgcgtagaaaatgcatttgggagcatacacattaaatgggttataaatagtatctgccctgacaatgctggaattttctcagcttttagagacattgaagtctttgttttgtgggttgctgccctccacccccaaccccctaagcttgagtcataaagcctgaaaaactaatgaggttgctgaaacttaaaatctaattggtaggatgtatggaaaacaatgagagatggcagaaaccgtacacttcgattcaagttggcttctctgttgcagcattgcaacttgctcactttgcattttattgttccaggtccttgaattaattttttccttcaataggatcaaattagacctagatttaaaaaaaactcataagtagataaccatcaaggctaatattaggatcctaaagtcttcatttagaaaaggaaaaaaaaaaactaaaaaaaaaaaaaaaagcaaaagttcaaacgggattttctttttaattttaaaattttattttattatgctttttgagactgagtctcacttactctgttgcccagactggagtgcagcgacgtgatctcggctcactgcaacctctgtctcaggggttcttgtgcctcagcctcccgagtagctgggattacaggcacatgccactatgcctggctaatttctgtatttttagtagagatggggtttcgccatgttggccaggctggtctagaacgcctgggctcaagtgttccacccgccttggcctctcaaagtggtgggattacaggcatgagccaccatgcccagcccaaactggattttcttgatagtctctctctctcagaaatattttgctcttatcttctgagtttatagatgatattttacaacaaaggtctacaaactataaaccacacctggcctgtcagcatcttcatggatgcccctacaattaagaatgattttcacattgaatgtttttccccccagccgtttaatgttgaaaaaacaaacagagaaagaacatgtggtagacatcatacctggcccaccaaccctgcaatatttgctatctggccctttacctacaaagcttgctggcccctggtttagaatgtgcttgctgtgtcacccttgctattagatatgtaatcagataaaaagtttctttcttggattttgttaattcacccattgaatatttctggagtatttattccattcctggcactgtcataggcactggggaaatgaagtgtaaaaagtcacaccaaaacacagactaaagggcatatttcaaaagtgacagagcttgcattcctgtcgagagaaaaagaccaaacctaaccaacccgaacagaaacaagaaatgaaaaacttaattaccaggaaaataaaccagctgagtatgagatagataataacagcaatttctgtgcttccccccttgaactgcactatggaatggtgactaagttatttcccacattttgaattcacccacccacatacaaacaccaaatacttgcttgctttccccaagtcatttcctcatttttaattttatttttttcctaaagtctttttgccccagctgaaattcattactcaaccccgtcttattgagtactttagtttggtgtttccaaggtttatttatttggtgtttgtttttttttttttcttgaaagagtctcactctgtcacccagggtgagtacagtggtgcaatctcggctcactgcaagcaattttcctgcttcagccttctgagtagctgggattacaggtgcatgccaccacgcctggctaattttggtatttttagtaaagatggggttttgccatgttggccaggctggtctcgaactcctgacctcaggtgatctgcccacctctgcctcccaaagtgctgggattatggacatgaaccgctgcactcggcctcatcctttttttaaattagcttttctgtgtctttagacttaaggcttgttgcttgtatgcagcatatagttggattttgatccttactctttgtcttagcagctcaggctgctatcatgaaataccatagactggtagcttacacaacatatttatttttcacggttctgaaggctaggaagttcagatcaaggtgctggcagatttgattcctgataagaaggtctctttctgtctggcagatggctgctttctcactgtatccccagagagccaaagaagctctctggtgtctcttctaataagggcactaatgccatcctgggggccccattctcatgacctcatctaaactcaattacctcccaaaggccccaccaccgaatatcatcatattaagattagggcttcaacatatgaagacaacagtcttttatgctttttcccccttttttggtaaatatgtattatggattatagttattttatttattttagtatcagaatctttcctcagatctgacattctctaaaacttttgtgatctgcaccaaagtaagttacagacaaatgtttgcttgtttcctttattttggatcttttctgtaagaattctttgtgatactaccagattagtaatcctgctctcctaagcatactgagtggtagcctatgatttcttttgtggttcaaaatatgccctgtagcctgtgttttggttagcagaatggccagagcttagactaaaggccacgactcacacattccaaatacatataggcttgaagttatcctattataaaacagttaccacattcatgtaaatggccaggcaaaggtcaaaatatgagcaacattatttgtagctcagtgagagatttgatgttcaaagtctgtcagcatttgtcagaagactgatattgtcaatggctgtttcagattaagaccaactaaaaagtgatttggtgtgaactcagaatatagggaaaataagacaatttgaatgtaccccaggaaacaagagccctgcacttgactccaaaaggagttctattattctggctgtttccagactttattgtatcttgagaagagaactgttttccctctaaatcagtttcatcatctgtatccagggtagtactcacaagaacatgtcaatatcaatagcatgcatatggggtgttggattcttagaacttattgcaattgcttcctctaggttctatgatgattatcaatttattgcctctcaggtccaaattcaccctttattgtctgctctgtgaaaatggacctgaactctttaaatggtatgatgttaaggtttggcaggagagggtgctggagagaagtcacaggaagaaggggttttccttcttaaatctggcgtgcattctcacgtggcttctgcagcatccatggcttctccaggacctggctcttgcagcaccggagacatctccagggcttgtttcccacagcacttgtggcttctctagcaccatgttcctccagggctctggcttcactagtgcctggcccctgcagtgcatagtggccacagccgcacctggtagccagcagcttcctttggcacctctccttgggctgttttgtagcagggtgcctctggtgggacacctccctgtgaacagcttccctgaaaccctagaggatggattccagtaagctccaccactgaagcaccacagcaacttccctgcctccagatttctggctcttagccctggggataaaggctctcccttgggccctgtatctctgtcttagagttaatggccattccttgtctctgccattcctatattctttaaagttctttcaggttctctttacttcttgctagctaagtcttgttatagttagtaatttcttctattaaagtttctattttcagacagtagtttgaaaagagaaagtttaatagatgaaatgacaaaccatctctcctaattggacccagggttaatatagggtcccatcaatagtattatggggttctgtgcttgtgttgcaaaaaacaagtggttgaaagagaatctaatggatttgttcaaaggagcgtgaaatcagaatgtatgtgctattatatatttccctgcactcttctggttgaataaaccaattttaggaaaatctggaagtttgccattatctgtaatggaggaagagaatagtggttctgatgatactagagtgaaaaaaattcattgtctgacaaattgaccattctgctttgtgtgggaacttcaggttcaggttctcacaacaaggctgctgaggggacctagtggatgagttcagtttctggggattgtctgcaaagtgataatatctacattgataatcctaaattgattaagagtgcatgtcaagcgttgtttccttccaccctcatatcttgtgatagggccatagcagttgttcttttcttccccttttctgtgtgaatcctgcagcagtatgatatgggccagcctatgatgcggaagtaaaagaaaaaccagaataaggtgccttgaggattatctggtctgatccctttatttttgagatggggaaactgaccaagagtgaggttaagtgtgttgctctcaagagtgtccacctagttagaaaacacaaaaatatagcaaaacagatctgattcctagctggttgtttccctccaaactttactttttaatctctaatgatttatttctttatatttatatattaagatttacaaaacttggaaaaatatgatatatactttaaaattaaatgatattttagtccacattaaaagaatagatcagtaaatgtcttgtgcaggtgcatctttttaaaattttacactacatatattgaagtggaatacatagagaggagaatgtacatattataagtgtacaccatgatgatttattgacaaactggactctcgttaaccagccctcaggtaaactaattgaacattacctgcaccctagatgcttccttcctgtgccttttattcactacccctcccaaggttaaccagtatcttaactaccaactgcatagattaattttgcctgtcttgtcctttatagaaatggaacaagccatatggtcatatagtaggtacttacttgggcctggcatcttttgttcatgattatgtttgggaaattgattcttcctcattgctgtaagtagttatatagttcattcattttcatttccatatagtatttcattatctaatcctactaggatttagttatccattctactgttgatggatatttggagccttttctaatttggggcatttacagtgaggctatgaacattcattataattacttttaaaaacttttggacattggaagacagcaaaatgtgaggttgaagacacaagcttggagttagacaactcattaactgttcagtcttggtctagttctttatgttcatgagcctgtctcctcattggcaatgggcttactaataccagttgtgcagggtttgggaaataatggaataaaatgatggatactgtgcacagtgcttgacacataagtactcaaataatggaagctgccattactttttaaattaaagttttatacattatagcaaagtatcagccaagcttattttactatttgtatctggttgcttgtacacagtgtttttcattttctcagggcctgcacatgctttatctttggagtaatgtttgattctttatctttcctttcccttcctctctgccacaattattacctgcctgttgtattctaggtactggggacaggaactgaataaatgagcagacattattcattcctgagttttcttctcagtttttgctgttgtattagcctacatcctcctcttctcatgccatcctctgaatgctaacattgctctttgacagcctctcaccagtgtaacccatcctatctgagggggacaggatcatctttctccagtaccaccactgccagttgagttctttagtgaggacttgagaaaattcagctttaccctcaagtcttcaacagacactgtggtgcaggcttttctcctaaagatgtggatgtgcagtgagacaaagccactgtatcagtcagcagaggctaagttttgctgcattaacaaaggactccaaaattttatgacttacaaaactcacagattgacagtagctctgatctttgtccaattccttctgaaacaaaggcttaatgagcactatccatttgggacatatttgtcttgaataggagaaaaaaggaaacggaggaaccacagagtggctcttagaacttctgctgggaagtggcatatgtcacttgtactcacatttgtttgcctacaacacgtcaagcctgatatcaatggggagggaaatataaacctcccagagagagcaatcggtaggaagggacttggcacagagtcccttggctcagtcatgttttaaacatgttttaaacacttccattgaatcagtggacatgacttttggaatataattcccaatttattttcccttttttttttgaccttcacatcactttactgtcaaatcagcaaactggcaatgcacaagatatacagaagaccaaggctccaaattagtggcccaggcaccctgatgacttcctgtttctcagaaaagtaagcttgggcagcagtgacctccacagcctatgataaatgaggaatcaacagttgcattccataattcaataaatagttcttccttctgccaggtgatgtgatggaagctctgtgcagcttcaaagtaagagttgacttctgcgtctatacaattcttgtcataaatgtgatcaagtatatctttacctttctatacagttggcccaaggtatgattactggcatgggtgccagctaataagtaaatcagtcagtattgacaccatgtttagcctcaagcatgcttttctctggaatgcacatttggatgaactttgaggaaaattattaactcaccccaacttaaggagctttgaccgaccagagatttcaggattatgtgtacatagtttcaaacgttgtattttaagatgaagaataatttaagaagattagtgagcatccttcattaatctggagctattttagtaataataaaaaagggcaacttgttttcatcttagaagagtaataggtcagttttatttataggtgatatctaatcaattttttatttagcttgtataggatgattctcaagtagataatgttaactcacctagaataaaggaaaccacttgttacctaagtatacgacattttaatagcttttaaaaaattcaccatactagtttacacaataaaatgtttctataagtctgtgtatatgtatatataaatatagaaggtaaatatacagattatattatataaatagataaatataaaatcaccatggtattttgatatataaaatgagtctcattataatgattccactaaatgtacaacctgttataaaatgagtgataatctgaccctcatttctgtgttttaatcttgggatgatttgaagtaaggcataatcatgtatgaacatattcctggagtctgacatgagcatcatgaacttgctaattttattccttgatggtttatataagtgtctgacaaatttaataggaagcagagctttattttttttcattatcagctagagaacaaaaacattggcatctgaattgaatactggaatatcgtgtgagtgtgtgtgtgtgtgtgtgtgtgttttactaagattcatgccactcaaagtgtgacccatggactggactgcttcatgaactgtgtggtgctgtcctacaatatgctaagaatagaaatagagtgttctgaaattttagagcaatcggaaagagtagctttaggtctgttggacctaataatacaaatttgggcttgcatatttgtgtttgttttgtttttcatctcatttgtctaagaattcacttttatatagtctataaaagtatcagcctgtgatggatttggagttaaaaagacaaacaaactaatgccacagacggtttagaagcattgatgaggaacctgcatcatgatgacagaaagtgatataacttctgttattctataggcgtgaattttgacatggagtactgtggcttgtattgcattgagattttaaaattcatgtcccctaacctttaagccatatccccttaactttccactacaaatattctatttaactgtgacttttgatccacttttttctagattgattcagaaaaagtaattctttggatttattcatttgttcagccatcgtttattgaggaactactttgtgcctgacactattccaaacacataaaattcagcagtaaaaaaacagttcttgatttattttagctaatatgaaaagaactcaaatatacaaatatatttgtgtatatacaaaggtgtggatgcacacacacacacacacacacacaccaactgtcaggtgatagattgtttccacctgtcatttggttccacttggactactaatgcatacattctttctccctatggatgttaacatcactattggtgtggttttgagctgatggaagtaagtcccaggtaacaaatgtaggtgacctcccttagggccagtgatgcctgaggatggcattcccagtttggtgatgacagtgggttgagaggagcctcagacagtggaggaaccttagaattcactgccacgtatcactgtttcctctagggatatcattaaagagagagttccatctgtgtgtttctttggttcagcaggagggaccgtgatgtgatcttctgggcgatgtttcagctctgcgaatctaggatggatcaggaaggtgttaagcctctgaaattagggcagtgttttgtgcagatgctcttttctggggtgaggttcccttgctttcatcaggttctatcggtggttcatgaccctcaaagtcaaagaatcactggtgtacagtggccacaagagccttctgcagtttggcccctgttactcaatctggctttcccctttgtgcttccctgctgcatttgggctggcctcctcactcttgcccagtgtgctgcacaggagctcacctgggtgtgtacttcctggaaagctcggcctgctaccacgcacagagctcattgcctcacctccttcaagactttgctcagatgtcatcctctgggcctaccctgactaccatgtttaaaattgcattcctctcctggcccccaaatcctggccctttggttgcttcttgttctggcttattgttaaccctggcacttgctacctttaacattttctgtgcttagttatttggtttatcaggtttatcattagaatttccctccccatcccgatgcttcatcaaagtggggatgtttgtctctgctcactgctgtatcccccacactttgaacctgtctggtgtataatgggtgctcagtaaatgaaaagggggttcaataaatgaatgaacagatatgatatctgtctctccctttcagtgtgcccaacatggagcttaaatttggctggttgctccatgtatactgcatcccatcggttatggtttcatgaatctcatgtcttacgttgccataaattagcttttaatgtatccctgtattttcttttcagattacaaatattcccattatccattttcatctttttcttattgatttttgctgtctgtttcatcttgctttaccctagaccctcaaagtgtttgtggataagaccttaggcaagttagctgacttctctacccctcagtttcctcatcttgtaaaatagggataacgatacacaaccttgcagggttgctctgaggctgaaatgagatgatgtgtgtcaagcagttagcatagtaccatacttaaatattggttgcaataatgctgttgaagatgtaagtatcttaaggctcagtgtaatgtctggcacatgatgggcacggagtaaatggcagccgttaacaattatgcttcccccccattattatcatcactaatgatatggtctggacaatcgacatggagtagggcactagcagaaaatcctcgacagggttaagggttgacgttcttgtcctctttttctgttcctttttctttcctcttccatggtggggataaactttttctccccttgccatgcaaaggaagaccttccgttctttgctgtgtgctgtgatgttggttgtcactatcatagtaataccatatcttttgcaatttttttgtttgactagatagcagtaggtaactaatctgggtcctcaagacatatttctatatatggatttcacaacaatcttgatttccggcaagagtttcatttttgtggagggcatttcaaggagctgccttgtaaatttctgaatgcttgggttgtttgctttgtttcttttacccctcagtgccaggtaagtaaaattccccagatttgaatcttacagttaatcaatcagcaaatacttattaagtatatacatgggagattatttgaagagcagaatgacacagtgaaaggtgagctttagaaagattaatctgggggttgtgtgcctaattggtggaaggctctggtgagcagagaagggagagtttgttgtgggagtccacaagaaccagtggtggaacggtgcccgagggagtgggagctggggtggtacacagggtgtacgcatgctcagcttccctaggtatagccagccagtctcccggagccggtgccccaatttacacttccatccacaatgctcagaattttggctgctctctggtctttccaacatttggttactactgctacataacaaatcatggtcaaacttagtgagtgaatacaatacatgtcattttgttcactctcatggtttctgtgggtcaggcattctggagtgctgggctgggcagttctgtctcagcatctcttaggaggttgtagacagatgatggctgccagaccatcagaaggaggaggccattggtggtcaatttatacccccacttaacatctttctctatctcaagggaaaggactgggtgaggccaaagaggcctctttctgaggatacgaagtgaaggaggcattttttctcagggttatgcaggttctggccctgccaaagaaagtagatgccaaacatctactatgtgttagaccttgggcaagatcttctacatttatttgaggtgacttactccctttaatgtgatgtttttttcagggttaactttctagataggcctttccttaccatcctatcttcatgctttccctttgtattttcatcttattgcccagtggatcaccttcgtagcttgctgttttcctatgacattgtacgcaattgtttccccgtttacactgtatattgttgtttgcctagtcacactgtgtgtggttgtttgtctagttacagtgtatgtgttttttttgcctcgttacaccatatatagttgttttcctatttatactgaatgtggttatttccctatttacactatatgtgtttttttgcctagttacactgtatatagtttgtctggttacactgtatgtaattgtttccttatgtgcactgtatgtagttgtttgcctatttatactgtatgtgattgtttgcctagttatactctttgcttagttacactgtatgtggttatatacctggttagactgtatgtagttgtttctctgtttgcactgtatgtgattgtttctctgttcacactgtatgtgattgtttctctgttcacactgtatgtgattgtttctctgttcacactgtatgtgattgtttttctatttatgccgtatgtggttgtttccctgtttatactgtatgtggttgtttccctgtttacactgtatgtggttgctttcctgttcacattgtatgtggttatttttctatttacattatatgtgattgtttttctgtttacactgcatgtggttatttccctgtttacactgtatgtggttatttttctatttacattatatatgattgtttttctgtttacattgtatgtggttgtttccctgtttacactgtatgtggttgtttccctgttcacactgtatgtagttgtttttctatttacactgtatgtggttgtttccctgtttacactgtatgtggtggtttccccgtttacactgtatgtggttgtttttctatttacactgtatgtgattgtttttctatgtacactgtatgtggttccttccccgtttacactgtatgtggttgtttttctatttacactgtatgtgattgtttttctatgtacactgtatgtggttccttccctgttcacactgtatgtggttgtttttctgtttacattacactgtatgtggttgtttttctatttacactgtatgtggttgtttccctgtttacactgtatgtggttctctgtttacactgtatgtggttctctgtttacactgtatgtgcttttttctctgtttacactatatgtgatggtttttctatgtacactgtatgtggttgcttccctgtttacactgtatatggttgcttccctatttatactgtatgtaattgtttgcctttttattgcctgtccacctgcattccttcagcctctattactgaaggtctgtgagagcagtagccatgcctctttcatgcactactgtgcacccagtagcattgccagattaaatatggatactcagtgaaacttgaattgtgactcaaaacaaatattaccttcattttactaatttatttttaaaatggacacattataattgtacatatttatgggtataatttgatgttttgacacgtgtgtgttgcataatgatcaaatcagcatagttaacatatctgtcatctcatgcatatgtgttttctttgtggtgaaaagattcaaaaacctcttttctagctgttttgtaaaatacaataccttacttttaactacagtcactgtactgtacaatagaacaccagaagttattcctcctatctaattgtaactttgtatctgttcactaacctgtccctatcctttcttcacccatccccttcctagtttctggtaactactgttctgttttctacttttatgatgtcagcttgttttaccccttagatttcacatttgagtgacatcatatgatatttgtctttctgtgtatggcttatttcccttaacatgatagcctccagtttcatccatgttgctgcaaatgacaggagttcattcttttttatggctgagtaatattccattctgtatatatactacattttctttatccattcatctgttgttggacacttaggttgatcacatatcttggctattgtaaatagtgctgcaataaacatgggagtgcagatatctctttggcatactgatttcatttcctttagatatatatccaatagaagggttgctggattatatggtagttatatttttaattttgtgaggaaccttcctactgttttccaaaatggctgtactaatttacaatctctctaacagtgtgtaagtgttcctttttctccacatcctcactaatacttgttttcttttcttttttttttttttttgatagtagccattctaactggagtgaggtagtatctccctacggctttgatttgcatttacctgatgattagtgatgttgagtacttttttcatatctgttgccatgtgtatattttcttttgaaaagtgtctattaagcttgctcttttacctttttttttttttttttttttttggcaaagtctcactctgtcacctaggctggagtgtgatggtacgatcatggcttactgtagtcttgacctcttgcctcaagccatcatcccatttcaatctcccaagtagctgggactataggagcatgccaccacgcctggctgatttttgtagtttttgtagagaccgggtgttgccacgttgccgagactggtctcaaacacctgggcttaagcaatctacctgcctcagcttcccaaagtgctgggattgcaggcatgcacccagcttctattttttaattgagttatttggttggttggttgctgttaagttccttagctattctggatattaactccttgtcagatgtttagtttgcagatgttttctcccattcagtaggttgtctcttcactctgttaattgtcttttgctttgcaaaagctttttagtttgatgtaatcccatttgtctatttttgcttttgttgcctgtatttttgaggtcttatttaaaaaatccttgccaagcccagtgttgtgaagcattttgcctgtgttttcttctagtagagtcatagctttaggctttacatttaagtctttatttcattttgagttgatttttgtatatggtgagaggtaggggcctagtctcattcttccgcatatgaatatctgattttctcagcaccatgtattaaggagactgtccttttcctattgagtgtttttggcacatttgtaaaaagtcatttggctgtaggtgtgctaatttatttctgggttctctattctgtttcattggtctttgtgtgtgtttttatgccagtaccatgctgttttgattactataattttgtagtatattttgaagtcaggtagtgtgatgcttctttcttctttttgctcagaattgctttagctattctgggtttttttgtgatctcatatgaattttaggattttttttctatttctatgaagaatgtcattggtattttgataggaattataataaagctatagattggtttggataggatggccattttagcaatattaattctttcggttcatggacatggaatatcttttcatttatttgtgtcttcttcaatttctttcttccttgttttatagttttcattgtagagatcttttaccctgatggttatgtttattcctatatagcttattttttggtagctgttgtaaatggaattatcttcttgatttatttttcaggtagatcactattagcatatagaaatactactgattttttaatgttgatttttgtatcctgcaacattattgagcaaataatatcctagtataagtatatgccaaatgtaagacatgtttatactgaaaaattatttatggttttcctgaaactcaaatttaaccagatgtctggtaggtttaaatgctacatccagcaaccctagtacctggcgttgagtagggtgtgtagcatattgtaggagctcaataaatacttgaatgaacaagagagtgaatacaatgaaagaacacatttctttctcatgacaattttacaaagtggatcttattattttatagatatgatgagcaaataattcaataagcttgtctgtgggtccagagccagttaggacagggtgggataacagtcaaattttgaaactgctcttttcagcttttcagtacattgtgctgccttgctttgttaaatgaaatttcttccttgtagcagtcagattttttggttgtatcaacagaaaactgaaccctccctagtttaagcagaaaaagatatattcatgtgtatattaaaggatttttaggagctctgggtccctggaggccagagaaacaaaccagaggctgactggccaggactgattcccccagcgtgttgtagaactgatccaatggaaatattgatgttgccctcactgggcacagatactgcagcctgcaccattgacgtccccaatgtggaccactagaccacacagccaagcccctgacccttagggcttccagatgtagctgcatctttccttgccagtgtacatacagcttcacactatttgtcccagatatatctgattgagaacctgaaggcatatgtctccatgctagctacaagagagtctgggaaagtgaacctttggcttctaaagtcaaagctatctctgtctccctctacattcattagaaggggaatttttcaagcacaggaagtatcttaaaaggtgctgggcagcctaaaagataatacgtgtccacttgacactgcctttgagcttcagtagcgcaataccttttgattttttaaggcaggtattactttctaccttgtttgaaaacaggagttgtgtttgctttaattttttaatgtgcccacagagtactgagcctgtactctcaagaggcactcaatatatgaccgaataaaagctgaattatctgtctagtgggattttataggtgacttaaattctgttcgtgtgtatttaaaaaatttccaatcataaacatttgtaataaaaatagttaaagtttccaaaacttgatctaactgggagaaaaacaataggtctgaagtatcttatcttcaaatctgaaatccaaaattctctgaatgtcgaaggattttttttgtctgatacctcattggcagaattacctgacctgaagtgacacaaggctatttatagtcttcattgttccacttaattgaatattcatatgtttcccggcagaaatattaatgtacttgattacaaactgttgccctgatctcactggagtactatactgtatatgatctctattatctctataaaatctggaaaactctgatgttcaagactcatcagtccccaagggttttttgaagtgtgtatgcatgtgtgtatttgtgtatacacacttgcataatatgtacatagaacgttctggaagggtgcattcaaattgccagcagtgattatatcttacagaatggattagatggggagatagtgaggaatgaatttatgcttaatattctttagcatttctaattattattataaaaaacaattgcctttttaaatgaaagaagatagagtagaattgaatagaaatgttcttgtacttaggaaaatagtggtaatattaattttaaaagatggtttgtcaagtaggctatgcgtttcacattagttcaacattacaactgataaagactcagaaaaagttatacacagaatagtcagtctcctgccttttggacactatatgcatgcccaggtggcagggaatttacgtcagcaaaagcactaattttgctaaaaaaaaaaaaaatagaggcacacaaaaatgtgatgagtaaatgaaacaactgttattagtgacggatttggcatgttttacgaagtctgaatgattactcatccactgtacatttgcagaagttctttaataaaaaccagacgcatatgtagtagcaggggttagtaggtggatgggaggattaaaccctgtgcgtttctggagcattggtttgtaactgttttttggcttgtcaacaggctatttttctgagtcagcctataggatggcttcccagggtaagtctgattttgcttttctggttttaaaatataaagtggtaatggagagctgactagttgctctctgcattagattctgtaaatcaatattgcctgcatttcttctgtaagaaagacattggtcgcatttcagcatattctagtgttcctgctgctcatttttgtagctttgccttacctccccctaattttaaaagtcaaatgcccaagtgctgaaagaatttgcaaggggaattgcaaaggtcatgtgtaagttctgtggctgaagtgtggagagcagtatgattgagctgcagcccttcatgaacctttcttttcaagaggaggtttccaataaattagggtagcacactttatgtgcttgtttatgaccttaaaaatggtttagattttgctgagtggccattactgctgctttatgacatggaataatggtttcaacctgcacagtttttcatttttttcatttttgtactgaaacaatgtcatgcatcagtcaatgtgaagttcatttttttttttcttttaaagggacttgggagaatgttagacattagaataagtggctgggttctaactccagagaactttggttcttgaaaaaaaaagtgaagattctccaagccgttacaaatgagctttgtagtgatctctgatgaaatgataaaaacactgcttttcccactggaagataaatgccccttttcattaactatagtatgaggaacaaaatcatgtgattttcttttttttttttttaagtttaaccttaattactttttaaaggcagttttcattttgtgattacttttttttttcttccggtgcctagcatagttgaggattttatcttcttgtctattttaggatactctaatgaataacggaattttgacgtgctctttcaaaggaagagtctagttgcatcctcccagccatcggctggttgagctgtcctacccacttcgtttcagctcatggaggccaccgtgaggggctggggcatgtcagtggcccacagctattctgaatggtagttatatctatgtgggggctcagaagggaaccgactttccattcattaatgttcagtacccacgaaagaaaccgatatttaaaaaaaaaaaagtaagggaatttcagttgattttttgaaaaacgaaaacgttcacattaggacctttaaaaatgaaagcatttatgttctcagtgctgtggatctcacatataaataattgcaccccatccccctccccccacacccctcctccccaagtctgaaaccctgttgcaagggctgtgtgaagtgggaggttaatgtggcctctctttctgggacatcagtaattcttgaatattttgggtaagggtagaaaagtatcccatttcagctgatcagtaatttaggagcttttaaatgctgatgtaagcaagggtatattatggaatagaatctgagatgatactataaagagacatctctgttgctaagggtcagtccagaccacactcctagaccttacttctggtcctccttgcaagggtggtcatctgtcctctgctgtgagatcttctttggtagaaatgtgatggggtttgctttcaccccttctcaaaaggctgtgccaggaacacttctatgggcacaataaggtgaaccactgtgaggtttgagaaaattaattgcccggggtgagctggaacacttaatccatcgtgtcacatatacacagaggtctttgaaagggacaggagtcttgatggaaggctcagctaccatccagacattgttagaataagaagacaattgctcctttcaatgagagaaagggaagaataaaatgtgatggagattggcacctcggaaagggaagaataaaatgtggtggagattggcacctcttctgccattctttaacctccataatgacttaccaaagagctttttttaaaaaaagagatcgacaggaaaattaattatcaatgatttcagagcagattattagatatgtgaattatccagcctctttggattttgtcctgttgtcatcatttgtcagtatttctcaacatgtcatcgaaaggtgattcaggatgaagcacaaaactgtttttttctcttttttttttttttttgaaacagaatctcactctgtcacctaggctggagtgcagtgctgcgatctcagctcactgcaacctctctgccttctaggttcaagcaattcccgtgcctcacccttccgagtaactgggattacaggtacatgccaccatgcccagctaagttttgcatttttagtagagatgggggttcaccatgttggccaagctggtcttgaactcctggcctcaagggacccacccaccttggcctcccaaagtgctggaattatgggtgtgagccaccacaccaggcctctaaactgctttttactcctagttgtgtgttgccagttcagaaacttaattaagcttatggaatgacagacatatttcaccttttagtagatgagaatacattcaagactaggcttaagtacatatatcttcgatgtaatttattaaacccttaaatccatattcacacatacaaaataatcagatcttaaaataattattggaagaaagaagagggaaaaatagtaggcaatcttcatgacactttaatgtgtatgtttactgcttaaaatgttcaaacacatctttgttttgtatagttaattttggtggtataatatttgaaaaggtgatagataaaaagtgcaggatgcaattcttgaagctgtaatttgcaggacactaataatacaagtccattttcttttctgagtgtgctatttatacaatttatatttttaacaaatcttagaactggaatgaaaatagtaattcatcttaagggtaagaaaggttgcagctgtgccaaatttggaaactttaatcagtcctcttagtgcttaagcacagactatggaatattctaatttgtatgtcacagagcacagtgctcagcagaaagcatgcactatcttaaattaatgttaattaattaatgttaaatgattgagtcaatttggcagtacttcttttcgtctctgaaaagaaatcatatttaatttagaagtggcaggtcaattttaaagccaagctaaaataagtaggtcaagtgaaattgtgcacagggcagggatagtggtgttatatgtacgaagaaaaaagactgaaaggaaaaatatcaaaatgtttacctgtgaagatgatgaataatttgttttttatatatttttgtttgcctttagtttaccacagtgggcaaatacattcttcggagcagtatactttcatgacatatgttaagctttacataactctttgttaaatctcccgttgatgaattaatagtaaacatgatacctatcaaatatgaagtgagcggtgtcctctgtagttgggcagcatagtagctttgagtggaacttacattctagcaaaattcattttttcaaataagattttatgtaaaatccaagtatagtcagttctgctataacacaacatatgtgtttctaaaaaatcatcaggctactccaaaatcatgcagtagacaacacacgatgtataggaaaaatggggctaggagcacaatgctaaaaaatttcatcagtgacatctgaaaaaagaaaagataggaagctaataaacacagtagacagatttataccctttaatttaagcgatacattaatacaacaacaaacttgttactttgctttgaataacacctggattttgcttgtagaagtggcttcagaagagttgcagctggtgagttattatgcagtggtagaaggaagcttatctgaaactggatcaaaaattatagcatcagaagtgaatgagtgtgatgcataacactcttagtaaacggaggtagccggtagatgtttgaagtgtgtgcttggtgcagctgggtgcagttttcagggtgttcacctactgtttcttgaagacagaatcacgcacaagcaaaccaaaattcttgggggatatgctcaagttgtttactgtgtaacaaatttgcatttccaaaatcaacgtgatggcagaactgactgagatggatgaaaaaaagctgcactagctctaggtatgtcaggagcccagtgtggaacccaacctccccatcaccaccccaggggttccacagagcactgctgtgtggtgtaaactttattttgtttgtttgtttgtttgtgacctggaacagacacagaaagttatttttcttgtggagagtttcggtcctacctacatatccttccctggctggagtctggaggtgtgccaagggctttggcattgacaactttcagttccactgccagatgggctgtccagtaaagcaaatggccttgaactgaaaaccctatagaatacctcgctccaggtccttgccagggactataaccttgagtactcaatgagtactccgtaagtactcaatacttatgaaatgctgctatgaaaaaccaatatctatggattacagtgtgaagaacagatgttcatttgtttctctggatacccaacaacgagggaagaagggtatgttgtttgagaaatcatttccaaagtgtcaatattgaaagaaggcgtgagaaatttacatttatcaaaaggggtcattggttataaaatagttcagggaaatctgtataatctctaccagaaataatctaggccagcagaaatctctattctgagattttgatatccctgaaaatttgtgcatcctccctccacccccggcaattagttttactggattatacttaatattatgcctctgcccccattgaatctcgttacaagatagagccttacaaatctttattgtatggggtgtctgtcttgtgggtgttacaatgtcctttttatgaagactcttgggtgaagtgtctctctggtttcaataccacaaatgactgtacttctacacaactttgggtttttattttatgtatatagttagtcatgtaactgatcatgttttcttcctctttatggccacagacatattttctttgacccataccgtttttgtttgtttgtttgtttgttgtactttaagttctgggatacatgtgcagaacgtacaggtttgttacataggtatacacatgccatggtggtttgctgcacccatcaacccatcatctacattaggtatttctcctaatgctttccctctcctagtcccccgccccacgatagaccccggtgtgtgatattcccctcgctgtgtccatgtgttctcattgttcaactcccacttacgagtgataacatgtggtgtttggttttcctttcctgtgttagtttgctgagaattatggtttccagcttcatccatgtccctgcaaaggaaaacaactcatcctgttttatggctacatagtattccatggtctgtatgtgctacattttctttatccagtctattattgatggacatttgggttggttccaagtctttgttatggtgaacagtgctgcaataaacatacatgtgcatgtgtccttgtagtagaactatagtaaccaaaacagcatggtattggtaccaaaacagatatatagaacaatggaacaaaacagaggcctcagaaataatgccagacatctacaaccatctgatctttgacaaacctgacaaaaacaagcaatggggaaaggattccctatttaataaatggttttgggagaactggctagccatatgtagaaaactgaaactggaccccttccttataccttatacaaaaattaactcaagatggattaaagacttaaacataagacctaaaaccataaaaaccctagaagaaaacctaggcaataccattcaggacataggcatgggcaaagacttcatggctaaaacacaaaaagcaatggctaacaaaagctgaaattgacaaatgggatcaaattaaactaaagagcttctgcacagcaaaagaaactatcataagagtgaacaggcaacttatggaatgggagaaaatttttgcaatctatgtatctgacaaagggctaatatccagaatctacaaggaacttaaacagcttttttttttcaaacaaaaagaaaaactattttccagcattccagtgctgagacaatttcacacaagtgtgtttgaattactagcatttactgaaaaatcagatctggtaacattgaactctcatgtcactatggcaaccatgggattcaataaagtattgccattttccttaaaatagaacaggcactcttcagttttactttttttaattttacctgcctgggccctgtagatgtttaactgtaaaccctctggcttagaaagcaatttgtgacccacctctagaaaacgtgcaggcttttatttgcatttgtgtactaatcttattcctgaactcattttatttttttcttgaattatgtttccttcattctattttcttcatccacttatattaattttccatcattggttcatcttgggatgttgtgtgctttttcataaattgctttaagtccttttagaaagaagcaagaggtattaaatatataaatattaaaattaggagaatgacttctttctcccagatcattttatttttatttttggcctagtaaatttaaagtgatttcagctatttttctgacctatttttgagtctacttgattctagtaccattcagagctctgcaattctttgttttcttttcttttcttttttcttttttctttcttttttttttttttgctatttcctcacagaaactctgagaaaacatgagacattcagtacatacattgttttgtacctaaagttggttgactctctatgattttgcattaagaactgaagagttaagtaattttcacatacaatttgggatttccatatctccttgagaaatatgaagacacaactagacccagttagcctttagatgtgtttgtgtctagttcaccacatcttttccttacctcccccattgcctccatgacactgaggctgaatgctacttgtcctgttttccttgattttcttggtctgcaacccattgttggtccaccacccaagctgatcctgctgtcaaaacatgttctactctttggcaggcactgaattggcttttctttaatgtccctcttagagccgcgagcttcctcggcaggagtgtcatggctctgtgtgtgcatgtgtaggtaaaaagaacactaggttaattcattcaccaaatgtttattgagcacctactttgtggcaaggactgttctggtgctgggaatagagcagtaaataaaagaggcaaagatatgtgccctactggagtttacattctactgggagttggtaagtgctataaagaaaaataacaccaaagggctttctctttaatttgaggatgatatgttagaccttgctgcctagggcttttttttttttttaacagagatctaaattaattgagagatctaaattaaatgagatctaaattaaatgagctgtgcagctgtctggggaagagcatagcaaaccaaggggcagcaatgagagtaaaatcctgaaggagagaacatactggatttagtattagacatgacttttatttcaaatactgccttgcctaatggtgtgaactgtgaccttctggaccatgtctgggaactcatctctaaaatgctaagattctatgtagaagaaggaccatgccttactagtttctacccagtgccaagtctagtccttggctcttggtaagcatttggtaaatatttgtgcagttaacagatagacacaacaatggttttaaaagaatataaagcatcttggccagccgcagtggctcatgcctataatcccagcactttgggaggccaaggcaggtagatcacctgaggtcaggagtttgagaccagcctggtctcaacatggtgaaaccttgtctctactaaaaatacaaaaattagccaggcatgttggtgtgtgcctgtaatcccagctgctcaggaggctgagacatgagactcacttgaacccgggaggcagagtttgcagtgagccaagagtgtgccacttcactccagcctgggcaacagagtgagactctttctcaaaaaaaaaaaaaaaaaaaaggaatataatgcatctcaaaagccggatcttagctgattgtttaatacaatcccagagattaatgacaaggaagatgcctagtcctgaaatgtgtccaaggaatttctctttaatgataattccatattttctgcacttagcaagacacatctacacatcaaactggggattattatgacccaggaaagggacctgggattctttgactgtttcctcttgagggcattagtgtcactgattgggagacagtcctctaaattcagctaaatattggtcaccctctataaggacagtgggacagcgggaagcagactaagtgcaaggattgtgtcttagttgttgtatccgtttttttcccttagtgtatcccaacttctaatgtagtacccatgagctcacagtaagagctcagtacatatttggtaaagagtgaataaaatcaagggatgcattttcaagctctttcggaagacagtgttggagtcatgctggaaagacatcatacattctgcctgtttccttcctaagaaggacacactagaactagaggagattgaaaaggctgaaaagtggcgtgaaggccagacctagtggtaatgtcttatttgcataactcatttagttattatctttacttacatatggggaaatgaggtcagagctagtaagtggcagaaccaggtagtttgactccaggggttgtatttttaactccaagagtgtgttacgtacagagaaggataactagcagttacagaaacagaagtatgaaaaaaaatcattcactaaatagctgaatggattctgttagtggcattagtgactgatgatcttttctggtgaaaaatcatttctttcacatggaacaggtttcagatggagagaaaagtctactccgtaactcacacttctctggcttttttgtggactcctccaagactttgccatgtttcatttcttgagactttatatcagattttctaaaagccattggggaagcccttcataacaggaattcttattttgattcagataacacatgggtatttcctaactaccatgttcccaatcccacatgcttcatagcctaagagctctttccacatttaatgatgtgctggccacattatttcccatcagcttcaactccttcttttctatttcatgaaaaaattcttgttcatgaacgattaggttttcttctgcttattttccgtgtagatagaatgaactcagttgttacgatgctcttgcagaagaacaaatttaaagctggaagaaagctttgcgaatttataacagcagtctgttgggttcagagagaattgttggaatcctatgctttcctttcatttgtgtgcttttcaagtgaggggaacattgtgatttttgtagatggtgtcagcatagatggcagagataagcagatatcctggccagcgttctggggaagatgaaaatgcttgtgttttctcatgactttatttttccagagctgactctatggcaatatcactctgacaaatattggctggccatggaatattttaaagagcaagggttttgtgaatgttctgtctattaccatggctgaggaatcaaaacacaatattctccacacatttcctcgagcactcatggatggattccagtatgatactttcatgttagctcttagaccacaggaagaatttaaaataaatgattactgaaaacacaatgaagaagaatcgagtagaatgttttgtaccatttttctctttctgcacggtaatatcatgctcagagtggtgacaaagactaactgagtgcaaaagggctttgcaaaaatttatgttttcagatgcttgttgtgaacatgatggcaatgacaatcatgtcacatctgcttcgctcgtgatctctatccttatgtaaggaaagagcagacactgatgatgttcaaaaacaaacccaccacagacatcccaaagacttctataattttccccccttctctagaatgtacttctcacattattgtgtgattaatgagaataaattatatggtgtgagtatacaaaggaaggaatttgagagatagctttttgcactggaaattatttgggcaaagattcttctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccggggtggtctcgatctcctgacctcgtgatccgcccgcctcggcctcccaaagtgctgggattacaggcgtgagccaccgcgcccggccgggcaaagattcttctacagtacctcttgggtctatgaatgaagcaggatggcctggatgtaaattaaggatttcagttacggtgctgttttagaggagttccctttgtgatgccatgttcgtatcaggctctggtgaccaagatggtggtggcggtgatgataatgtttattatagtggctgcagtgtattcactgcttgtacttcaggttctgtgcaaagtacatgccaggcattaatctatgcattattccacaacagcctgtgaagttgagactgttcttatgctcattttgcagatgacgatactgaagcttagaaggcttgagtaatttccccctgggtgaatagctaatgagaaatgggaagagcttggaattgaggctagtactctctgaccccagagcctgggctctgatacctcatccttgctacatcctttctagaagtaggaaactcttgcctggaccatttcaggggcctgttgcctctccctactttcctcctgtttcctctttagctctttttcctagcatgtacctcaccattgaaggtccatcatccctgtttctttgcctgacttatatacctctcaatcttcaggacttctttactctggggtctctccttcgaattctcataatattttgttcttatcttaatcaaaactccatgcagtttgtggtcagctagttaagtattccagggattcctaacctgtggtctgagcagtcaatcgagttttttgtgtctatgcctgtgtgaattttctctgaagtctgtagttttcatatgaatctcagaaaagtatttgaccaaaaagatcaaggtgtttattgtttataggatcccccaccctcccataagtaataagctcccagaggaaaggagcatatcatatttatgtttatttccctagatggatataataggataatatttttggagtgttcagatgaatgaatgtagttactagttagacaatgaggtgatatagcctgtggcttaagaacataggatctagattccaactgtgccttgggttgaattccttctttgcaaaccgtttggcaagtgatacagtctcttaaagtctcattctccttattggtaaaagggatactaaaataatattaaaggtagaaggttgttattgaagattaaaataaggtaatgcatataaaatgcttagcttgggaatacatagcataccttccataattagctgctattattattacttaagaaccttttgaaaggggccaaacaatgaggttctcatgattttcctagtgactattgcagagaaacaaaaacctgcaaaggaaagattgtttgcatgctgcttttgagtcttaaagacttagaaccgatgtgctgtcattaactatggtgccaggtgcaaggcagctacctccttaaaatgtttttcttgggcatttccattccctgtggccttgaccctggatagacagtggctcaggctccccagacaggcacccagaatgccagctaatggaaattttgtgatagtctgcccctgaggatttggacatatgttgttttgtgtctaaatcaacagaaataagtgcagctgtagttaccccctctgcataatcatctaagtagcctgtttctttgcatgctcatggagcccccaagtgctgggcccatcacttgccacccactctgtgcattgcaaatgagtacagtaggtcagataaaaggcagaggctggttgggcatcattgctgacttacacagcaatgatgaatagttacacatagatcaagacataaaagttatttataatagtctggtcaccagggtcacattggcaagaaggaacctttggaaaggtgctttggttggatacttctgaactctggctcattaatgtgtaccaaatatagaaaagttagtttaaaatctctttacagaaaatatattatgagctggattttattgacataggaatactgacttatacttttcctataggtttctttaaagtatgtaccatttctttttattattggtaattgtgaccttggctcagtcatttgcaaattttctttttttggtatatcttaaaaatggatagcaccttttattcataattaccccaaactggaaacagcctgaatgtccttatactagtgaaaggataaacaagctgtggtttatccatacaatagaatactaattagcgatagaaaggaacaagctaccgatacctgtagcaatgtggatgaaggtcaaatgcacttgctaagggacaaaaaacagactcaaaagcctgaatgctatatgattccatttatatgacatcctggaaaaggcaaaacatagaaacagaaaactgataggtggtttctgggattggagatgggggctgttttgactacaaaggagtagcacaagagagtattttgaggtgatggaactgttctgtatcttgattgtgctggtggtgacatggctctgtgcatctcaaaactcgaacggaaggtgaattttagtgtatctaaataaaagtaaaagaataaaaaaggagatgaaaacatttacccaatatgctcacatgctcacaaagaaatgttgctttgaaaaggccgatatatgtaatttaaatttcataaatttaatttaaacctcacaaatatttattggtgagctgctataatgcagtgctttatgggaaatcctaaaggaaatactgatccatgcactcagtaatgtaaccatctctttcggcaaacatatacaaacaattttagggtgattttaagattataattatattatgggacattagaggagaaagaggcatctagatgggatcaaggaagattgttaagaaagtgaagaaggtttgtcaaggaatagtcttaaagaataggtagatttttaaagtatttttagtaaacttttaactgaaatataatattcccacagaaaagtatacacatcttacatgcactgcctgaggaattttcaccagatagctagcacccaatctctaagatagagcatcactagcacccttgtgcctcctcctagtcaacccctcttctaagtataatcactatcctgacttctaacaccatggattaatcatgtctgggttttatttaacttcatacaaatgaaatcatacagcatgtactctcatatctggattctttcgcttaacattatgtatgtgagatttatcccttgtttgtatgtagcagtagttcattctcataggatattccattgtatgattacatcaccatttatccattccactgttgatgggaatttggtttgcctagagttctgcactattatgagcagtgttgcaatgaacattattgctatatgctttttggtgaacacacatataaatttatctggtttgggttaagaaatggaattactaggttatgaggcatgcacatgttcagcttttggtagatactgcaaaccattttccaaaagtctttctgtgaatttacaccttcaggagcagcatctgagtgtgccatttgctctgttcttcaccaacatttggtaatacatctccctttcattttactgaagaatacgtagtgtttttttgatagggatggtgagtgcatgaagagtagtactccaggcaagagaacaccccaagcaagagtgtacagctagagttagagaataagttgtttatattggtttgaatcattacaatagataagtccagaaggataagttggtgcttgattgctagtctaaataaaacattaaaaaaaaattcattcattgtatagtgatgaaccattaattttgtgaccatagttgcctgaaaacagcaaaatcgtgctttaggaagtgttatctagtagtaggtgtataatattttgggggaagttgtcagaacaacctagtagtccaggccagagtttcaccatgtcagaatatctgtgagaacagagatggtggttgatagataagatgtgataagcatctgttcggtagagggttaaggggaaggaagagtaagagatacctctgaccctggtggtaccttagccaattatgccaaaattcactattatccttcttaatgtctttaaagagtagtttatacttgccgtatccatttctttacttccctatatggcttattttttaactttttcattactaacaatattcaatattattattattaaatatatcatacatatagaaagcaatacctgtccgtttagtaaagaccaataaaatgaataaccatgtgcccaccatccatcttaaaaaatagaaccctctggaagcctcatctttgaggcattctcctctttactccctacctagttaaccatcatcctttttgttctaatcactcctttgcttttcattacacttttagaatcgttgactacatcactaaactatgctttgaactttaaataaatggggtcataaggcaagattctatgtgacttcttttttcattccacatctgtcttgattttatccatgtaaaggcatatcactcatgtttactgatgtgtagtgatgcattgtgttaatattattcctcagtttattgatctctttcgtctttttttttttttttttgacaaagtctcactctgtcgcccaggctggagtgcagtggtgtgatctcagctcactgcaaccttcgcctcccatgttcaagtgactctcctgccagtagctgggattacaggtgcacgccaccacgcctggctaatttttgtatttttagtagagacagagtttcaccgtattggtcaggctggtctcgaactcctgacctcgtgatcctcccgcctcagcctcccaaagtgctgggattacaggcgtgagccaccgagcccagctgatcacttccctcttaatcattaatccctggacccactgaccctaatattgtggcatatgtgatagactgaagtaaatcatgtattgtgtcccatagacttaaaactttttgttaataatttaatgtttacaatgaggtggaactacagttgtccttggtatccttgggggattggtttcaggactcctttggataccaaaatccatgggtgctcaagtgtctgatttaaaatggtgtagtattttcatatatcttatgtacatccttacatatactttaaatcacctgcagattagttctaatacctggtacaacataaatgccatgtaagtagttgttatactatattgagtttttatttgtgttattttttattgttgcattgtttttatttgtttgctttttaatattattgatccatggttggcagaatgtgtggatgtggagcttatggatacagaggggctgactgtattttgtcttctgtatgaaagaggtgcttattgtacaatagagttttccaatctgggcaatattgacctttgcagccagatattctttcttgtgaaggccatactgtgcattgtaggatgtttaacagcatccctggcctctactcactagatgccagtagcacttgtttctctgtttgcaaaaaccaaaaatgtctctagacctgtcaaatgtcccatggggacaaaattgtcccttgttgaggattactcctctaaagtattaaaattcagtgaaaaggcagtgagttaccatgactgactggagagaatcacagaagttaccttcctcttagtacttccctgctgccccatcccagccctaggttggtgactgtgaacagtggtatttttcttttgtcttttggtagttgacttttactggtcctggagaccagccccctcatgttgtaagcatgttatcagttttaccccccgccccccagggactacttttctgctctcatggtctacattctgcctacgtgtgactctctttgccctaaacccctcctaatccagaggcagtctttataagtccaagggagatgatcatgctcattgcattgcatttaaaaattgcttccatttcccataagcaaaaaaaaaaaaaaaaaaacacttaaagaaaaaaaagtacatatctttttgaaattgtcagtttaaaaatctataataataaatacatgttaataaagaagttaaataccaatgagttacaagatttatatatttgaaatacacattttatagtattattgatactttgatattaatttaagcttaagagttatagaaaatgctaaaatgatagggccttttgacctctgaaatgaaaatttaaaacatttaaagtatatttagttagcacacagctctcccgtaactttgtgtaatgattttttttttcaagtacaacacaaaacctgctcacgaatcccaaagcattataaagctggctccatctagtgtatgaagtactatatagctaatactgggggaaaaattgtactaggaatctcttttggtacttcattatgaaattagataacaaccaaaacaaaaatggactgtaagctaaatttatgttccaggagataacacaggccagagtgaccttcacagcattagaggagaggtctttatatatcgaagcatcaacctgtagcatgcctgacattttgttctgacagccttgattttttttgttttgttttgttttcccctgggctagaggtcttatttacaggcactatcaacaaacgcagcatgtaacttccatggtgatattctcagtcctacttggccagcttcccactttttctgtatggaatcatatctgagagtcatgctcatttcccacagttagtgagagattggggctgggctcacttactgtgatttcagaaccctacatggttttctttatcagactgaaattctttgtagctattagcctctcaccacaatagagtgggccactctatcggggctgtgtttaatctcgtttccactgaaagtttctagcacattctttatatctctcaatcaatgtttcctaaattttagctattctcatgctaacttcattacttttgcttgcaaaaaccacatggaactttaaatattacatgttttaaaggaaatgttatcatacatggaagccacgaatggaaataggtattaaaatcaatataatgaaattgaaagaaaattgttagattcttgctaggtatattgtctggaccggcaggtgtctgaggtctgacctgtattgtgaacaaagggcaagtgttgagagattgaagacatattagcatcaaacagagactttccttagatggaagaaatttgaaagggcccttctcactgtgtgattccatgcttagttaatgtgaagtctgtacatctctatttgagatcatcttgtatcccacactttgggaacttttgctcaagatttaccatgtttctcaaaggaagcctatcattctcccccaaatttccaaagaccttgtttcccctagaaagcctttttgaaaaattatttccttttttgagaactttcttcttctattaagaagtataaattgtgttgatatgttgggttactttttttttcttccttgtaatctcatattttcttagtctcttttctaactagattaaattatttgaggacaaacattgtttctttctagtaaatgccattaattgaattcatgcttggtataatattcagggaagtctgcttcattctctgtttttttgtgtgtgttttttgttctgttttgtttttgttttttttaagtcagatcatcgttagaggtggccaagagaagccattatggtcaattaattaatcatttaacctattggtgaatagttattgagtgccttctctgtgtctggaattgtatgtggtgaaagaatgaagtagtgacctaaacagacatggttcatgcctttatggaattcagaatctagtgtggggtacagacaagtaaagaggcaactccagtgcaaggttctaattttagaattagtttgcttttgtgttcattgggtagattacaaaaacttggaacagagaaccatagagaggaaagtgtgggctctggagtttcaaactccagacctgtggcacattaacctcttgattttgcacaggatactcatatctcaatccctgccccccccagtttctttctttaaataaaaaagatttgtttaataataaacatggggtatgatatgcaaatatgagatacagttatcagtgtgacaatatgataaacaattctccatgtctcttctctcctccttcctcttttttcacataaggcagagacgtgatctcatggtttttttttttcaaattttcatgtttctttcccaacacgctaataaatgaaaatgcagtgatctagatcaagtataggaactaaacatgtttgttaatgggaatatcattgtagatggtgtttaaaggttgcaaatgcattcaattttcacattgtctgtttaaattaataaataatttgagcattcagcattaccccagaacatttttctcttaataatcatgatatatcagttatgcatcttaagcctattgaacagtgcctgggacataggaggtgctcaataaatatttgtttagtggatgaatggattttaataattttgactcttccttcttttattcatgattttgttaacatcttttaaaaatgaaccaatattgtttgatattaggagcaagataagcttaaattatggtttatattattctctatatctgtattaccagccttacctgttatatctggcaggtaattaatatgtagtaaatgttaaggggagaatttagtagtttttttaggcattatttttttaagaacacatgacaatattttaagtaaggatttaatttgtcttttatattatttcatggtaatattcattggaattacagactattaatttaaaatattggttatttgaatattttactatcaacattaatatacactttgattataggtaagactccctagagtgtcaattagatgcagaaagctaatgtgcattgagtttattatgattgattagagtttattatgattaatcaacagacaggaaggatttttgtgcaaatattatttttctcattttaaatcctgtttgctcagcataactgtaacaggatgtcattagtatgagagtaagttttgagatgctttaaaagtttgagaaatttgactgttagcaaaaatttaacataaggtgatttatttagcataaagaggtttgattttttatagttttacttatttaaatacacgacttcctgtgtgactcctgggtatgtttacatagaaaaaatataaacaaaaattatgattgacacactgaatcagagcagaaggtttcctggactagaatttggtttgtagctaagacaaccactgaaaagacagagtttgttgtctactatcagaagttacagataccatcaatatttagtctttagttatgcactatgaatatattattcacagatttatctatacctttcctgaacttacatgtattttgaatctggactacctcttaagatatcaaaattcaaaactaccttaagcattgtctccaaataataacttttatttgccctagaatttaaagttctttgaggctctaagggctgacttttcattacctaacaatgttttgaaatagagtcctcgctccttgtgtcaccttgattgagtgctatttttcttgtaccatgttaagtacttttcatactttatctcattcaatcatagtattaatctatgaaataggtagtattaatattcccatcttatagatgcagatcttgagactcataagtcgaatgccttacccagagtaaaactaggatacgaagggtggtgtgtgtgtctgcattgaatcaccacactatcctgtctccagttggaaaaatggtgccatgtttatatccataggagtgacacatttattaaatagcagacctctcagaagtttgcttcccacaggttgaaaccactgccctggatccttaccacatcttatacaaattggaggttttgcacaccagtgacttccataccaccttccacaatggcatcgttgtctgcaagaaacagtgtctctctaccttctgctcactctttggaatacaaacatttaatttatatgaatagactataaaatctagatggcagaatatccctgtcttctttatctcagtcccttcttctggctcctccttggaccagaatggatttagatggtccatggaactgctgatgtcctgggatctcctaatgagatggaatcaagggaagggtgggttcatctcagcggctgtgagcttagccaaggtggtccatggaggccacttctacagctgaattgcatgttgctttaaaatattataataccttgactcctgcttggaagaagaaagaaactgatgttgtagatgaagatgatggtgatgcactctcctgtttcaatccacaacacccctaaaagataggcagagacattcatattcttattgtccttcaatatttcataacttaaaaaaagttactaacagtaaaatatatgtccacatttttctttttaaatgagtaaagagttaacccataaattgagataaaaacaccatgattttcaggtgctgatgtggagattttatttattgtaaagtcatcttgtgaataactttgtcccccacactgatgacggccttatcttttcctgtttacttaccttgataagatagtaaattgcatttttactaaatttctcatttaaaaatattatcaaagcagcataatctcatcagtgtgttctctccaactttgtgttgtctcacctactctgtttatattctagattgtagttttcttattgcaaatactggttgccatttatagataacaaagaaaagcctctacataacctttaatgcaggaacaagtatttattttgagatgaacactgagagaatatcaaagagtttaaggtaagggattaatccgtggtattgattattatattaaagagtcatgctaatgttttatatatttttgtttgttaattgcttaaaaattcactttaggctgggcgcggtggctcacgcctgtaatcccagcactttgggaggccgaggcgggcggatcacgaggtcgggagatcgagaccacggtgaaaccccccgtgtctactaaaaatacaaaaaaaattagccgggcgcagtggcgggcgcctgtagtcccagctattcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaattcactttagacagaatttgagatgcctctttgtagactatatttttatcctctggacagattctttgaaacagtttttaaaaacatttaatttttccttctggatgtttgtataaatatcttaaccattctttaataatgttgggctgcatcccaatcaggtttatgtggggtcatcttagtctcttctttatttcccttttcaaccttgaagggcttccttggtttccggggacaatgagctgtctttgagaggatgctgtaatatcactgttacaggcagatctgttcttggtaggagaaaaaaatagaaacaggatgaaagagataaacgtgagtgagtgctactgcacagttatttctgcaagtaggtagtcattaaaaattttcttcagtcatgctgtgatggtttcaaattagagccgctggaccagttccttgcaaatttgtaccccaatactttctgcatgaaagtgagttgtgctcagccactaaaagcttgcaaataaagagtacacagttgtatatcccatttatgactattgactttcttcataattaattaaatgctaccctcaaattatacttcatagatccttccttatctgaccttttttcatttttgtcagtcattcatgcattcttctttccttctatccatctatccagcaaatatttaaatacttactatgtgccaggcactgagaaaaaggtaagtacaaggaacctgcccttaagaacacaggacaaatagataaataaaaggattacaagttgaattaagtgctataaaagaaagaagcttgcttcaagagcacaaaacaaaaggagatgtttcttctttaggaaggatggtctgggaagacctctctgaggaagaaatataagacctgcaaaacatcatctgccaggtcaggaggcgccaggccagggaaggagttgcagaggagagagaagagggctctagcattctgtcctccctgtaccctcttcccattggcatgtgagtgtgagtcttgggtttctctggagtgaacgcctggaaagcagagcctcttgcatcttcatccttgtcttccccatggcgctgagaacagtgcctctcacacacatgctgggaaaactaataaatgtttggattgaagggcctttcggtggcatgtgacttttcccagaatgtgagtgtgaggccatctggacaaaagagatgtgtgtgttactcttgagagtactttgtgagtttcattattactttgatgaaactctttaattaccccacaataaggctttcattgaacattccacatggatattttaaagaattaaaatgtatgagtaacttctttattcaataaataaaaggagcttccattcttgagtattttcctgccactcttaacagaccatttacatagataatattatatatagctatatatattataatgttatattatatattagtggtttctagacttgacttcactttagacccctatgagaatcattttttagaaacacagaattctaaaccatacccctgcagaatctcactcactcatttgtttggggaaagatccttgaactttatacttcttaaatctcctgtatttattttaaggaggtggggtaaggagaaggctcctcaagtgcttctgataggaagacaggttggggaaccattggctgggatcataatgaaacattccaagaccaagtagatgcttcttaaattgtgtgtagttcatgggccaacataggacccagcacatagtaagctctcaagtgttaactgttgtggggctattgagtagaagtatgagtttactggaaagaaaaatgactatcaaaagaaagaatataagaaaatatggtgtgctcgggctgggcaataaaacatttaatgcctaaataaaataagaagaattttgagctatgataaaacagtagcattacttttcttcagctaagtcttggacaggataacaagtaaaatcccttatctcttttctaacctgttcaaagcagtgattgaatttttccttccaaaaagattctgaaacccagtttagcttccaaggaaaaagttggctgtcacttggatggttgattactttaaatcccattttagttaaggttcagcttttaaagggtcagtaagaattctgatgactgtagttgatttgctgcaatttagggcaaagagtagtacttattattgcagaagcactggagtactggtgatgtttttattctgcattttgtgcttagtttttctgatattattttttcctccccaaccacactacaaattcttagtctgtgtttaaacttaggatttgggtatctctctctatctctctttccctctgtgtgtgtgtgtgtgtgttcatatgcatatacatatatgtatacaaactcaggaaacacatctgaatagtacagatgtgcccaagacagttgcttacatattacgttgattcattttaaagatattcatcaagccatggactgtttattctgctgagttctagggatacaacattaaaccaaacggacatggttcttgatatccagaagacatgtgttcgttaatttgggtgatgacttgaggagcagtattttagtgctgggaaatgcacgtaacatctcatgaattttgtatatggtggcctgtgttcatatttaagccaagctttggtccatttgctagtggacgtttcattgctgtatccaagaaggttcccttagaactgtactgtaaggtagatctttctaaagtactggtgtaaattgtcaatagaaatatttcttgaggcggtggattgtccaacataaaaagtcaggtgatgttactggctgaacctgccaggggaatatttggcaccacattatgtccccttcgggaagggctggaattgataccattggtttcgtgatcaatatttgagaactcatggagggtacagattttccctgtgtgtgagcatgtaataaatcagagtttcagttctaagatgtacccgagtgccttgtaggtttactcagctttaaatagtgcctaaggtgagagagaaaatctggcttgaacttttatttattttatttcattaaaatttatttttaagagatggggtctccattgcctgggctggtcttgaactcctggtcttaagcaaacctcccacttcagcctcccaagtagctaggattacaggcatctgccaccgtccctggcttgattttttagaaaattatcccttaaagtttctgatatggttattccctatcctttctttatttcttgctcttccactttcttgatttttcatttgtttttttcactctgtctcatttctcttagttctctagattggtcaatattaatacaggacaggtagcactaaccatgattataattgtaagagcttttttaaaaattgagcgtttattatgcatcagagacaatgctgaacacattacttgtcatctctttcagttctaacaataacctatgggtagtcacttatttctcctttctcaggtgaaagaactggggcccagaaagtttagaaaatttgtacaaagtcatagaattagtaagtggtgagatttgaacctggataaataaacgtcagaatctatgttcttgattttcatgccaaactgtgctagaggcaggaaaagagaggtgggataggttagtaagataaatagtgtaacatcttagtcatctgtttaccccaatacctggtacagtacctggcatgtagaaagtgctcaatgactgctgttgatgaactttctcctctaatcgtatttattggtccttagttttacgagcaatctgcccacttttctccactttgcacatctgcccttcccatgagctaccatcacctcctaccaggactattgcagtagctaactctgacagttttctagttggctgtcaacatagcaaccagagagacctttctaaaaactcaaatctgagctcatcgttcccctgcttgccatctctctgtggtttcttgttcatcttgaaacagaatcagtgacctttccctggcctaccagatccttcatggtctggtcctggtcactgtgtaggtctcacgggcaccatgtttttccttcatactatgtccttcagtgatagtgagtctgcctgccaacttcccacctcatagttcttacatatgttgttactgctgcctggaaagcattttttctatactcctcctctccccaactcagatctcagaccagaagtccctgcctaaggaaagcctttcctgacccttaaattttaactttttcacctctctgcagcagttatgacatttttcattacatatttatgtgattatttaatatgtgtttcccattagactgtaaactccacgaatttacacaatgcctgggacacagttggtgttccataaatatttattgaacaaaagaaagaaagaatgaataaaatgagcagagaataaacagaaccagaaatagtttggccgagactcctggctagatatttcctagcattagagggaagttaaaaaaaaagataatttcattatatcacgtaatttgagtttgattatggctgaagaggttgcattattttccaaccatttactttggagataaatgtaggcacagagaggtgaagtaacttgcccagtgtatgcagctagtcagtgtcagatgtctttgttatgacctttgaattgtgtgtagggagaaacatacatacaatattttcacaactctgtagggcatctttggtgtgctgagtcctgtaggagctgcatgaatatttgataatattgatgttgtcatgtctgcattttaaagtgttttttgagaacatgtattgctgttttttcttcttgtataccaatgtgttcagaattagattggatgacagtcttaagaatacacagtttatggcctaacgatttgtgtgtcctgaaagatggtggccataattaggagcagtttgtgttttacttccaccagaaccgggcaaggacaaccctcctaatattcttggggtctgagggtaaggaatgctgttttggatctctagcctgtcagcaaggagggcatattcaattatcaagctccaaaaatgcctgtgcacagatgcaaaacacctagagttgtgtgatgagttgatgcccgagagctcccaaactgagaggggacacaagcagttccacagtcctccctcctagattctgtgactccagtaagtgttgacaattcactggtatgtgaaattacctctccttttaagttctctaataatgtgcagtctctgcaagcctcagccagtaccggagctgggtaaggctaaataagcttcccgaggtgcttgcctggctgctgggctgcctccctggccgtgcctgggtccttgagtagccctcattgtggtgtgaggcagcgtttttgtcctgcaggtacagtaggtactggattaaacaggtctgctgttgcagacagaaaccaggcaccgttctagcacagagctgtgtttggattggagtttccagggccttatcaggagccacccctagtgacacagccagtgccagaactaactttgactttcactcttcgccaagggcttgcagaacaccttaaaggaaaaaagatggaggcgcttagagttcagatgttcatgccatgctcctttgaaagcttgtatctgtaagtgaagttttattctggaaataatcccgggaccacttaagaggagcagttttttttctctttaagggggaggataaaggaagagaagggtttattgggagttaaaaatactgaagctgttacttctcactggctttaatcagcttcagctgtaacctctggtaggtggctatgacaaggataacaactaatttgggggtgggggtgggggtggtagatagaaatgctaacccaatatccttgccctctcctttaaaattgaatactggtcttaagttaataatgacaaaaataccgcgactgcttgaaaaatctgagttagagcagagcttgatttatgattgcaagatagactgcagcccagctttgttatgaataaaacaggattttcttcaggaaaactgtgtgtttaatacagtagtaacatttgtccaaactctcccattgtaaacactgtgaatttttggtttctccccccaccttttttttttttttttcctgactgtggaatggtaacagttgcattaatgaacatcttctttgcattcttgtatattgatttttttctcttggaaggggaaacagacatccaaacatcagaattgtctgcctggcatataaatgtagaacaagtttaaaaaatggcaatttcaaagaaatattaaaatggagaaaaactaaacagagtatagttccccccacatcctttaacatttactttcactgttaggtgataagatttgaaaacagtgctaaaagctgtgtccccaagtgaataggcattcaagcaaatcaacttatgcaaaagctacctctggagcttaatcattatttactgaacgttcctgggtcatgggagaggttctgattaagtcagaaaggcattatgttcagcagcttgtgaaggtgtgtttaaagacagcaagaataatggaaaaatactagatgtagcagatctatttttagaatttgattcttaaaaaatataaatataattaccataagtttaagtgtgggttaaagttcatcattttcagtagatacatctttaaaaggtcttataaaaggtagttttaaaaatgatttctaacttcttgagcttctatttctgctgcagtttgttttaacagatactttagatttttttcattctttatgtcgtcataacagcttaattactcacctctataaaatgttagagcattttctaaacaaagtatatataattatgtgtttaaaatgtcactatgctagaaatgttataaatttttgccttattaatgagatactagctggggagatgatgtctactctttgtgattcattctctacaaaaatatactctaacttactaattttttaatattaataatggatggcatgaacaaatgaaacttgctattctgattctacgtaagaatggtagtaatgtcaaacctgaattcacagccaaattaattcttaattttgaatttcattcttttagttaactaaaatacttgtcgtaagagcatgcttcccttatacactctcagaatgaaattcttcacaaacacgtttgacaaaacttgttcactgagttattgcccattaacttttctgtgcgtattcttttaggagagcacacactgtgaattaattgttttgtattttcctctaggaaagaaaaggaacatgatagcagaaggcagcattctagaattttggctccctagaaagtaacttgtcagctttgactcgtttttagatattaagatgttcagcagataccatttcaggaattaaaacacagactagaagaattcattgcctaacttttactcatgtccacatggtttgtgggaactatgctaagtattgtgcttgtattaacacatttaattttcacaactgctctatgaagaagatatgtctttccacccccattttgcagctgagaaaactgaggcttggataggtgaaaaaccatgcccaagtgatacagctaagaaatgacagggctaggaatttgacccagggatcctggctccagggcttaatgctattatctgttgtggtctgtggattttcacttaagatactaaatgaatcaatatttcttcctctgcttttttatctagtgggtttctcctatccctagatttctgaattaccaaactgtaactcatttgagctcttgaggggccgtgtttggtcctgatgccacggttttcgtctaccaggtgtatttccctgagtccagttcaccattgattataagacagctattggctgggcgcggtggctcacgcctgtaatcccagcactttgggaggacaaggcaggtggatcatgaggtcaggagttcaagaccagcctggccaacatgatgaaatcccgtctctactaaaaatacaaaaattagccaggcatggtgtcccgggcctataaacccagctactatggaggctgagaaaggagaattgcttgaacctgggaggtggaggttgcagtaagccaagatcgcaccactgcactccagcctgggagacagaggcaagactccatctcaaaaaaaaaaaaaaaagacagctatttggtggagaaagaaacttactaaaatatattcattgattatatgatctcttctgacttgggaaatcttaacatgtggagggaaagttcctcttagaattaaggaactgtcgtagatccctagagcccagagttctccgtctctggatgattcaagcaaatggtttgaataagggtgcaccaactctaaggttctagtattattagattctatgaggtagaatatttgttgggagacagacaccaactttactcactgaacaaatatttattttgttctactatgtgctggagagacaatatgtgaataaaacatgtaaacatctctgccctcctggagcagattggaccaggtcatgaaggaccaagcacataccagtttcatccctgagtctggccctcattctcatggttcaggatggcttctgaagctccagccagtgcagccagattacaggagacatggtggcagaaggtttagagaaggggatcatttgaaggagattttctgtagctgattctgatactcagccatgtttggaaatgaatactaaaacattcaagatcacctgtttgtttagtaggcgagctgggacatgagcccacatacatctctcattcttaagccaggacactttcctccatgtctgacaaaattcacattctcttccccacctctagtcagcctggccagaggtctgaaaagcccttctgatactgaattcagtgttttggatggaatcaaatgagaaggactactcactcctgccaaatgggctatgaaaccaccccaaaacatctatccataaactgcccatggctttttgtgggtacagcacaactgctttgtcataaacaaaaggaaccgataggctgaatctataggaactgcctccccctcaggaggtactatgagatgggtcgtatgaagctcctcctgctcgtatgactcacttcacaatacctctcaccccatgtccttctccagctgaggatcccacaatctcctaagatgtaaactttaagttatgttgaaatggagtcttacgtagaactccagaaaacagtttcggtggtgttcttggggttgtcttagaagactcttgaggatctttgttctttcctatttttcttcacctagaaccaccatggagatgtatatatttgatctttaatttatattatgctatagtacagttgccgtagtcagttgtatttgaattaataaaaaaaacaggcaaaaaaaaaaaagccagtctgtttcatcacaaaaaggaattcttaagaatgttttgaaagtgccaccaactgcacaaatcagagttggtaaatggatacacacacacacacacacacacgtgtgtgtgtttatatatatacacatacatatatacatgtatatatacacacatacatgtgtgtatatatgtatgtgtgtgtatatatacgtgtgtgtgtatatatatgtgtataaatatatgtgtatatatatatgtgtgtgtatatatatatatatatttttttttttttgagacggaatctcgctctgtcaccaggctggagtgcagtggcgggatatccgctcactgcaaccttcacctcctgggttcaagtgattctcctgcctcagcctcttaagtagctgggactacaggcgtgtaccaccatgcctagctaaattttgtattgttagtagagacggggtttcaccatgttggccaggatggtctccatctcttgatctcgtgatccacccacctggatatatatatttttaaatggcagtctgggtgtctaacatttcagagtgattggcacttctgttatctacttaaatctaattggcgaaacttagcatgtagccagtccagctctggagacctgggagatgttgtgggtgggagtgtgcctagccaaaacaaagagaaaataggaaaatagatgggtgctaggttttatgaattgtaggtcttaggctgaaactttgactttttccccagtattactgatattttttaaatgttacaaaaccagctgtagtatcccagggtacatcaaactggcttaagaaaaaatggagtttgattggccctcgtgaagtccttgtccagggttagtccagggctatcatgacttcaggaatgatttgatacaggtgctcaatgtcatataaacactggctccctctttctttgttattccttctcattagtcctctgttctttctttactgtttcctccagtttggctttcttctcggatagatccaggaagttccagatttacatcctaccagcttttcaaaccttagtttaaagagactcattttaacctaatagtttcagttgaaggaatagggataacccttacttgattgtcttggggcacaagcacattcctgagttagtctttgtgaccagaaggatggatttcctgattggccagggtcgtacttccatgtctggaggtagtgacaacaccataacctcatgaactgaaagtgaaggaggctggttattcaaggttaaatcaggtactttaccaaacaagtgggacaggatgctgggcagctataaatgccatgtggccaccataaatcattactgctatgtgtaaggttgcctgttaaaccatgacaggtgtacccattcactgctccttagattacagtttgtacttttgtctttatttcaacacaatgttggaaactttgcatcttggttgacgtgtgctagacatgcagtaattgttaagtgatggtggtctaaggcttttgaattttctctgatctgttataatgtctagaaaaacagccagagcatgccctgtgattggaacaattatttgagtacaaacagaagggctttctacctttaaaaagtttattccagttcctttcacactcatgtctgaattctgtcattagtttgtcattgtgttagatttttaaaaattgctttttcttttaaaatactctcagtggagcatcttgccatgccgtattaattactttaagggatgaatttctcaaagccctttaaaacatggcagttagatgtgaatgggattccacagttggacagagtaagcaagaattctagagtacagtctagtgaaaggaagcttgatatgaaaaacagaaaacttgagtgtggggcacttcaactttatctgcttcataacctttcaatggtttggctctcagaggcgatttccttgaaaggaattgagtgttaagattgtgccaacccataatggcatctgtggaaaatggagatcagtcgtggtcataaaatgaggaaatggcaaagttcatatccttagtttaaaatatcttttagtaagaacttgatattcctcttagttggagtatacataagtgagacacactttggtaaaaaaaaaataaccaacttaaaaaaaatctgctgatgaaaattgcctggaagagcattgttcgtatgttacagaggtctctaaacatttttgatccttcttcctagttaatttctttcaagaaaaccttctcaacacattttcatttgatttataagttatgtacatgtgcaactatactattatataacatgtacaaaaataaaaaatgaaagtgataatataaaatatatatgaagaaatgttttaattttttcttcctgcacccaggttgtcatttttggtatggatttttggagaatactgatatattgggaaacttattaaggttctccttgatttttatctaatcagtcattgagattagtctttcctggtacctgttgaaggtccagcttaaaaaaaatgtggagaatcctgaatggatatgaaacatcttccatttttagcagcgaattgaggtctcagcattagaaagaaaagacttcagattttaagttgtgtgtgattggtggttcttaatttttagaatgcttttctccctatgtactgtgaaatgtacaaagctctggagataggagcattgtccagttgcgacaccatgatatcctgcatgtctagcagcacctagcttttggaaagcatttgcgtggggcatgaggctatgttttgtaagcctttgtattttagctatgccagagacctggagtatttattatctgagctgctcatgttacccccaaaaaggtggaatcttggcagatctccattctttttcttgatgactaaaacccaagttaggtgttgacagaagtccagaagatctcagtgtgaagccgaactatgatatctggtactttcacatttacatgggttacactcccagctattttaagtacgagggatgatatagtttcttattagtatttttttccaccatgcatggtgaaaaactcatcctgaatcactttggaaggaatggaaagtttgagataacagaagtgccattcactctgaaatgttagacacccagactaccatttaaaaaaaatatagccatttaccaactcttatttgtgcagttggtggcacttccaatagattgttaagaatttctttttgctggtggaacggactggttgggggcagttcttgtagattcaacctatcagttcctttcatttatgataaagcagttgtgctgtacccataaagggccgttggaagtttctggatagatgtttttgtttggtctcatagcctatttggcaggagtaaagtagtctttctccttgtgtcccatccaacatgttgcattcagtatcagaaggactcttcagacctctgggaaggctgattggaggtgagaaatggaatgcgaattttctcagacatggaagaaagtattctggtctaagaattagaggtatgggttcatgttccagctctcctactatgcagacaagtgatcctgggtattttactattagtttccaaacatcggaatcagtcaagtgtcagaattggctgcagaatttttgtggacatattgattcctgggccttacctaaacaaatcagaatttccaggaatgaggctggacatttttatttgagatgaagttctcagcgaattttgtttttctcagctagccttttgcattttgaaacccctgtagcttaacccatacatgacataggtttctcctttgcccaggaggttaacactattgaaccttcctgtgtcttcactgtgtatatgaatatccaccactgtgcctcctggacataaataaattgtacatcagtgcaaacaaatactaggctttgagctctgtcaaccaaatgactatgatgaagattattttttactgaataaaaatgctacaattcctactttatagctcatgagagatttgcagaataaattatcttctctctccatccctgaaaaagttttttgagttctctcatttaaatggacattggctaaactttacaagacatatcttctgtggtccaaacttgcacataggcatataaaaagtagattccttgtatccaaaagaagaagcatgctcatggtttaatattattatttttaccactaatttttgaactgtattccagtttattggaccatgtttcagtcattgtgctaagtttttctatctattaaaaattttaatcctcaccacagtgctgagaggcagatgtattgcgaagcacagagatagactaactgggccacagtcacaagttaccgcacagcccagctgaactctgcctgaggagtggactaaaggaaacgcaaggaaaagtagaacattgctttagcgtctctaggtttctactgatgaccagagtactgtcttagaggactgtgatattgagaccaaagaccagtccctatgagatagtaaaagaacactggcatcatgtcaaaggtgaggggtgggcagacagatgtttggatgctggagcattgaatttaatggaatttctgatattgttaggtggctgacaaagatagaataaagtattgggatttagcaaaacgtcagatagttcagagcccatgtccaaaatacctataccatcacagagaagagggaggctttgaaggttaagaatgtaaattctgccatagaggtaggaactcaggtcacatttggtggccatctggtgtctgtatacctccagccactgtgctgaacactttaatttagtgaacattaactgacccaatccctgcagcacattaaaatgctgggttttggaaaagcccagagaggtcaagtggctcattaaagctcatgcagctcggcagtgactgagctagcccttgagtccaatcggtggccctcctcctcgagccattgctgacaaattcccagttctcaggggagttgtgtgcctggcttcagtgatgccgatacatgccagtaaaggcatttgtctctctgcccatcggctttcaaagggagctttctgatggtgagatgcccaccttcccatgtgggacttgatcagagttccgtagtctaggtaactgacttaattttaaggcgtctcagaagaattatgtgactgtggctttaaactctatgagattagaaaccaggtattcccagcacctggcaataactatttgttgaataaatgacctttacataatctgattaaaaggaatcagactcatggaattaggattatctagcgaagattcagcttcatggcctgggatgagttcagttagcttttaaaattaaatacatttggacatctctccttgtgtatcattagtagcttcagcatcacgtcctcgttttaaaaaataagcattgttgccacttgtaatgttctcacataaacctcaatttggagcttaagacattatgctcatttgtcctgctaacattgtgacatgcagatatccttgtttttgtctagaaggtgataattgcagattcagttacttctaagagaaagggatgtttagaagattgagagcaaagctgagaatctgggagtcatctttcacaatgtggaaatatcccgcagggagtgtgtgccatgaggcgactctaatgcttcctttgcacttttgggtttttttgcaggaagatttattaaaacactgtcaattaactgagctgtgctatatttatataactataaaaatatatttgctctattttttagtggggtttcttttcacttatactggtctacttcatacatacgtatttttttttcagacaggatatttcagaaaatgctttgaatgatattgttgtcgactttcacgtatgaagacttagtgcagttgataactagaaattttaatttaagatgtcttaagaatgctttactgttaattgaaaggatttcttcccccagtatcacagccaatgactcgtcttgagcagctaattagtgcgattattccacagctgcatttgctacagcacaaaggtttgcttctgtttttatcaaaaggatcagtctctctgggaatgttttaacctgacaggctttgaatagtaaggccgcttatttatttatttattttaaaataactgttccccccgcgcttccccccgccacccgccatgcccctcatcacagctctccttcttttcttggcttaggaaggtacatttgagctttgaacacatactctaaaatgggaaaatacatttttaaatgctcttttagtagagctgtatcaagtgaatagattattttaagtgagttagaataatggccaagtgcccttaatatgtggatgagtgcatgatattaaataatatgcaaggtattaatgctgttcgatttgtatgtgtctgtagaaaatgtaggaaaacatgaaggaaagagggtttgtgttttctggaatgctgagcacttccaagtttgccaatgtactggatatattcaccactttcccatcgtattgtcaaagtgttgtctatgttggattctgtcccctttcttctagccaaatggtgattttgatcactcaagtccttttttcatggtcttaaattagtgtctagaggcatatattctgccattgaaaaaatactatgacttctttatagttgaggggagtaaaatgatagaaagataaatttacctgtagttctattctcaccctggcaactatcgtgatctttggacattccctactaatcattttgcatacttggatacatgcatataccacacttatttcaaattagaatgtaaatatacttttgaatcctacttttaaattccctcttgttacatacatttcccactttgttctgtagttgcacaatttaaaaaaataggtagtattttattgaattcatatatgataatgtatttaaccattctcatagtatgggacaaattttttattattcatatattttgcaatttgtaaagagctttgtaatatcagtttttgcacatttaagttatttacttaggaaaattgtccatcacaacatttctgaatcaaattgtatgaacaatttttagctttttggtagtgttgttaagctgttttaatatataccagcaatggtgtagagtaacattattcttatgctttttgttgtcatagacagtttgtttattaaaaaaaaaaaaaaaccttggatcttaccttaaatactattttgtatctggcttttctaagttctttgtattgtgtagttttattcacatcagtaactatatttttacactagttttaatggttgcatcatgttacattttgattctctgacaatatactgagccaatttcctgttgtgaaaataagcgaactgttaaattgttattgtgtagtttttctgggatagcgtgagggtaaaaccaatacttcttcatcccctagcatgttttgttaccttcagagcctgaaggttcctgtctttaaggagctcatgaggatggtcaatgatatttaaggcttcattttgccttttattagaaggtaaaagataataccagagtttatattcaaggaaggaagttcaaagtacaaatacttacctcgaagcatgactttctcaagagtgaatattttctcaaatgttccttttcttctgttccaggtgctaaggttttgaaccgttgacctaaacacagacgttaaaaaatatatatagagagagaaataaacaatgaaacattttctacctataataatagtgacagcaaacatttgttgagccagtactacatggtactcattgtactagggcatttatgtgccttgttttatttaatcccccaaaatccctaggaagtagggctttaaaatatacatgatgctatagaaattttaaaagaacagctcccacctttataaatggtaagtgggtaaaaaactattgttatccttcttttccggatactaagacagagagagatttaataacttgatgtcatagagctggcaagataagttatcagaaaccatatttaggaaaattaggaagttttttctttttaatttgtgagtagggtttcagaattttaaactattttgggtagagtgagtaccaaaaccattagaagtagtcctcatggggaatgcacagagaacacattgtaacatagtagagggcatgccaaggtgaatcagaagaaaagacagcacaaagaaaaccagacagagaagtattggcttgtcagaccagctcgtcttctgcccccttacccaaagagcgaggtcgagttcagtgttaacattctggcccaaatgcttccttcattaattatttttacttattttatcttagaaaaatttcctcttggcaaagctcaccttttctttaatcaatatttgttagtaaacattttaggcatcttcaaagaacttagataacatgtaggagtagttatttggttagattcagttatacaaaaaagcaaatcaagcaatttatttttaaatgtggaaatttgggtgccattaagatgctttgcttcttggcagtgcatatggtggcgctatatttggtggtgatgagtagtgtgcagcataaaatgtaaaaaaaaaaaaattaaaaaaattaagccgcctgataaaaatgccttgatgcaatcaagctgacttattttaattcaactactaatgacttaaatcctgtcacctcttgattttcaattatgtggagtaccattctgtgacttgattatatttgcgcagactcattttatagtttggtgcaatttaggatacccccaaagtgcaaacgaagggtctcattaggaaactaaatgttgtatgcattttggttttcccacagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtacgtgagtgttgctcttgttggttggaccaaactctcttccattttccatttgctaggtgttttgtttatctgaatatgtattttgttagactgacccttcagaattatatttgaaaactccaactcccttaattcttacgtggctttatattttaaaagaaggatgcaaacgcattgtaactgtaatagtaacaatcagtaaatggtgggagtcaatgttccatgagaaattgcaagtaggaatacatgtttgttgtgatgacatctttctttgggaaagtttcaaaaccagaattatctgaggtgggcctcttctgataatttgtgtatcttaaatatttttctcttaaataccttccatagccactctttacttttctttttatttagtatgtaatattggttgtaaaatctgactgttttagagagctcttcacatataagattgaagaagagctttctgcgctttgataaccagactacataatccttttactgaagtgagttgtctgctttgggtctctttgatttcttgctagagtagaaactgcaggagcttgttagcatcattcgattagggacatatagcttcctaattactaaggaaaattgtaacaagtctaagaatagaattccatctcacacgtgtcttccacatcacatagggagatactccttgtttaagaataaacatttcagttcttaaatatgactgattcaaggaaagttaaaaggaaagtagaggaacttccttatttttagtttttttattttagtacctgctcacctaattctgaaaagtctcaagtgttactgttcattaaacaatgtgaactttacagaccggtgattcattattggtttttgcattcatccatgtgcacagaaaaaatgtctcccattatttaaagtttactattaaagtaaatagagagatgatgtgttataatcaggaatcaatctgtgaaccttaccaggaagtaggaaagagattctttaaaaaacaaatcaagagtcaattattttttatttgcgaagacttaaaatatagtgatgcaataatggaactcggatgaagaaaccaactgaaattgggttagggaaaaaagatacaaatagtttagcataaagttttactctaatgtgattgtttgaaattctggatattgccacagttaatggattttttcctctttctttttttacccgtcagttaactcaaggttttctctctggagtagatgatgcattgaatctttctgttctgcttgggtgaaaattgatatgatcactaagtttttatagatttaagaattatttaagatttatgttgttgtctcatgcctgcaggggtgataatcattgtgtataccttaggttatttaaaattgtatgaattaaatagtaacaagatgtggagaaatatgtctattttattcatcataatagttcacctttataatctgtagggcaaattttagaagagttgccatggatttgggctactagtgggttatatccaactgaaggtaatgttaaagaatttttattaaaatcaatattcctgttaaggcagctacaacagagaggaaattacccaaatgaaaatgtgttgaaacatcatttccagattatcttaaaagtgagcataatttctaaatgcttttgtcactgtaaatatattatttttgaaaatgattaaagttaaaatctacattaagttgtttgaataacataccaatatttttatatgttgctgtgtcctggtgacactggattgagctacaacccctaacttatgtatgccagaaaaatgtccaaagttaaagcacaaataaattgttacagctggacgacatactctaactaaaaataagtattaggtaaatttctctttcactctgaatatagttcctgtctatttaacttctgcttttttatatttcagttatataaactagtaaactatgtcatataaataaaaataaggaattattgccatagctatatggttaggtttgatagctatttagacaaattttggtattcttaaatgaagaaacaaataagaatacacgattttattaagacaatattttaagaaaatcagataacatttttaaagagaatatcatataagtgattgcttcagatacttaaagacttaggacttcataaatatagttggcttattttcaaaattttgtgtataaaagtattatgaaacattatagaaagataagtgagagaaaggtggttttttttttcttttttatagtttttaaatcataagcataattttgtgaagtaagtggttaatagcaaaacagttaatatgcttaatcttggaccatttatttctccatgaatatatattttcaaagaatggtaataccaagtatactaattgagtgcattatgatacagattatattgaataaatattttctcatagtatggcctgagtaaattcgcttaatttttaaaggtttaacttgctaaaacagaacatgcctgcttctcagtggaggtagatgtatacaattagtcacacttgcatgcactagagaatctggttaaatctctccgtctcccaagttgtttgtaagaaccagagggaagaaaggtcatagtttagttttcatacacacacaaagttaagttaccaacattctgctatctggatgaatgactgatttcaaaaagctaaagcagtgttttcaggttaatccctttttttggcagagtaaaatttaaaatatgaagctttataaagcatgtttaaaagttattgacatctggtaaacttaggactagtcagattttgggttagagatcgaaaatctgcaccactcattcctcaacgtatagtcattgtgccgtgagtaagttcatgaatctttgtaagattagcctctggtttctatattgatttaataatatatgaattttccttcatattgattttcatttttggggacatggaatcatgagtcttattgctatatatttacatagtaaagatattctccaagttttttaagaacaaccttacccaattgggtattgtaatttaaggatgctcttttaccataaattaaccaacacctggagtgcataatgcatttttttgtaatggtgaacacaccctgtattttgagttgtgaattaacaacaacaaaaaaaaagtcatcaagaaccattaatggaatcagtttcttccacaagtgggttttgctgacatgcaagtcatgcaaacctgaagtttgaaatttgatgtagcttttttcaaacaaaaacagagtaacgggacagaactgtaggtgagttcagccttatagctaaagcatcacggtacaaaccaccaagttaatcatttatgtagtcaccaagcatctgttttcatagttttgtctctctgactttgatgaattataaaagcactggtcgctctcatcctggactaagttcatcaggatttcttcccctactaccttcccaagatgggctttgacggttgaaagcttgaaaacattagtttacagtttgaaaatgtttctctgttcagaaatctgaagggagttgccaaggattccccactacctctgtctctccctcccttcctttcaccttgaaatttaaaattttaaaggcaaagtcgaagtgtcttctctggaacggattgtcccttgaatttttctgttctgcttaagggaaaggttgcatgaattttaaaaggaaaagattttttttattactttggggcatttcttaactactttgaaggaatttatttttaaattttcccttttctccaaatcatctcaagagttgcgcaaattgctctgtaattagtgatgatgcttgctgtttgtcaaatacagaagcactttttctgggaccttctacattgtaaactaaatttacgtgggcatttatttggtggttatctcgtcaaagttgcctctcatttgtattgagattctagcgaggtgggctggaagccctgctccttgttaccctctttcaaaaactgacattccatatttcactagtgaggggaagggttaatggctgaactactggtctttctctgtaaattatgaaatctgcatggagtagaattttcaaggtgtgatttattttttaggtataacacagaacatgaaaatgtgtgtggagttacaggtggattggtgggctacagattggcaaaagggacttctcccacaacctacccttagattttgtttctggtttatttagccaggaatacagaccctaaatagcatcatggtggctgcaagaagccagaacagatgtagtgtgtctcagatcagcttgcctttgtcccctcagttaggggatctgttgctagaggtgtcactctcataaggtgaagacctgctatgtctaagatttcttcttatagcatagtccattcacacatggaccagcatatacttatgacccttgtagtttgacttacacaaacaacctgtcagccttgatttcagggatcatttataaacattgttgtccttttgtttttgaatcaatgttggtgtctgcaaggctacatcctcattcagggggagaaagggactcagatttcaggtcaacagacagctcttcattctcccagaaacctcatttccctgcagaatctgaatcattcagtgtcacacataaggtaattttctctctctttaaaactcacgttattgactttttaaattgcagataatacttgttaacttttaacagatttaaacaatgcagcagaatagttcaatatgaatctcaccctgcctaccaccgcctcccttccgtcatgttccctggaaggaacgactgttaacagtttaggatgcagccttcctgttattttctgtttaataaccctaccatcagttgccttttataggagcgaggtctgaagaaatatgttagtcactttttatcaggtagacataaaccctttatttttctttgttcatatttgcaaatggaacaaaaaaatgtataatttattttccttctgggttgtctctatctttaagaatcccgcttcaaggtccactcttccctatgtgcagtgaggacttctcaccctgtgtcttgagagcagtttaattggttcaatgtgtaagtatgtaccagcttgcacggcactgagtggcagcccctttgcttcccaggctgctttatgaacacttgggggtgaggatttagtgatctctgggctgacacaagaaagtgctccatagagttgtcttacttggtaaagtcaaacttaacacaggctcagtagtgcaagaattgcaataagtgcaagaatcacagtaagtgcttttggattcatgttggacttggtttttctgtctgcactgcttttagtgactagtagctagtaatgaaatgctggctgcagaaagtcatcttcgcttaaatttttaggttttatctacttaaaagagcagaccgatgagaccaactatctgaaacaaaatattcagcctttacacaactaagcctatgaattaatcccagtttctggaaacattggaacttcagctctaattacatgttcattgggcaatattggcacagaatggaaatgatttctccctttatgaccacaagggcattttcatgtaactgaggggtacagcacaatctgggttttgtacagcacaatctgggtttgatttcatcaggttgtggatagggcctgatgtacctggtggacacttgactagtagctagtaatgaaatgctggcagatacgcaacatggcgctctctctttaagtaggagaatctttgccatcttctccatgagcccctttgcaatcactgaattcatcctgtgggtttcaaagagaagagacacctgtttggctcctcctcgttttctcctgttagaggaggctatactaataggtgcagtctcctttcatttacacagttctcataattccatactgccagaggtgaaggcagtatcataaggaaaatattaaggtctggggcctggaagtgagggctaaaaactggagtgggcctagtgtcatctgactctgaatggtaatttcttttttaatgtcatgagaccagtagaacgtgcatcctcaacaggggcgaagtcactccccacaagtaggacaaaaatggattgttggagggcaaaagagtcttagatgttacaatggtttctaaacctccaaagtcccagtacataaaccgataaacagtatatgtgtcttttaaaattttatggtgatggggatgaaggagaagcaattaggggaaaaatgtcttaaaaggctttttattgggatactaatgaataaaagattgagaaacattcctgcagaggaaccagcatctttcccaattctttgtgttttgtttagggaccatttgtggaggctcctatagatgtgatgcctatattctgtctggtctgtgtctccccaggaaaactgttatgagaacaatcatgatcagcaagtgccagcattgaactttacctgtattgactcatttaatgccaccattgctctgtgaggtagttattattagcatccccatttcacagatgcaggaactgtcacagaggggtcaactaggtcatcagaaagtcacccaagtaggtggtgcagtcaggatttgaactcatatagttgaactccatgggccactagtggtaatacctctcctggagggaatgacctgagaaacattaggagggagagatagcaatgttcagcctctcaaatgacacggtagcttggggcttgtagcaaatgtttactacagagcttcaatccatagcttaaacttttataggaattactgatgtgaacgtgacactacctgaagcaccttggaggaggaaaggcaattgtgcctccttgacaacgtggatattaattatagggtggattggatggtgggatgaacacttcaggtcttttagctcatttattattttagtaaccttaggaaacaagtaggataagccttattttccagatagggaaactgaggcttagattatcactgatccctggttacatagactccacacactaccttatttgcttataagcacacatcctactgtaaggacatgctctaaacatttctaaagaatcaccagtaacagaatatattagagcaaaatgggaggtcaaagagaaactacagaggagtctcacaggcttaacagaaagatacatgagcttaagcatttgaattagtaaggggcttccctattgaatagttaaaatatcctcatgagtctccacaatatgccagatgaaagaactggatgtgtttttattatataaaaaagacttcctggccacattgacccccgtggtaatttatgctttattgatagtcatcattatgggttaaaaagcactacagtgaaagtttctataacaacatccaaaaatcataactcaagtcacttatattctaaagatcttgatggtccatgctattacaattcatatgctttatagttctgagtatttactaatatatttgcattgttttagatgatttttgaaataattcagtagactcacacacttttgatatcaattttcttctgaaattatgtttgcatttttggtttttcctttcccatgcaccttgcaatattagagctcttgccatattttagcacttaacaactggaacttcatttctggtggtttttctatttgcttttaagtaaatgtcagtggtaataaatcttctattactatattgaaaaagtcatgagtctccttcacaaatattacctatttaatcccaacaattaaagaaaggacttagctttgaaagaccacttaatttgaaagactcttcagttagcacgcttttgaacagagattgtgaacatgtgtaagcaaaatctaattttaactttgctctactaaaatcggtgggtgtgatctgtgttaaaaatatgtaaatcagtacagtggcttcactcaaggttataactgcaatcagtactagaatattggctcttgccctgaatgtgtctccttttattgacttctttgaggatcagcttgaacttaaaaaaacatttagctccagataatataccagttattcagatcttatttataaatttagatgttttttgtttagtaatttataactttatgaaaaggaaatgaatccgaattggagcatatgaatcaggtaaagcagggggctgttaaaggagagaatggtcctaaaaaagaaattgttttaattactctttttaaaaatagggaatgtcctagaaaagggtataggtgaatctataccattgtttctaccagctgtctctggagtgagtattgggattggaagcggtggtggtcaaaggctttatcattattattatgatttttactaggagagcatatgcatgcattctttatgtaaagtgatgtcctgatgcattttatttgagtcacccacaactttttgaggagcacagttcttctgtcaggtgtaaactcaccagtttactagacttagacacattatgtaactctagtggtctttcctagaagaaagataacaaggtgtaggaatcctgcaaattcaaagtgagcaaaaggatttcaatcacccggtcgggaagtaatttttaaaagtagttaagaggcccaaaatgaaaagcaaaattcagacttctattaccttactaccatgcataactctgttgtaatctcccctgttgggcctgggttttgtataattaaaatttaggggctggaaattttgttgagccttaattggaagtgacaaaccagagacattcctgccagttaggaaaggcttaagaaattcttattggctaaattacaaatatgtaacattttttctgaacactgcatggtagttcagactgcctaaaggtgacaagattagctctgtttttctagtgaagtagtaaaaattagattaataagtaccaggcaaagaaccttttctttttttctttttttttttttcttttgaaagaaatcttaccttgagtacttctggctgtggagatcggtgccttaattagccacatgttctttttacctcctgggaaataagtacgggataaaattggggatcaagccgtagacgtacattgacttagcacacgccgctaagtaattcatcaaggaatgttggtaattagtcctgcctctttcaactcttggcttattttataaaaccggttgatttaaaataatgcctgctgatttattacccacacgtttcaagactggtacttggctcttaaacaaaagcaatattgtgcagcgatggaaatgcgccctcttgtttttgtgtttttacaaattctgaagggccatctatggcccccctattaactttgttgcctttccttttgccccattcagcattttactgggctttcttttctgtcttggtgaagagaaaaggggaacaaatttaaaacaaaaaacgaaaaaatccaggctcttagagatttgggatgtgaggtgcttgtcaaagtgtattggctcggtgtgatttgatggaatttaatttgaatccttcgtctggtaagacaggctgtagtaatagcctttggttttttttttttttttttttttttttgcattgttaaatgtttggtgatatttatggcagccaggctaatcttaaaagaatgaatttatgagaagcacagaacctcatgacttcagcctcttacccttagtatccaagcactgtagtgcattatagtttgaatgccagattcccattaatgctaactgatggacctcattatgctttgagatgagaccttaatcagggtccctgttgaaaatctacgattaggctgtctttgattcataactctgtgaacttgggcacatttcctgttctctctgggtctcagtgtcctcatctataaaatggaggtaataatactcgccctggggagtttttgcgagagttaaatgagataattcacgaaagcagtgctgtctgatagaatatgaaccaagtacataaattcaaagtttctagtactctcactaaaaatagtaaaaaaaaaaaaaaaatagtgaaactaattttaatgtattttatttaacccaaaatatctaaaatatcacttcaacatgtaatcagtataaaaattattaacaagatattttcacattttttcctaagtctttgtgctgcctttaaaattgcatgtatattttatacctccagcacatccccaatttggacactaaattttcatcagaaaatttatttgacctgtgtttagattttataaaatgtataattgaaaaagttagattcatatacctaacttgtttcaaacgtattcaaaagatttccaataaataaattgaatatgtctttagatttaaattaaattatatgaaaagttcagtctgaatgagtctgaacaagccacatttccagtgctcagcagccacacgtggtctttgcattggacagcacagaactaaggcattagccaagtagatggaaagtgctcaggaaaggattctgctctactgttggtaataataaatcacataatgatttacaattattaatcacacgaatataaaaattattatcttctctaagttgccatcttcatatgccactattgtacctacaaagtattactgttttcctactgcccgccacaaagaaaacacaaaaaaattagtcattattttcttgctcattatttggagcccatgttagctgacatatcttatgtatggttgatatttcctgtcaaaaacagcctcttataggagaaagcagcaacgagtcacccttggtaacatggcattttgactcatctctgccaatagccttccattcagacttgagcatggtgacagccctcaacttgttagccacacatcttactcatactctcaatccaggttcttttcaaacctacacatatcacacttacatagcacctgtccggtgtgttaaagatgtctaaagtcttgcgaatatatgagcatttaatcaatgttcttggtgtgagacagacattaggggacaaggagattagttaatcatacattgttctttaccatacattacatagattgattaacatgaaggatattgaaaactaggtttttttggtggggttttatgtatgatttttatttgtgctgatgtctctaaggcaattttctttcttagttaacttgcggtatatttttaggaaattatagcacagctcataatgcaatgaaacagttctttagtaattcattagataaccaagttttctgttttgatagtaattttcaaccgcttattaaaccagaaataatacctaagtgataatttatattttgttagtcaccttttcattcctaatgcaaacaatgagtcaattatattggaattagtaaactgtgttagagagatttaatgtgttcttcatataatactaagagcctataaagtcacattcttgtgcaattacaaaaagcaagaaagccaagggagcaaaaatgttaaccatgctatgacctccagaaagaaaaatcatcacgttgtcagatttcatgatttccttagtttggagttagatctattttctgagtctgtattaatctcaatattttcttattatcttccattaacataagttaataaactttcaggccattgcaaagttgatttcagttttccagtagctttccaggtttgttttaaaatcacatacctaaataatttttcaactaatgaattagaagaatcttgatagagctcataatacaatgttatgaatatgggcaattgtgaccatttttattgacacctgggactcccaatgtctcatagagagggaagacaaattgaacattctgacaagacatttaattttgatataaaatctctgttcatcagtttgacatgaagctaagatgtttagaacttaacctcaaatggtggaaagcattgtgtaactcaggggttctcaaagtgtgctctggaacctgtagccactgcgtcccctgcgacctcgttagaaatacagattccctgtgcctatcccaggcctactgaaccagaaactctgtgggtggagctcattaatctgtgttttaaccagccttctgaaagattctaaagtatgctcatgtttgagaatcactgctgtagaaacctggaggttaatttgtaagaaatgtaagaaaaattagaaaatgcagaggcaaataaagtcaaataaatttctttactgtagagcctctgagatcctttaacatgtaaagagttatggcaaatctccaacagtggtacagtgggcaagcactttgagaagaaaggggaggagtaagacaggcaaaggaaatgttgccttgagttgctcagtggaagatgcaaaatacctaatagctatttagggtatcttgtacatgtggtacattctattatgtgcatatatttatgaaaagtttataaaaataggttaattctgtcaagtcttgaggaggtgaattgaggataagaaaacaataagaaactctaaaatgacttgctttagcactgggcctttccaggaactctgagggtcagtgaatccatttgtccacaaatatttgtaaattaaatatgtatgtcacatatgtaccattcatctcttttactaataaatgtagatgctgctatgataaagtacaaattgatatcagagctctatgtttcattttttttcttatttttaggcattttcctgatcaacaaaaaccaaagcacaactcgtaatcaaatagggccttgaaatatttgacttttaaaaatgattgaaagctacttaaaaatattattttttgttttttagactttattttttagagcagctttaggttcacagctaaattgaccggaagataaggagatagccatttatccctgcccatgcatattcacagcttctaaccccagagtggtacatttgctgcagtcagggaacctagattgacatatcattatcacccaaagtccaaactttatgttagtgttcactcttggttttgtgcattccatgaatttgggaaaatgtgtaatgacatgtatccaccatgatagtatcatagacagtatttttactgccataaaaatggtctgtgccctgctttggttgctcctctgaagaaaaaagccacttttcttcaggaactgtgttttagctatcaagagttatttaaattctacttttagaagctactctttttacaaaattggatttagataaatggtagcacaaaatggccctttcagagtctgcagacccctgacatctgtaattcccccagcagtaggcccttcatggtctgtctctgacatcaaaggtctttctactgacgtggctgtagtcttggctttgtcttttacactggggcattgacatcaagagaaagtgtttttcttcctttctcctttctttttttgtattggttttctgcctgaaggcagtatatccagtgcatgtggccatcctgccctttctgttgaaataaaacaaacggtcattttaagaagctccatgggaaagatcaactctttctgatgctggagtccttaacatgcacgtccagcacgatgaccaagtacagccttaggtgagatctggctcatatatagccatgaagtgcacttttcttccaccagatgatactgattgccttctcaccttcttacctccctttcatagttatagtccacctagtaagagaagaaaaggagaaatcaccataagatatcccctgaggacttctgcactggatcgtgaaccttgtttcctagacctacttttcttttctgttagggtttgcatttttcaattaaaattcattcaaagaactcctgcccagaggcatttgattatgcctacacctgctatctagttgcagtgttgaaaggcatgggctctggagttagatcgggcgatatccatatgttttctcaacctgaattcccttgtttgcataacagagataataaaggtccctagctcataagcttgctctgaggagtaagtgacatgatgcttgcaaagcacttagcacggtgccaggcgcaatactttttaatgctgatcactgtcatcagcatttcaaccagagacacacagtccacagtaattgagccacataatgggttcttgagaagtgactagaaggttaatgctttggtaaaagattaggaaagttgattctacctatgatctagaattaatttctctagagatgcatgggatgtgtaaagattcttttaatcaattactgttgaattacattgcagcagcaaggaattttaattcttaaaaactacctggctatgtagattcctctaacagtaatttttgggggataaggagtagtgagatgcttggccacagtttttaactttcccccaaattacacccactacataaaagacttatatgttgtttttaatgattgacagccaaattaggcagctgttaaatccttacttatagaaaattctgtggaaagtggtaaaaattggggttaaagtttcaagaaaaattaatagacatcaggctatcaaaatgtttcttgattctgaaattaaactttcacttataagctgagaagccaacaattttggttctagaatacaggttacataggagtgaccatatatgattttattaactgttcacttttgaaagccttattattttggggaaacttgaaggttcaaaatacatttaatcacagcctttcgcccctaagccacagggcctacattgcagaaccagtcaactgatgaaaacaagtgatctgtgttcagagtgttttcattgctaatcaagttgcataatcatttttatctagtctctaagtgttttgattcatttgctttggaattactcgacttcttccttacatgatatgtccatttaattttattggactgcgctgtgctggctgggcacagtggctcacgcctgtaaccccagtgctttgggaggccgaggtgggtggatcacctgaggtcaggagttcgagaccagcctgaccaacatgctgaaaacccgtctctactaaaagtatgaaaattagccaggcttggtggcgggcacctgtaatccctgctactggggaggctgagaaaggagaatcccttgaacccaggaggcagaggttgcagtgagccaagatcatgccattgcaccccagcctgagcaacaagagtgaaaaaaaaaaaaaaagactactgtgctatcctaactcctccactccaatctctgtaatttatggtacaagtttaatttttttattcatttgtttatattttttaccttttagaaacatgtcaccttgactgttctgtagtcagttctaactacttgctgacctttatttttgctattaaaccatttatcttccattacatagactatcttcagataagaccagaggccattctctccaaccagtcttgcaaagttcactacttcacaattgatactgcaaccatgaaatcaaacatgcctctgcatggacccctagtatgacccaggggaagttgtctttctgggtgtaggtctccccatctgagtcgtctcagacttccctcctagcctggactttcagtgaattatctcctttttcctggagaatcgcccacctacagaccactgaagtttcatttgtgataagatgaaggtgacaaaggactttaaaagccttgaaagaaacattaggtttattttaagtgttagatacataaaacagttgtaatgataaagaacagcagtgtatataatacttacagttccactatagtttaagtcaccagtttctccttgagggtggcaacaggtgagttgagaaaagcctcttttttagatacgctattattttgtctaagtgtgttttgccaattataataataatgttaatcctggttatcacttactgcattcctgagacttttctgaaggtcttttgcgtagagattgagcacagacttattcagaatagatggcgaggttgtcaactaaactgccacgagtttatttacacaaatgtcctaaagtctatattaaatatttagttctcaagtatgctaaatccctaatattaaaatttatctctgacacaatttttggtcacaggatgttctatagctcttattttctttcccttatgaagcagaaaacaaataaaggctatggatgcttttttatgttcagtcagtgggtataggacaggtgaagggggatttacaatgtgactcacttctataaatattttgctcactttccttcagtttatatattaatactaattttaattcattccttaagagagaattgtggagtgtttgtgtgtgtgtgtgtgtgtgtgtgtgtgtgtgtgtgtgtgtatgtgtgtgttttgacaatttttctcttaaagcctttccattttcactgatctttcaacttttcctcttttccatccttggagaatacctctatagatgctaacaccccccttcccctatttacctccctccctcgctcactcctttcctccccctctctttctccttcctgccttcccttgaatcctagctctgtcctttgataaacttgggcaagtgacttagtctaaaccttagtttccacatctgttgcactgtgtttctttaacatgaaaacctcccatgttgttggcaaataagacagtcatgtcagtataacatgaaaatccttttggttcatttcccacagcatattaatgcttgaagtagtcaaagacaagttttatcatatttaaagagaaagtcttagccctagataaagcattacttggctttccacagggctctgctctctggagaagttgagaatacagaggcagcagctgcagagacaatactgtctgtgctaacacaggacattcataaagaaggctgtctctgggatcagattttaattttttgaaaaaggatcaacattagaagcatctatacttgttatccgtggtctaccttttgagagaggaagcaggagccccagtgtttaaggctgtctgggatgctagctgcagaatccagtagaaatttaaccagctgatgctgaattagggtttactgattgttgttattcgtgctccggttataaaggtgcataggttttgagggatctgcccccaatcttcttttttcttaatatgccctgctattcataggtgtgatttttgcagaacgtgatgttttccaggactgtagaaatggagttagagcataaacacctgaaccaacctcagagctgtaattaaatgaattcatgtatgtaagtacctagcacagcccctgagctggttggctttgattggagtcttgaaggacaagtaggaaagggcttaatcagtatcagctagtactgttgaacccttcaaacattgcagttcagcctcagaaggtgagggacgtatccctgtagtggtttgtgttgagtggaaacttgaataacaagtagggttatacccaaaagactaggatgagggggcatggcacatggagagaaatgaagcaacaatacatactctggattttggtgtgaagcagtgaaatgcaaggtagcagaaggtaggactaggagggtattgggaactgaagctagatggatgagcaggggccaggagcttgggtctgatgcagtcaggattgggtagccatcaacagcgtgtcttcattttccttttaggaaagaagaaggtggttaaggtggacttctatgggagctggtggagatggtggcgttggttttggaggaatgcagttggaggtggggaggcgatcaaaatgatttggggaatgagtgatgaaagtgttggctccagaagacgtaagaagaaagcactggttaaagaaaattaaggagtaaagtatatggaaccttgccagacagaaggaagaaggcataatactataatgctttacagagaagaaaaactgaacatagtagagcttaagaaattggtctatattgggagttgacaaacaatgtccatgggccaaatcctgctaccatcttttttggtaaagttttattagaatacagtcatgctgatttattttcatagggtctttggttcctttcacactacaatgacagatttaagtagtacaacagagaccttgcgcccacaaagctgaaaataattatcctctggacatttatagagaaagtttgctgactgctgatctgtgtgtatagctagtaagtagacctgggattcaaatcttcgagagttgggatcatatctcttttgctcacttctgtatcctgggcattttgcattgtgtctaacatatagtaagccctcataaattaacatttattgaattaacctacaaatgaatgaatgaattaataaaatcacaaagtcaagtctacctgagtcacagcttgtgctagtcattattattctgtactgattcttacaaagatgttgaatgggagttgatatacaaaacaaatatatttattgagtgccaacaatatataaggcatgttcttcgttttaggatacagtgaaaaacagattttcatgtgcccttgtggaactcactgctaacagggaagacacatgttaattaaataatcacagaaatgcatgcacagtttcagcctcaacaggtaccagacaggagaggggcacagagttttgagagctgccaatgggaagatgtgatgtaaagagtccaagaagtctttcccctgttcacctgtcttgtgatctgaagagtgagtgaactttagtttaaaagggatgtgggatgagtatttcaggcagcaagcactgcatgtgcaaaggacctgtgtcaggagagagcaggcaagaaacaaagagaaggttggtcttgctggaggagcaacagcaaaggggatcatggtaaggactgaggctggagagataggcatggggtcttgtgatcaagatagtgaagtcagtctgcttctagagccaagtctaaactagagctgcaagtttgggactcagtaatagagtaagtattgtagttaaagaagagtattgtacacaccagagagagggctgtgagagaagatgtgatccttgagaagtactctggaacatgccagtaggacagagagggagaacctatgaagcagccagtaggacagagggggagaacttatgaagcaatgtaaaaacacaggaacaaagcttggagaaccaggatggtaaaggttttgaaatggaaggttatggcatgcatgtctaggattgaaaagtgtctattgggttggtcttttgtgtgatcactgtgaccttggaaagaacaggtttgggagagtggaggggaatggctggagctggtaatttgttgaatgaatgggaagaggaaatggaaacaagcatttattcattcatttacccaacaagtagttattgaacatctttgtattagggatctaatggtgagtgaaaacacataagatccttgttctcctggggcttactgttaagtagagaggtgggtacttagtcaaacaatctccctaccaccacccaaaaagatgtatgaacactaaaggctacagtaattgctgtaaaggaaagaaagaaagttttgtaggaatatgtagcagagaacgggggaagtgtttgggccgggaagagttctccaactaagtgatcttggagctgaaggaagcataggtgtgagctttgtgaaagctgtggtgagagaaaatttcagcaggtggagaaaagcagatgctgagaccctgcagtgtcagagagctagaagctccaggaaataagaagtgaggtccagagtggttatgtgtgaagagcagtgatgagaattgtgcactacaaggctaaaaggtgggcaggggccaggggcctagggtttaagctcccaggacttaatccttaagaccatctaaaggattattgtctttattttaagagcaatgggaagccatggaaaggcatgggaagccatggaaaggtataggctaggggagccacacctgggttttaaggagtgtagtctgctctttgcagagacagcgtaaacctgttagacctttctgaaccaacatgggtacatggcacggagaaggattctcatctcagggggttatcattccctcttctgagtgtggagtcatctaagctcttcagaaaacctccagctcagatataacttatgcctgccttggcagaagaacatgaaggtttctcctaaaacccacttggaaaaaattcttttttccaagtctccaagaagacttggagaatgtcttctaaggactgcataagctataacttcaggagacatgaatttctgggttaaaccaattgcaggcaaaaagaaaaaagcataggcaacttctgagataaatgatttcaagggctttaggcttgagttacctctgagtgatgtctctccttggggtctgccagggcacatgatacagcaagtgttttagagacctctctctataaaagccattttgacccctctccacttatgcaccattctgtcctcagatttgatgaatagagaaagctttgctaagaataactgacttgctcagtacctcttaatattcaaagaagtctttgcatattaggaggacttgatttctgccgagtgggaggggtggggaaataatagattttcagggaaggtaatggtgggccctattgggagtggaggcagaaaacagtgaccttcctggtcacacttctaatcacagagagtgggtgaccctcccctctgctcccagctaacacacacctcagccaccctgttgcagccggtttatttttgcatcaataataaccgtcctccatggaattaaaaaatcgtgatatttccctgtggttcttgcctacattttcctgtttctgaaccaaccaactctcttccttttgcttggagagcacatccttaattagttttgcataacatgtgtggtacaattacctgaattccttctcctccttcttggccctgtttaaccaaacacctcccacgtctttgttctttgtgctcatcctgattgactcatgaggtgacactggctgacacttggcaaaccagtgaccttctttttgagctagagttgacaaaacctgatagaacagggtaaaaagggggaggcagaagcctgcagccagccctttttttgttaaggagaaagcagcatgggtaaatatattaagaagaagttctgctttgaatactttgggaatatttgacaaaattatctgttgaagaacaaaagtaacatgtttaaggcaaataaaggatgaggagcaatgctcaatcaggaaaaatgaggtagagggatagagtagtgattataccatgtctattttagagatattatgtactttatgaaattcttgcatttgttaactattaaaatcagaagaatttacctggaaaagtaatagccagggaggaaaaataggtttaacacaccttgagcaccagaagctgtcctatgttcattttcccagaaacggtgttttcaattaaaaaacaaaacaaaacaaaaaaaacctatgaggatggaatgaggtatgtgttaagtgaattgagcagtttggaggaaggttgctacagtataaccttttatatttccatgacttggtttttggttgtaatttcaagcagtacactcctagaccagctagataaaaagaatggccctttaaccaaataatcagggataacgaaccagtgtgatttttcaaaaaaaaaaaaaaaaaagataaattttaagtcaactttgctactatcagtgttaaaattagttgtatttagcttcatttagagcccttttcctaaatatagtgtgttgttaataatgcaagtgttttggctttaaaaattaccttttataacaatttttactatttccattttgccaagatttagataattttcatgggtttaagcataatcctttaaacttaacccaagtttttagccctgtcaccctgactctatccttctgttcatctcctatccctcccccaatccccacacttcaattttctttaagattttgttagagtgcacttagagtgactagagtctgagcccatggaagtttcctattgcttatttttctcccagtggcacatggtctaatcacctattagagcgagaatagttggtcctcccctccgagtctctccacagttctgcatagattgcaaccagatgatgacattaattaatatggcgaattctgaaagcaagcatttaaaataaccctccctgtctaattcagagatcacagaaagacttgggcagtactttgagccttgacgacatagcgtgtgctgagcatggcctcccttccctatgtcatcaagagtccatgtagtgtaggcaattaagggacccatttctcccagcatgtgtcacccttgcaattggaaagtgtccactattctgggcctacatggggatagtagagggagctggcttagtcaggcaaagttggggcaatgggtagtagtaatgtgatttgctttataactgtttgctttgcattggcaactgagctgtggccacactccaactggcagtggagatggaaccttaattttagattgtgtccctaatgtttggtgaaaataaaaatggagaggtgaccatgagttgacttgagactttttatatgtgagtcatagtatctattaggaagaattgcattcatattatgtaattatcctttgtttagtttttctttttttttccagtaatgaataatccttatcatctcttttgcatccttatttatttttcccatttacataaattaataaggccatgacagctaaccccatactaaatatatgtatacttgaagcttgctttgaacttcctgaaaacatatctatttggcttactgttgggtccccagcacctaaaatattacaaggacatatgacaaactccataaatacttcttaaataaaattgcagtttaattcatgactcattcttcaccctttgattcttatgtttgagtgacctagctgtccagtgggtttgcatggataatttatatgttcctccacatgaagggataaatagatagctcataggttattctggtatagaatagaaccctttgaaaaccagcctgaggctctttttccttttttaaaaaattagaatgctggtttcatcttcagacaaaaaatactacttttaattactgtgcagtctttagttacacccataacctctgggacactgagatggtaacacattcaattctttgtctttgacttggttattaacttgcgtttgccttggttattgttagcccatgatatttagggaagtacctctgaaacattttaatgtctgcctttttttttaaggtaaaatgcagaaaaaaaaacccaaataggtttggttttgaattttaaattactttgtattatttttgttttataaaaatatacagtaattagaagaatgcaataatgctactttctatcgtgttttattatttcaatgttgtttgtagaggttgtaagctatgatctctgagtcttcaaagagtttgagaattaaaaagaccacaatctatgggttttatttttaattattatgaaaccatagagatgaaaatgcaatgtgtatcataagaacaatttttctctatgatgtggattgagtttgtaattgagaatagtgattttcaaattagctaatctttggactgctctggtgaggttttaaacataagaatagctaggtctagtcctagaatataggaatggccttgtaatctgtatttttataaaatctccctgtttatttcagatggtaagcacagcctagtttagaacattagatcaatgagctcaagtcatgggtatgatttttcagttggcctattggttgtcctctgttctgtgacctgagaccttcttctgagcctgactaactatcttgcagatggatgttcttgctgtggtgtaggtaagagagtgtggacaggggaggcattgagcctagatccagtttaattaccatacaaatatcttaggtcatgaggtagctagggtcatcttctctaagggcagctaatttctttgcttatgccaagcaacagccttgtcactgggggcttttttcttaatttggcctttttaaaaaaaaatatcagcaagaggagtgttgttaaattgccaaccaattcagactcactagtcttttccagtatctactggagctaaaattcacaaacccaactcacttctagaaatcatagcttctgactctgcgtcagcatggtgggtgtttgggcagcaagtgagcagaaggtgctgggatcagattgcctgggttctgactctgctgctcccatgcactggatgtgcgacttggaagcaaaattacttaacctctgagagcctttgtttttcccgttggcaaaaaggcaataacattaatactaatatagggttgtcggaggattatatgagataatgctcatgcatcaaaaatggtaagcactcaacacatgtcagtggctggtattattactataatttttaccacaaattctgaataaacacgtctagaaacaaggtattgccatgattagcttgaaccagtatcacccataatttttttattaattattgcctccctttgcactctctgggatttccattcatttatttcacaaatacttatttagtacttactatccaagcagggtactaggcactggggatacactagtgaacaaaagagacaaaacataaatgatagtttaaaaattgatgcttcactacattttaacagccttaccatttaaccgtactgaagactgagagaactgaaatgtttgatcatatttagattttgtgaatttgcccataccaggtactgactagcatgaaaaatagtgacagaaatgctacataatttcttccgtgtgtcttctactggtctgtccttctgtctctatccattcttggccaaatcctgcccacccaataagacccactgaaacactgctttccatgtgaagtgccccaaggttttccctcctggtccctctacctctctctcctccaatctctactcactccttccgtagaatttggcttgtattccatgtatagtctgtatcaatgtatcctttgtattcccattagttattttcacccttataaaccataagtaatgtgtaggaccacatggcttctacatcttgcaggcccctggctcttaagaccgtcccaggtatatattaagtagtcagtaggatgcagagttcatagacagagaaaaaaaaaatttagtctacaagtgagatttttctctctttgctcctttgtaaaatgggaataaagagtacccagctcacaggctggtaggagtgtgagatgatgcatattgttggagatgttagcgcaacccattcacagtacagtttcaataatagctatttcttattatttttaaaagttttattgaagcataattagcatataataaagtacacttgttccaagtgtataatttgataaatttagacacattatacctctgtgaaatgatccctacaatcaagaaaattaacatatccttgtacctctttgtaaccccttcttccttcccagcttggccctactccccttgtccccaggcaaccactgatttgatttgtgtcactatagatgagtttgtaatttccagagtttaaaaaatatggattcataccttttgtagtttcttgggagagaggcctggcttctttcactcagcataattaatttgcagttcagccattttgtggcacgtatcaatatctcattcctttatattgccaactgtattcttttatataggcagaccacagttttttttatccattcccctcttgatgagcatttgcttttttttttcagtcttagaatattacaaagttcctatgaatatttatgtacaggtcttcgtgtggattcattctttcatttctcctgggtaaatatttgggagtgaaacagctgaatcatatagtagacatatatttaacttttagagaaagtgccaaacttgctttcctaagtagtcttgtcatttatattctcaccagcaatgtatgagagttctatttccttatatcctctcccacacttggtatggtcagactttaaaattttttgttagctttatgtactgatgggtgtgtaatactatctcattgtgtgtttttttttaaatttgcatttccctaatgactggtgatgtagagcatcttctcatgggcttatttgccatctccgtattttcttttggtgaagtgtgtgcaaatcatttgcctgtttcttaactgagctgtttgtctgtgttttgagagttctttatttgttctggatctatcatatgctttgcaaatattttctcccagtttgtggtatgtctttccattctattaatagtgtcttttgaaaagcagaagttttaaattttgataaaaccaagttcattggttttgtaaattaatcatacttttaatgtcatatttaagaactctttgcctaacccaaggtcataaggattttacctatgttttcttttagaatgttatagttttaagttttatgattcattttgagttaatttttatataagttataaaacatgaattgaagggttttttgtaaatatggatgaccaattgttccaacatcatttgttgaaaaaactatcctttttccctttcattgcctttgtatgtttgtcagaaatcagttgattatatgtgtgggtctatttctagaatctctgtcctggtctgtttttcttccttgacaccaataccaaactctcttgattagtgtagcaagtaagtcttggagtcaagtattgtctgacctccaaattgttttttgttgttttttgtagtaaaatattatataatgagtaaatagttgtgtatatgatgtcaatcattggaggtaaaactgaaactttgctttgttgctttggttaataagtgccatgatttgtcattctactagttatctttctctgaaggtgatttatctgaagcatttcagaattttcccaaatagcagagggatgagttatatgcaagtgtacttgtataatctttaacattttctaagtcttattttacatggtctttaatcctgtagttatttatcacttcggaagtgacttcacagtacatgtcacaaggccaattaaaccctggtagattctgaagtggattgtaggatctgtccaggactatgatttggtttttgtttgtttattgtgtaatatgcccagatggagagcatctagaatggagactagcaacctatagactgttggatgtgaatgaaaataggagctgtcaacgcactccctttctgcttctttgaccacacatctacaacaaaaatagcagctttttttaattggctacttaatatatgctggtcactctgctaaatactttatgtaaattgccctatgtggtacttacattgtccatgtgaggtaggcaccataaatccttgttttgcctgaagaaaggtttaacaagttacccaaagctacacaaccagaagtaatagagctagtgtttgatcctctcccctttccctccataatcttgtgttcctaatcgctatgctacagtacctttggtactaaagaatgaaagggattcaaacttgaaatataacgtaagtcgtccattgagctctggaactcctactttctatgtccaaaactttcctgtctatgatttcttctgaatcactggatgaaaaagtcatgtgggttttagagatggggctctgtgtgtcaaactggttgaataaataaatgaacgagttattcattgtataattcagcacaaatctattggatatctatgtaccaggcattgttataggtgccagggatattgcagcagaacaagcaaatgaacaaacaactctttcttcatgaaagttatattctactggaggagagactcatgatggacaactttgagatcatgtagatgaaatcacttcataagcaggaggtagtattctcctcagatcctggtctaatggcctgtattatggtgccaaaatttgtatttgaaatcacccttgatttcaggcaggaggcctgacctgtctatccctggtaattttgagcactgttaagtctgggtagaccatctgctttacctaagcttagatcattggctctctttttcagtagtctgaggctttcctcagaccagtcacctcttcacggacattttaagtgtatgagggctaagctccaaaacacagtaattgctcttgagaataagcagttttctctgtgaacacaagaaaatcatattctgctgggctcaaagagagtttcttaaagttgactcagaagaggcttaaaaacagtaagtgttacaaatggttttttgaaaggaagaggaaattatttatttattattttaagagtttcatttcaagaatgagggaagtaaaccaaaatatccagctttttttgttgttgtttgttttgttttatttttccctaaaactcttttgcaggaaaccttatggggcttttgccttttgatcttgctatagaatctagatggatacatgagacagaaggatacagaaatgttctcaaagtggttgggccacccaattaactctaggggtgtgattcagttttgtaccactttacatagtgagaaaacattccagaaggagctgtgctccccttgggtgtaggaatgtctctcctggtctgcaatgcagttgaaaagtgaagaataatttccattttctgctttgtctattgaaataaaaagacaaagcaaaaacaataaaaaaaaaactcttctacatcatttatcgctcctttatttggcaggagttttcaaactaatattttctttttgtacaccagccccattttttaaaaagtactgagtagaagttttttaaatttggcaattcaaaaaatagttttacttcaacaaacttaatgaaatcattattctttaaatatcatatggaaataatagtaagtttttttttgtttctttaccacattgatatttgtggtttgtttaccacactgccattcaacctttgatgaacatgtgggatgaatgagcactactggtaataatgaaattaggtacaactttcccataagaaaatttggcaaaatgcatcagaagcttcagtggtttttatatccttttatctggtaattcttccacttaggatttttgttcttgttagaagaaaggaataagtgacaatctgagaatatttgtccctacgtgagctaacacagtcttttaagatttgtattaaggttagttcctttgcacctatcagttttgcttttaagttgagattatttatgtttgttttatttatgtgaaataagtccttagaaaatatctttgatgcttatagttataggatatagtgatttcctttaccagctgctaagttctattaggtttttttgtttgtttgttttttaaagacatggtgatacggcttggctgtgtccccaaccaaatctcaacttgaattgtgtctcccagaattcccacatgttgtgggaaggacccggggggttggtaattgaatcatgagggctggtctttcccatgtggttctcatgatagtgaatggataagtctcacgagatctgatgggtttatcaggggtttctgtttttgcttcctcctcattttctcttgccaccaccatataagtgccttttacctcctgccatgattctgaggccttcccagccatgtggaactgtaaatccaattaaacctctttttcctcccagtctcaggtaagtctttatcagcagtgtgaaaatggactaatagagtaaattggtaccagcagagtggggtgttgctgaaacgatacccaaaaatgtggaagcgactttggaattgtgtaacaggcataggttggaacagtttggagggctaggaaggagacagaaaaatgtgggaaagtttggaacctccaagacacttgttgaatggctttgactaaaattctgatagtgatatgaacaataaggcccaggctgaggtggtctcagatggagatgaggaacttgttgggaactggagcaaaggtgactcttgttatgttttagcaaatagactggcagcatttttccctgccctagagatttgtggaactttgaaacttgacagagatgatttagggtatctggcggaagaaatttctaagcagcaaagtattcaaaaggtgactttgggtgctgttaaaaccattccattttaaaaggaaaacagagcataaaagttcagaaaatttgcagcctgatgatgcagtagaaaagaaaaacccattttttcaggagaaattcaagctggcttcagaaatttgcataagtagcaaggagcctaatgttaatccccaagatcatggggaaaatgtctccaggccatgtcagagaccttcatggcagcccttcccatcacaggcctggaggcccaggaggaaaaagtggttccaagtgccattcccagcacaatccctgtgctgtgtgcagtctagggacttggtgccctgtgtcccagcctctccaactgtggctgaaaggggccaacatagagcttgggctatggcttcagaggttggaggccccaaaccttggcagcttccatgtggtgttgagcctgcatgtgcagagaagtcaggaattgaggtttgggaacctttgtccagatttcagaagatgtatggaaatgcctggatgctcaggcaaaagtttgctataggggtggggccctcatggagaacctctgctagggcagtgcagaagagaaatgtggggttggagcccccacatagagtccctagtgggacactgcctagtggagctgtgagaagagggccactatcctccataccccagaatggtagatccactgacagcgtgaagtgtgagcttggaaaaacctcagacactcaatgccagcccatgaaaacagtcaggagggaggctctaccctgcaaagccacaggggcagagctgcccaagaccataggaacccaccttttgcatcagcatgacctggacgtaagacttggagtcaaaggaaatcattttggagctttaaaatttgacttgactgctccgctggatttcacacttgcatgggccctgtaaccgctttgttttggccaatttatcccatttggaacagctgtatttacccagtacctatacccccattgtagctaggaagtaagtagattgcttttgattttccaggctcataggcagaagggacttgccttgtcccttctgtggatttttgggttaatgctgaaatgagttaagactttgagagcctgttgggaaggcatgattggttttgaaatgtgaggacatgagatttggaggggccaggggtggaatgatatggtttggctctgtccctacccaaatctcaacttgaattgtatctcccagaattcccacatgttgtggcagggacccagggggaggtaattgaatcatggggggccagtctttcccgtgctattctcatgatagtgaataaatctcatgagatttgatgggtttatcaggggtttctgcttttgcttcttcctcattttctcttgctgccaccatgtaagaagtgcctttcacctcccaccatcattctgaggcctcaccggccgtgtggaactgtaagtccaattaaacctctttttcttcccaatctcaggtatgtctttatcagcagcatgaaaacggaccagtatagatgggctcttgctatgttgtccaggcaggagtgaagtgacatgatcatagcacactgtgcctcagactcttgggctcaagcaatcctcctgcctctgcctccccagtagccaggacaacaggcatgcaccactgtgtgcaattcctgttaggtttttaaccacacttccaggagatggtgttaattagaaagacaaagttgataaaaagtaataaataggagaaccatattgataacataaataacaagtgtaggattagtacctagaatatataaagaactcctgaacatcaataagaaaacaatggggtgggaaagaaggcaaagaatatgcatagacagttcacaaaaattcaatctgtacctaaggaattgcacattaaagtaatacacagatacaaatagtattttacaatcagcttggaaaaatttagagagcctgataatggtatgtttggagagaaaaggaaatcagaaccttcatacattgctagtgagagcaaagatggtacaaataccttgaagaacagtttggcaatatttaataaagtttccagtgtgtgcaacctaccatttaatgattccacctcagggcttacaccctgcagaagccataaaggagacaaacatggggatgttcactgcagcattatctgtgattgcaacaaactgcagtcaacctaaatgcccatcaataagggagtagattacatggcacatcataaaggagagaaaataaatgaattagatgggtgtgttttttcatggatagatctcagaaactaaatattgagtgataaaagcaagtttgttcaagcacatgtatggtcaacaagtatgtaatttttgaagaaaatcacacaaagttataggtgctatcttgcaaaagcataaacacatggattggatgactacacatcaaattctgggtaatagttgcctctggggagggagagcagggaacttatggggcttattgttgtcttcaatatttaatacaaagcaaacatggtaatatttttggttttttttcattctgggagacagaacaatgactattctatcatttaccacaaattttaaaagttaacaaaaaaggtaaggaatactttcagggaaataaaagtaatgaggcgcatctcaaccaaggtgttcatcagaaacttgccatcactgtatttgcttgcacatgttctagtcatctctgttggtattttccctcatactatcataatcttttaggacaggaactttgcctatgatttctttgaagccaagcctcatgcaatttaccaaagaaagtatgatcatcattctataagccacacacagaaattgttagaaagcttcacaaacctgctagagtcagtgttggggaaagtgtgggtgaatgggcacttggatcctctgttggttagaatataaacagaattgctttttgcaaggaatttgggctgcatctctcaacatggaaaacaggcagtctctttggccaactatcctctacctcaaagaccccacactccagaaagcctatataaaggtccagtatgttcataatgcaagaatattcaattctgcattacttaccatagtgaaaattgagaacaatagaaatgcctttgaatctgggaatgatttaaaatttttagtaataaaatggaacatttggtggctgcttttgaaaagaaagatagatctaggtgtgttgacatggaaagttgtctaggatatattattattatttaaaaagcaagcggcagaaaaatatgtatcatgtaaccagatgtttgttttgaatggatgtatatagatatataattatattttatttaattctatttgaattagcctataaataaagcagagaatgcatgtaaactcttaaattaattaaagagtagagataagagagagtagggagtgggggctttttgtatttgtttatatttgtctttattcttttgggattttttgatgagcttgttttctcatttttaatgtacagtgttagtagtattactgatgtctgaatgacacttccacctaaagatatgaaggaagcacgtcatgtattgcatttcatgttttataccactatttttctttaggagatgaattcttccttgagagatctcatttgcctttttagtaatctaaggtttttctaagactccaaagaaacctgaggtaatggagcagtgacaatggtgcacagttgagtttgcatgaaggtgactcagatttcagcccttgaggtgcctgatcatcacacatagtgattgactgcatctcatttatgatggtgcagtctactcttttcagatataaataatagcacagctcattggacaggaagggagagccaggtagttccctggttgcatgggtgtgtaaactaggccagtgattttacatcatcctaacgaacgtattaatagcatgataaaacgaaggcccttgaattgttttggtggtgatgcctactcaaccttcccatattcaagatgatataaagctgtaacaggctttcagaaatgcagtctagatttgatatagtgctttttattaactgtgacacaatggattatggcacttcaaatgagaaggggaattttcttcctttttgaaatgtgaattaacaaaatgcttattctcagtagaagttgttttcatgggcttttccatttatttctgctgtggttgccttcctctactgcctctttgctagacaggcaaacagtcacacacacatagttcatatacccattaaatcatgctattagaatggaacttttttgtttgtttgttttttgagttggagtctcactttgtcacccaggctggagtacaatggtgtgatcttggctcactgcaacctctgcctcccgggttcaagagattctcctgcctcagccttttgagtagctggaattacaggcacatgccaccacaactggctaatttttgtatttttagtagagacagggtttcaccatgttggccaggctggtcttgaactcttgacctcaggtgatccgcctccctcggcctcccaaagtgctgggattacaggcatgagccaccacacccagcctgaacaactctgtttttgaggaacggttttatatttcagaagaggatatttcaattgggtcatgctgggaaaactccccaggagatgaacctgccacttcatcgtgcagttattgtctgtacttgcacaaattattgcttcttctggcttgggatacttcatctacttgtgagttggcagtagtgacacctacctgtccccccctggagcactgggctgatgtcatcattgtgcggtgttggatgagtaagtactcgagaaagggtgattgccaagggctgggtagttcttcagggggatgggctgtgttagttgcctggttgttaaaataggagattaagaagaggaatcctgagcctgacttcttcctttgcaacccatgacctcattttgtctgacttttttcctttagcagttaaggccattatactctacagatatattccagaggaagtggagggctccacctttaaaaataataagcaattcaggacagttcatataaagtcaggatttgaatagatatttattaaatgtctgccatgagtaatgtattccactaagcacaagggggagatataaaacgtagtttagtaggttcttcataggttctaatgaaatgtaaacaccttacgagaagtgtattcctttatgtcacaaggaacccttgtgttctgtaggtcaatcactgtgcaatactacgtagattcagagatagttattaagcataataaatcaatcacacttttctctaaagctcagtagagatactacctgtctccacatattacatttgattgtaagatacagcctagagaaaaatgttagaatctcattgcagtgatttccaatgggaagaaatctaagagaatccattcatttgagattttctgtattataaaattattttctaaaccagagtctataatagatttcctttaaacacaagaatatatatcataagcataataaaaatgaatcataccacacaattcttgtttgtataaagaaatcctaatacatgaaaattaatgaatgatattgccacttcatatatatatttgtatgtacaaatatttatatatatttaaatatgtacctatttaaaatatatatatttataacctaatgcctgtatttacaggattaataaaaccataaccctatgtcagagtttttaatagctagcaacaataagcaacttttgttaattttgaaagaaaatgaatttattgacagggtattgggttacctgctgagttgctaggcagtaagaagaccaggcttggaaccgggagcagtacctctaacacactgcagaattggtctggagagcaatggaagcctgcttctctgtttctattgcaccaataattcagtcttcccacagccttgcccactccctgtggtccctgttccttttccttatcctttatctctaacacctgagtccagtgcagaacacctgattggtggatcctcagtcacatgttcattccctagctgcaagggaggctggcaaaggaacacctgcattttctcatttctagagtaggaggatgattctgcagccaaagcaattgccaaattgttattacaataattatgctagaaagtttgaaaggcagaaaacatgaaaacatcatcatattccattgttctgatacaaaactattttaaaataaaattatcccagtctttttcctattcatatgtttttacatttgtgcaatcatagattttatacttttacatctgcattttattttcagtgtctttttttatgttgctatatacacatatatcattttaaataatcacataataattcaaataaactgacttattttgccattcttctaatgtcagagattactgataaattttcattattttgaaaaataattttatgaacgtgttcacatctaaagctttggcatctgaatgttgtatttggggcttcagaacccagaaggaaatcttatcaacccttgagtctttaataataaaattagtatacttgatttatacctttccttaattgacttaaacacaaacacagtcctccttttgatgtgaaattttacaagttcggaattgagtgagttaaatttgggattgtttaaaaaattttaaacattttatgtaggcaagctatgtttgttaagcaaatatttactaaaaagtactgctttttaatttaatactaggaaaacaaataaatgacctaataataaatatcctgtatctaaacaaggtaatatgatgcacatcataataaacttatgactgtcatatgactgttaacactgacctcaatattttttaaagtaaaaagtttcgatttcatcacgattacatatatcagaatattttccttaccttggatgttgtgagtcagttacggtatttacaagtggattcttgtagaattaagtgatattatcataaaataaacacatcatggtgtattagttagccccttggtaaatctgccagtctaccatttttaatatttagaataccttctgtctcctgtaagattctggtattgttgcttgttcatttgacatatgtttagtgcatgtctagtacatgttggacactaagtgtccatattatatgtccagtgcatgatgggcagcatattaagtaacagggtataaaaacaagaaaaacaagaaggacatctgacctgacatttagaggcttaaatcgagcaggtgatattatagtctggaaatggatgtgtgtgggtgtatctgaaaaatcacaatagactggttctgggaataatgaccgaaaagtctcttttgtgcatatttaagttactggcattaaggttagtatgcatggtttgaggacttgggactgggaaattcttaggtattggttaccatccctgactttgaaatatgaaaatatgatgatatttgacttgatacagttgcctcctttttttttttttttttttttgacatctttagcccttaaagtcagcctggcttatgattctgctcttagatgagggtggttcattcatggtatggtgctgaagaggaattagtgtagcaaaatcagaaggcttggggaaaagcatagggtttttcagcattaaatctctccttatataacattccttatattcttcttcccactgatgattccatttctatcccttggaatctagcaaagggctatttgtagctgcaagtattccctggaattgggatcctacaacatgtaaagagtcaagaatcgtaaaatgtaatttaaattaataatccagatctgaactgtactctcagaggttaaaccagacataatctttcaggatcttggtgggcaggttggttggtacattttatgtcttagggatatgtatagatcctcctttagaaaagatagagactgttttttgtttttgtttttgtttttgtttttgaataagacaacttttgctccagttctgctagcatggttggggaccacattaaaattccactttgatcaatagaaagacaaataccataatgttgtcagagtttttttctcagcatgggattgttatatgttgttccttccttttgctcatccttttctctaaattttctccagtcatgtacattatgggttttggggttttgtttttgtttttgttgagacacagtctcactctgtcacccaggctggagtgcagtgacatggtctctgctcactacaacctccacctcccgggttcaagtgattcctgtgcctcagcctcctgagtagctgggattacaggagttcaccaccatgcctcgctaaattttttgttttcgccatgttggccaggctagtctcgaacttctgacctcaagtgatctgcctgcctcagcctcccacagtgctaggattacaggtgtgagtcaccacgcctggcccacattatatttttaataaggaaagtaataaaattggtgtcttttcctggtattaaggatgacaagatgaattcaataaaatttccttggtgttttttctctcgtatgttcctttttgtgacaacaattttgggacttttaaaataagtatgtttgccatatcactgatagcagtgcattgattacctctgagaaatgaagccacgatgcatcctgcatatttggttggtttggagtccagcacatcagggttcagatctctggttatatgaaagcaggcaagtcacatcaagctagttatgtaaccctctgccctcagtttcctcatctgtgaagtgagactagtggtagcacttacattcattgtgagcatcaagaaatattaatgtatgaaaaggcttgagcattatgctttgtatataagagatgctcaataaaagttaaccttcctctcttattttcttttctctgaagggagagggtgagaattgttacaacttattctcatactctccaataactattttgaatatggaaaatggcatggcttgttgttaagtaaataatcatgttctatattagggaaaaagaataaaaaattttgcattatttagccttttgttatgtttttccatagtcatttctattatttcaagaaatctttctctgtctcttctcgctcgttctcttttacatccaaggttgactttctaagcatattcagtggtaaaggtataactgcatcatcccatatttcaataccaaaacggggagaagaaaacacttaaattcagccaccacagtgcattttccaaagtgttaattaaataatatacataatacaaggaagcttcagtttggcgattgaaaccacttgccattttgctaaaagtaagagcccatttaagtccatttaagatcatttgggtctgcacttatttgtcatgggtatcatttgagacaagaactttgtaggaacaatcttgtttaatttaatgctatttctactactgtagcttttgttttgttttgtttttctaagtggtttgcagatagttttgtagggaggcaaataataaaataaaacgatctagaatctttaaaactgcaaagaatttgccattgaagcattaggattaaatttttttttgtaaacccccaagacaacatttgtgcatgtatgtgcatgtgtgtgtatatatctaaaaactatactttttcctttccttctaactctttattatggaaaatttctaataaatacaaaagaatagcacaatgtgcctcttgccccatctctgagagcatttggcacacttctataatacttgaagagcaattagaaaataaaagtctggggttatttataaaattatgaacaaatgactttggaaagtttaaaaaatagattggaaagaaataacttttcaaaatgtaggaaatgaacagatgaaaaattatttgctggggtttttttttgttgctgttttttgttgttattgttgctgctgctgttgttgttttcagacagtgtgggcagcaagccacccaggcgccaaggcaagagaccgaggacaccagctgttccagtataataaaatataaaacaagaatagttataccagatatagatcttagatatgattatatatgaatatcattaatcattagtttgtagcaattactttttattccaatattataataatcctctctctgtaatcataacctaggaaaaaccaggccatacagagataggagctgaggggacttagtgaggtgtgaccagaagacaagagtgcgagccttctgttatgcccagacagggccaccagagggctccttggtctagcggtgatgccagcatctgggaagatgcccgttgccaggcggacccgtggtctagcggtagcggaaagtgtcaaggaacaacacccactacttagcagacagggaaagggagtctccttttccccgggggagtttagagaagactctgctcctccacctcttgtggagggcctgacatcagtcaggcttgcccgtggttttccggaggcctaaccatctccctgtgatgctgtgcttcggtggtcacactcctagtccgccttcatgttccatcctgtacacctggctctgccttctagatagcagtagtaaattagtgaaagtaataatagtctctgatatgcagaaataatggcgtaagctgtctttctctctgtctcctctccctctctgcctcagctgccaggcagggaagggctccctgtccagtggacacgtgacccatgtgaccttacctatcattggagatgactcacactctttaccctgccccttttgctttgtatccaataaataacagtgcagccagacattcggggccactaccggtctccgcgcatttgtggtagtggttccccgggcccagctgtcttttcttttatctctttgtcttgtgtctttatttctacactctctcgtcactgcacacggggagagacccaccgaccctgtggggctggtccctacaagacagagtctcactctgttgcccaggctggagtgcagtggctcgacctcggctcactgcaacctccacctccctggttcaagcaattcccctgcctcagcctcccaagtagctgggattacaggcacacgccaccatgcccagataatttttttgtagttttagtagagacagggtttcaccatgttggccagacactggtctcggacacctaacctcaggcagtccatctgcctcggcctcccaaagtgctgggattacaggcgtgagccactgcacccggctgatttgctgttttatcatggagaatttgggagagtaaggaggctatatgtgaaactccgtaagcttattgtaagctaagcattagccaacttctggttttgtttgcaagtatagtaacgttcctttatttactattttatcagacataagagacttttaagtgacactctcagatatcaataatgcactcatagttgatgttcggaatgactcagaaacaccaaaagcagattcctagtgtgctttttgaaacattagaattgttcagcttcattctatatagttttagggcatagtttatcattattgtgttgaattgatcgttcttgatttatagcatagcttttcctgtccatctgactgtccagaactcaaatcagtatgaattcttgagtattgaattaggctatttacagtgaagatgacgtttcctgcaccctccaattagctagaaacatctcctttgcatgtcaagacaagatgtgaaataactcttgataactgtgaatatcagatataagaaggaagcatgtcaatagttcatgagatacctgtgccattcctggggcttgactagtttctgtgccttttctgaaatctgccactgaaaggagtcgggaaggaaattggcacagcctcttctaggataggatttctacactgtggcattattaacactgggacgaaagagtctttgttttgaaaggctgtcttgtgcatcgtaggatgtttagcatcaccgctggactctcgcatactggatgccggtagtagcaccccctcctcacatagttatgacaaccaaaagtatctccagacattgcctaaaattccttgaagggcaaaactgcctgtacagttgagagctcccatcttaataggcaggagcaccttactgtaaatttctgtgtgggttactctccctgtttcccccacctaacccttgggttgtaagccccttgatgatagaaatgaagtattttctttcatgttgaggtctcgctttcttttctgtctaccacacaatatatagagatttgaggattgactatgccattgctttttttttcagacggagtctcactctgtcgccaggctggagtgcggtggcacaatctcagctcactgcagcctctgcctcctgggttcaggtgattctcctgcctcagcctcccaagtagctgggactacaggcatatgccaccacacccagctaatttttatatttttagtaaagttagggtttcaccatgttggccaggatggtctcgatctcttgacgttgtgatccacctgccttggcctcccaaagtgctgggattacaggagtgagccaccacacccggccgccattgctttttagtttttgtttttatccaagccacataatatagtgggtttttaacaaaagggcagtcttgacatttctcttcttcccgtttttgttactgcttcacaactgagtacgtaacaactggtacttcagtgatacagtggcctattttctttcttataaaagacattactatatcatacagtattttaacctttcctttacaaatctcatgatactgagatgcctttggttaacaaaaattgccattgagtctggaagattgtttgtttgctgactgaccagccccctcatctcatccttctcacaaagaaagaaagaaagaaacaaaccctcaacccttaaattagtcaaagtcctaaggcagttttcccagaacaaatgtccatattgactttctccgttgttaggtcctgtccttgttgacccgttgctggcttgaggggctgattctgttcactttggaattgggtagcgttttggtttaacaacagtgtccacccagcgggggaccaaattctcaggagaagccttatttataataaagcacaaaaacaaatactcagaagaaatagtgattacataggccctctgaacagtttcaaaagcagaaataattccgttgaaaatatgaatcctgtaaataactcatagtttggtagtgtttcataaagtgattaggagtaagcctcaatttcctcatgctgaaaatggggataataacatctgctacttcgtaggattgtaatgaggattaaataagtgaatccattgaaaactttcagaaaaactacctgtaacatagcactcagtaattgctttattttctttcttttggagatggagtcttgctctgtcacctaggctggaatgcattgatgcgatcttggctcattgcaacctctgcctcccgggttcaatcaattctcctgcctcagcctcctgagtagctgggactgcaggcacacaccaccacaccaggctaatttttgtatttttagtagagatggggtttcaccatgttggcctgaagtgatcggcctgccttggcctcccagagtgctgggattacaggcatgagtcaccacacctagcctattttcactttttaattcttctcctaattatgaggagtctctatatcttcccattttcctacctcctttaaaattcctacctatattctccaaagaagtagtctatcctcttcctctttatatgcattatccattatttttatcacacaaatccaaatgggactatccaaaccacatatattggcctggtataggtgtgtcctccctttacagatttttatagattttcaaaaaattttaaatctctgagaatttgctttgtagagtatgataagtcataggtttttgtttgtttttttttggcaaagtactttttatagtgaggaaaaataaagctctgcctaaatacctatgtaagcttaagtttcagttgattacgtgttttagatgacatccatgtagatcattggccaatttgtttgaaagaggtagtcatgatttttttgatctgaaaaggtcaatatgaattcagttctgtatcccctgcacaagttttttaaaaaatgtttcatttgtggctaaaacacacattcctgattagatcaatgagagcactccatgggcaaatccagcttattttgctagttaacaagatgtttctctgagttctcgtgccagcaacgccacagaagaatcacaggaatcctcctgaatccataatcaattcatgcaacaccaagtcagatctcttagaagaaaattgctggtgaaggtccagaatagcaagctaaaaagcagatatttgatacttgcaataggctgataggtgtgctaagtgcttgcttagtaaacatgctaccataacacttttccttttatggagaaagaggacataaatacataaaaataaaatatcaaatacataaatatgtgtgcactgtgtgaatatgtacaggttgtctcaaatttatacgaaagcagagtgaataatagaatgaacccttcgcgtaacccatcacccagcttcgagagttattgactcggctcatcctgtttcacggatacctccctctaacttgcaaatcctagacataatttcatctttaaatctgtctcgtagtttgttcaacctctccccagaaaaatgtacagtcaaagtttgcttacaattttcaggaatttacaatttccctaaaacccagttaaagagaaccactgactgatccagctcatttggaagtatgagaggaaagatgtcacgaaagccttctgtatgagactgtggcctgcaagtgtcccagctctaacgttcatgtttttcccctttttctcttactctcacaatccatctatgatatttgagttagctaaagagaaaaagataaaaggatacaggaaagaggctgaatatttccttcatcttttaaagtcctctcgtctccttcttggtggctttatattttttttgagattgtgagctatatgatttaacactaatccacttggatgtgaaagcaaaaattccaaggtgaacaatcatagagaacattatttatttactgagcatttactatgtgccaagtacttttcatgcatctcatcacttaagcttatcagcatctccagcaactattaggtaggtaggatccatgagcccattttgtaaacagaaaactgaggtccaaagcatttaagcaacttgcccaggatttgaactcagatctatttgaaattccattcagatgtttaacaatactaaactgcatctctccattttactctgacagtgggtcgtattcttagctgtgtgtcccaagcaggcatacgtggagtattttatagctgtgtgcaccatttataacaacttcttcatggtggcgtgaggcatttcagagcattatataagaaagtctcttaatgtttatgctgtttttaaattagacttagtgcaagccaagaagaagccaagggcattttcaaagtgttcatcagatcatgttgattctctttattaaaacatctcaatggcttcttacaagtagtagagaataaaaatcaaattcctttcaatggcctgcaaagccctacaacatctggcccagacattcttttcagggctctcactgaccttgtcagtactccaaaagtgctggctctgtggttgttgatcttgtccttattcatccaatatgctgggctgcttcctacctcagtatctgatctcttctgtacctcaccatagctggcttctcatcattgaggttccacccaacttgttgcttctagaatagctttgttgcaatggcctttttttctcttttactgtctgcattgcacttctcattgtatgagattcttattcctttgttggttcattactctgtgtttgtctctgcttccccaccttaaatatgattttcatgcaatcagggcctgtgctttagttgctgctcagtcttcagcacctagatgagtgctgagtaaatcctggttgaatgaatgaatggtttgttaagtggggatggttacattaaacctgcatgcgaagctctcagcacagtgcatgccccagtcggaaagcactgccgagctgctgctgttgttggtgaggttaattccaatctggaacttcatcataacataatctataaggcaagttttaagaatttcccaagccaatgcagtttctcaaaaaccagaaggaccctcagtctcatgatatagatcctgaagttgtgttattaggagatggctgctttttgacagtttttagctcatgtgggcttgaccttcaaaccagtagcattcagcagctctcatctctgcctaggggctttctgaccttttgcttaggcccaaggcaatgttttcatctctgacaaacttgaccactgccagtttcttaagagtgtcggtacttatgagaaggagttgttctgcctgtgctgtaatcatctctaatacccgataaactgcaaacaatgggggcatttgaggggggaaatggtacaacaaaaagacgtctgcgattctgaggcagggctaaactggggcacgtggaaaagttctagcatgtggaatgctgcactcgcagctcccatggtgggggggatctggacggtcctgacaatgggccattataaaggcactattgaaccacgtaattgtggcctttggaaaaaccataaaaatgtgtcaaatattatacaaatgcaaactgtacaagcttgaatgttagaccaaaaatttcagaaaaaacaaagtcctctccatctgatcaaacagttcaagaaaaagttgaaacaaggcgaatttcaccattgtgtaaccccttcatgggtttatttgttgcttgcaaaattttcagtagaggaattctgcctgaatatattttcatttgtccagatctgtaggctttcattctcatggaatgtctagcttgtttaaattacaaaatcagtgtcatgtacattatagaaaataataaaataacaatcactgagaatttatcgctcgggaatagtcattgttgagacttgaccgagtaatttgtcattagtttttttttttggctttgcatatatataaatagcatttaaaaatcaattttggatagcagcatgtatagtgtttttaacctgctttatgttcccatttacattaatgaactttccgtctcattaaatattgttagattaacacagtaacggaaaaccaaacaccacatgttctcattcatacgtgggagttgaacaatgagaacacatggacacagggaggggaacatcacacaccggagcctgttgaggggtgggggacaagggcagggagagcattaggacaaatacctaatgcatgtggggcttaaaacctagatgacgggttgacaggtgcagcaaaccgccatggcaaatgtatacctatgtaacaaacctgcacgttctgcacatgtatcccagaacttaaagtaaaaaaaaaaataaatttgatatatgaaattcaatgtagtgtactagacaagaaataaacaaaaaattgttagataaaatgtggattgtaatgactgcataggatccatttatatgtagtggttctcaactgagggctgttttgtccccaggaggcatttagcaatgtttggagccagttttggttgtcataactggagtgggacatgctgtgttacttggcatctaatgggtatagattagggatgctgggagacagcaggcagttcacacatcacccccacaacaaagcagtatctggctccagtgtcaatagtgctgaggctgaaagcctgaactatatggcttccttataattaattgaatccatggcctatgagatatttgttttcaatttttttattagaaattaatggctgaaaaactttatctataaaaaacagagtgttttagacttttggggccgtcgggtccattactcaactatgctcttgtactgttatagcttgaaagcagccatagactatacttaaatgaaagtatggatgttttccaataaaaccttattgacaaaaatgggcggcatgccccaggcagtagtccacctacttctgttagagataatgctctaatagatgtctgtgtacctaaatctttgtcccgtatctgatcatctccttagaaaagttcttgaaaagagccattgctgcatgggcaacatgtatgtatctttttaaagtttatatccgtttattttattttatcttttacagttctacctatttattttattttctcctatgagattgttcatttcatgtagctttctgaacacacttgcgccaccatcattctatcagatttggaaccttgttcagggatatgaagtgtgaatgggtaaggtaggatttgcagatttaaaagtcttcaggaatcagacgggttaatgaataaagtagtccagttgtcagtgtcagaataaagagtgatgagagttgcagaatgaaaagtaagtgctcattgaaagggagaagctacttctcaactctgttgcttttcaactctgataagttgctggcccagtaggagtgcagtttggtatctctagatcttctgatttatcaaccagaaaagagaaatccaaactctggtttgagaaaccagattttgggttgaaaactcccaatttttcatcattggtgacaaattcatagaacactaaattctgtctaggtgaacagacttgcctgtggtttgtgtccatggactgccagcttggggaccttggaataactgtgacttatctaggggtctacagctagaggtgaaagcaaatctcaggcttccggccggtcatttgagacccacagggccctactggcttgttgtactgctagatgagagctgtaagaattggcaatctttgggcagcccctgatagataaggaagctttatcatgtgaagtagggtggcaggctgtgaatcaactgcctggcctgaagacttagttcctctagagctttctaacttaggaagactgagggactgtcacacttcatttcctcaggacgtttccagaggtggtcagaatcctagcctacaacccctgcctacacaatgtggccccttgttcttcggttctgccccttatccatgcacgccagccacagtggttccacactgcttcactgacgtaccaaatacttgctgagtgcccacagtgtgccaagctgtgttctggacaaagcagagcagaggagggagaatcaggagcactggtagcatgtgggctggatatgtgaatatgtccttaagatagttataggagacaaggtcaatgaggtaatgctcctggggtggggtggagtgggagaagtaggcacagtggacaggggtctgtagaatctacgtggagaactaacaagctagtgtggatttctgaacaccatacccagagattctgattcattagctctggtttggggccctggaatgtgcatttctaataagcactgtgaatagcattgatgtagggacttctaggccattgcaaatactttgtttttgtttttttttctcagaaataagtagggaaccattacagaggtggggtttttctttttgtttgttttggtttagtttctatagagaaatgacttgatctgacaatatcacaagatccccctattcattgtattgaaaatacaccgtcagagtgccaagacagaagcaggtagaagagtcaggaagctttccatcatctaagtttgaagagatggtggcttggatcagatggtaacagtggagcatgaaaatccatcatattctgattattttctgaagatggaaacaatatttcttgatgggttggatccagggtatgaaagaaaggagtcaaagataaccatgatttgtagaatgagcaactaggttaagccagaggaagaccattttttgacctacccccgcccccaacaaaaatggcaattttctatgtttcaacctaatagaaaaaaatggagttgccaactgtgaaaatgcagaagaccgtgggaggagccaatttggaagagtggatgaacatgctgagcttgagagtctgcagtcctccaaacggtgccgtctcgtaggccagtggagatgagtctggttctcagagacctctgttctggggtgcttaaatccatgtgactgggttcgatcaccagggctgggagtgtagatagatgaaatcaagctcggatccttgaggcactctgacatttagaggggagaagaggagaaaactagctaaggagagtgagaagaaatgaagaacgtgagagaaaaaccaggcaagtgtggtaaatcgaaagccaagtaaataacatgtattaagagcctccttgctgttctttgagcaaccaaggcttgttcacacctgagggctgtatgcttggctggaatgccgttcctgccaatctgcctggctcatctcaccaacttcaggtctgggcgtcaatgtcatactctgtgaggcccttacctaaacacactgtgtaagatttgcacagttgcctggcatctagttggtgctcaagcaatatttgttgattgaatggtgaacatataacttttgatgaaggcagcagtccaggtgagaacatatgaaagccttgctgctcgggatgtagtgtgttccctggaccggctgggtcagcatcccctggcaacttgttagaaatgcagaaatcttgggctctagcccagacttgtggcatcacactctgcatttaacaagatcctccagtgatttgtgtacacattaacatttgctcccagtcctgtatttaattttctatgaatgtcaagaggacaattgagtatactctctcagatgggaacaactcaaagtaagaagttaaaacaatcaaaatcaaatatcttcagtggttgtttctgtattcaatcagaaagctatgatacagtttaaaagcaaaagaaaactgtgtcgagactttcaagaatattttatgtgattatccccctatcttttttacttttattttatgtggttattccacatatctttcttacttttactttgaattgacataagctaggagcgcatgtaaaatgcatggcatctggtacatggtagacaagtttgagagaatgagcactaattccgttctttatattttaaaacatcgtgctatataatgtaacatatccactcataatgtcttataagaccctcatttaagagaaatggttttctcttctattcggctgagataaaaccacatgttctttttattatcatggtctttggcttattttagcctgagggagaaaaaaataatgtatatattagggattttcttatgataacaccttttttctgaggctactaaatattgtttgtcctaaaaccaaagtatgcctgtcttgtggtttataataagcatactgttttataggtcattagctaaggataaaagacttgctgggaatttttgatagggctagtctagtctattctgttttaacatcaaattttcagaaaagtacatttgttatccttttcttttatacatatttacagctcaattctctgaattcagaagcctacaatgtaataagacaggaagtagtatgaaagtatacagacccataaatatgtgatataaatgtatatatatttatttgtgcacacctgggatatgcacctggaatatgcacctggaatacacccctggatttacacagttttatcttcccttcttattcagttaaagtcctagatcagaactgacccacagaagagggagcttctctagttcgcctctgcggacagaataatggagacatggctatggtttctaaccctggcaagttgtttaggtttcctcttagtttctgttttctttagctttaaaaagggtggggggtaattaagcatatcctgtattcttacaaagatgcttgtccagttaagacagtagttggaaaaacaactgtaaaattacgtatacatatactatttctctttattaaaatcaccccattctttccttcaaatcctgctaaaacttctgttgagtaggaaagttcaattctagtttggtgaaactttcctagagagcaggggtcagcattttctataaaaagccacaatgtagataattttaggccttgggggccctgcagactctgttgctactcttcaaatctgctattgcagcaagggagccgccctggacaacatgtcaactaatgggtgtggctgtgttctgataaaactttatttatccacattgaaatctgaattttatataattttcatgtgtcatgaaatattcttcttttcattttttttcaactatttaaaaatgtaaaatccattcttactttatagaccatacaggcagcagaccgagttgggctgatgggtggacagactcctgttgtagagaaaaagcactgggtttgtcaaccatagccatttcgaacctttctttatttaagactctttggtttgctttgtatttgcatctgattttgattcttctcccttaggccaggattcatacccttgttgtttttactttttgttaaggacagctttgtacagattgtacagtaaacaagattatatgtccaaggatatatgttctgggcttttgttttcttttgtggtaatgtaattgtgggactgaaaagaacctcgacacttaatcagatgtgaccttttgcaagactatcctagttatttaagaaagctagctttctctgttttaccgcttttttcaggaaatatgattgcataactgacattctctatggattgccatttttaaaacagtatgaaaagaatagtggtgtggtgatagataacaattgattaaagggtaatccctttagttttctttaaacttgctgagcaaaagaacaaattatctctctaaacataagtgataaatctgaacattttgttgaattattaaaaatatatatatataaagccatttgagtgtagaagcatgtcatagctactcaggaggctgaagtgggaagatcacttgagcccaggagttcaaggctgtagtgtgccatgattgcacttgtgaatagccactgcactccagcctgggcaacatagcaagacccttatctctaaaaatataataaataaataaataaactaaaaggattaagaaaatctacactcgcttctacttgaattctggtttacaaatagtagagagaatagaagaatagtggatatctagatagggatatttcttccccagtaaattctgttgtcagccaagatggtagtatctatagctaccatcttaaactgacatgtgatgtgctccaggatctctttagaatgaaactgatggaaaataacctgtcagttttacccaggaagtggtaaagctgaagtgtgacagttaggaggtgatccattccgattctcttgctatccattcaagatctgaatgaagaaaggaaacaggtgaaattacaggagtgctaacaatgaataaaagttacaaagcctttgggtgtttgccctttaactcagatagctagcataatttatatgaaatataagttatatcaataaataatattttatgataaagtattctagctttattttgctgtctatacttcaggtgttcagcagtactcaacttttgctatctgaatttcttagtgtggttagtcatctggaaagtcaaaaacatgcaaacattatcaggaaatcataaagatgtttctgtcctctttaatgctacatatatgttctcatttgcatacttctttggctatttaaaaattaatgaaagcaaagttattgactaaaaagctatgaattagggtggctgaagacagaaaattatatttatatggctttttaagttgtcaaagggctatagagcctcataataatgctatgagggagtttggacagggttagtatctttctccagcatcttctcagggagggaagtaaacatagagaggctatgtcacacaccacctgtccacagtggggagtgacattgctggtgcagtgatgatgctagaatgccaaccacattctagatcaggggttctcaaagtgtgatcagagggccctggttgtatctaagacccttgcaggagttctgccagatctggactatttcagaataacactaagatattgttttcctttttcactctcatttcaccagtaaacaatagagttttccgaaggctacatgtcgtgttgagatgtcattgttctgacatcctgtgagatatctactaatgtataatcgtgtgttttcaaaaattctcaattttaatttctaatatgctaaatattgatagatataatccatgtaaacacaataaatttaaagagtgtaaaaggatcctaagacaaaaatgtttgagaattgctgttttagatattgtgctaaggccgttagaaacatgatctcatttaatgcagaaaacacacatatgaggcaagctctactgtcattcccattcaatatgctaggagatgagggcctggagaagttaatgaattgcagaaggtacacgggttgttaagttgcaaagatagaatctgaacccaggtttcaagttaagaactccactgtctgtgttgtcaggcacattgtctttcaaagaagcaccaggaaatgcctggatttggactaatttctcagaagagaaacttcttcccataacctaggctatctccaagggaatgtaaatatgaagattatccttatagacagtgtaaaatagagattattttctagtagtttgtgggccgaggcttgtactctgtgaaacacaaaacagttgagcatcggatctttaaacctggaggattttacttaaaaaagaagtttggattgccagctacccttgaaaaatttggagattttgagctaggctggactcatattcccacatggccacaatcagctgcagtttttatctgctgttcctgctagatagatgtgtgtcctctggtttgccacagacctcactactccttattaccttcctcgtagctcatgttcctcatttatgttgcctgtttgaggtatttgggttagaaacagctggagatgttctgtctactgcatagtgtttataggccatctgctttcaacttacgtgaaaaataaaaagttattaacagtaaaagagccaaatatatcccattctgcttacccaaacctggatgtaataaagacctcactgacagtgccacatagaaagcaaattgcttctttctttactaaagcataatattctgattcattaaagaattaggatctgccagtgaattaacatttatttttaaacatgaatctcttttctttttaagtgtaatagtgaaataagcacattctactcattgccctcattttatgtttattttagtaatgtctactgtcatcattatcatgtctggaccctttataaaaaaaaaatctctgtgaacctctgtgtacatattaaatcagtcatttgaaacaatatgagattgtcaacctaacggactgcattatcctgggcatttagacaacattattgaacttcaaatttttagcttaacataacatttgtcagcagtagatattaagcatttatcataatttataagtatatatttgcttgcctcttttctttttttgcctcaccccagaatataagtttcataaagctggaaactatatctgtttgttcacaatgtatattctatgctttgtacagtgtttagcacttaacagtcaataatgaatgaataaaggaataaatatgtaaatatatcagtgttgtatatgataactcattcttctgtaatcttaagaataatatgtaaaaattctcagcaaaaatgctcatgcttttttcatttgagaattaaataggggagatatttatttcttattatccacataaatatatatccacttctgtgtgtgctatgttctatttaggatagtgcccggtcttcctgatgtgaggtcaataggcaggttacacatctatgtagctaagaataaggtgcatattaagaccaggatgcaagaagaggctgttgaacttgaacattcagcacagagtctcttctcttctatactaaaagatagtcatcctgcagtcggaagtggcagttattcggccattggaaaagtctcatgtaatagtagcttttagatgatgtctcctccaaaggggcattctgctattaacctattgctgaaagagaaataccattgtctattaatactactggaactaaagatgaatagtgaattggccttgatctgacagtgagtttgactttgatagctcgtcacttaaaaaggttcttttatatttatgaaaaaaagcatgacgtcaagccagggggaaaaattgatatcaacatttaagaccaaactcgtagggcttccaaaaaaaaggcccttatgtgaacgtttttttttacatgcataactaattagcttaggttattataagcagggcttctgtgataaagtttccggtggtgtctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgagatttattctgactcatattcagtctttgaaatataatgcaataaattgatttaatccactttttgttattgtaatagacatactgttttcaataagtataaatctgctcttttaatgctgtttattatttgatgccataagaagtaattcaatgtagttttgaacaaagtaaatattagtaggattcttttttttttttttttttggcctagtgtgtggctaaactatcttcatcagctcctgttcattgctcataagattaaattgtctttatcaagaaaaaagtgacttaaaattgaataatgttgttttttggggaaaagtatttctcgttctgaattaatgtctgtaggaaaggagaaaaaacatcctgttggcttgttaatagtcatgtcttttaaaacacatacgtgtaagtgttatgcatttgaaagaaactacttaatgtagaattgctttttatgttgagttttttcttaattacaatgttgaataatcatgtccaaatgaaaagtgggagaattaatccacaactagttgatttaatcattggaagatttatatttattttctacagccattttacacagttggttcttaaggaggtgtgtgtgtgtgtgtgtgtgtgtgtgtgtgtgtgtgtgttttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggcttaataatttattctgttggtggcctggtcagtttcatgtttgtgcctgaaggaagagccgtctgaaactcacaaataacagcgctgttttcttttccctccatggctatgttcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagaggtaattcatgtctcctctcctctcctgttttcttatgctaaataacttgtctgttgaatatgattcccacacttaactgtggactctagtttgtccttgtggccacatttaccagcctttgtccccgattcaccatcgtggctgtggcattccagcctgttgtctccatcgctgggttattgggtgtagagcacatgacgggagacctggccctctccaagtgaaatgtggaggcgaggacacttttgccacttgcttcttcttccttagctgagtgctctcttctcttccatgcctttcagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaagttatagactgtttttgcttgtgtttttgcagggattttataagtttgaagagcaaaacagggcagagagcgagtgcccaggcatgaacacacattcacgagcgtcctgtatgcaggtactgaatgacttggcagcctgaggatgaacactttgtaatgagaatctatatttgtggtggatcacaccttcctgaaaacttaagcatttttttcccccattgttttttttttttttatagagaaagctaggaacattgccattttcctcatagtatctcatgattaaataatgacaagggagaataaactaaaatgtgtttttcccctaagttgctgcaaagattaaaaacttcttaaagtacataaattttaataagatatgaaatatgtactttaacataatccatatatgttatacaaatttgtaggttagcaatttttgtattagtaaaaccaagatgtgtgtgtataatctagatattgtttcctaaatggaatctcatggaacatacattttgaaactatattaatttaataacatataatggatgctttcccaaataactaaagtttcttctactacatcctatttaatggatatataaattatgctatatctatttatatatctatgcatgtatatagatataggagagaatgataagcaacaaaatttgttgcctttctatgtttcctgtcatcaacttgcattatttttgtcataagagaaaaaaatattttaaaaatgctattacatcaagcccactaattttatttttctaagaacaaaattaaaagtggcaaggaaatgttgttcataagtttcctagcctatttgcatatttaccaactcaattagaaaatcatctcttaaagacaaacaaaacaaataaaagtggtgtcaatagaaatggaacctaacaaacagtggatagtagttattcaaaactggccaattattctttttaggggtcattaataagactccttttttgagtgtttactatgttcctggtactttgaatgctctgtacagtttgtcctgaaatcatacaagaatccataagacagtaaatattatgaacccccattttatagattgacaaactgaggctttaaaagattggaggctttgccctaatctagaaagcaggagaacggggattccaacccaaacctatgaattttggattctctcctctttaatggaagtggcaagagacagaagagcatccctgttagttctgtgatttcattgtgtaactatgaagtcctgttaagacccaagcacagacacaccaactagctcaaatacataaggtgtttatgaagaaatgttttcacaggcttgtctttgcaactgctgcaatgcacatgtaatcactgttgtttattatcataacttatgttttggtactttagaaataaaattgatctagtgggaatgtcagctccacgactgtaatgataacctcatcctggtgtactccctggggagtaccaagcacactggtagctgtacaaggagaaacttattttacaagtcactgtaagatgggtgcagggatagccagtggcctgggagccacagtgtccacacttccctgtggaacactacagacggtgttttccttctgcaagaaaagggtaggggccatcgtctttagggaaaaaaggaagtagaatgacagctgtcattcaagatgaagtgctgtggtacatctctcctgtttagggcaggcagtttagcatagttgtgaaagcatgggttaaattgtggctccagtctttcttcagtgtgtgactttgggcaagctgcttctcatttatttcacctggaaaattgctataataatagtacctgccatgatacggttttcgttagggcaaaatcttagcctatgaaaatcctcgaacccaatgcttggcaactcataatcactcattaaatgctggctacaagtattatcctcatcacctattcgtgttaatggtcttcaatactattttatacttcaatactattttagtggaaagaggacagttacttcttagaatctaactaaagaccattattgctttgggtaaaaaaagaccatgagtctctttttaggttgtgttgcatagtttatttatttttgtctctcttctcttaccctttttcctacagatggatgatgtaatcgatgacatcattagcctagaatcaagttataatgaggaaatcttgggcttgatggatcctgctttgcaaatggcaaatacggtattgataacctttttttaagtagaaaatcttgaggtgtttccagggttcttttcttttttcttaaacttttattttatctttgtaactggttcactgattaaatgtattaatagtaaaatggagaattatctcaggatcacaaataagtgactttaacatcagaaattaagaagtttttatgagtttatgaataatcccatgataaaactctacattccctggagtccacgagcagttttgatagggcattagcccttccaattcccttgacatctaatgcccaacccagtacactgcagccaagggaaccattgtgaactgcactattcacagtggtgctctagttggcctgaaaaagttggttcagtttttcaagaaggttttctcatattcttaggtgatagagggacattggagttacccttctccaacagcaaaatctattccaacctcagttcataaacaagtggtcctatttgctattgtatgttacttgtttttctctgtaatttagagccttgcctatattgtttattttccttcattccttacattttagtcttatgttactgttttaccaaagtcttattgcacatcttatttagtccttgcagttattctgtgagtcaagttcggatggtatcattgccctcagttttaaactgtaactaggttagacagtcttacgcaagattacatagcttgggtgtatcagagccaggcctgcttggtaggtctttgaatgccttctccaatccttttctgtttcctctgagagcaatgctatgagactatcatattcttaataactagtgttttaaagaccaatatttattgagaggaaagggaaaaggggagttgtttaatgggtatggagcttcggatttgcaagatgaaaaattctggagatctgtttgataacaatgtgaacatacataacactactgaaccatacacttaaaattggttaagacggcaaattttatcctatgtgttttttaccataatgaaattttttaaaggtatgactaacttccagtagtaaattcccttggccaaaggacaaaataacacttacttaggtacaccagaatcctcagaaaattgagtcttatagttagcattttcttttcttttttttttaaatccatcttgatccaattcttcaagttcacttccttgaactcatgtggggtgaggacttcccttgaaacctcaagcttcttttatgatatttagagtttgtctactttctacccatttaaacccaccccctgattttggaagaaccaggtgttctactattgtgatgaaagtttccatgccatactctccgaacctcttggaatccttggttggcttctgtggaaccttcctgcttacaagttgttgcatcctatgaggccaaactacacttatctagcactcagaatcctaggacaaacatgagtaaaacacttgggggagcatgccctggggaatttataaatatacccaaagacatgggtatatttacatttcactgctctagcagcattaattagcaatggcccagtcatctcaaaagaactttgctgtgagagtggtcattttgctagtggtgtcaaatgggtccctgggcacactcaagtgaactgtagaattgacatgattctgtaaaatcattgactttttttgtaatggcaaagacctttgatatcatttggtctaacctagtactcaatgcattagcctcctctttttttttttttttttttttgatacagggtttcattttgttgcccaggctgatcttgagctcctgggctcaagtgatcttcctccctcaagtagctgggattataggtgtgtgccactacacctggcctgaccttctcttgcatctcgttagtattctccacaaaaaaatcaaggcatccagcttcttggaagcctccaaaaaaggatctgtactagctcactagggaaatagcaaagcacaatggttagaatttagaggtttctgaccagatctggggtcaaaccctgaatcttccatttcctctgtgaccttgcatgttatttagcttcctgaaaccctacatttccccatctgtaaaatggggctgttatatatacctatattatgtggtcaactcacttggtaaagcatctgtagtatttagcattggaaacataagttgtattcaataatgttatctaaattattaagtataacttattaattataatatcaaataatattgatagtatttgtttattcagctgatcttcactgagcccctataatgtatcaagctctatgttagctatctgtgagacatatctatctcacaatatccctcacagtaaataactctgtaaattgcagcatgggtcccagtttgcttcatggagaacttttccacataccaccccttctgaagacagttgtcatgaccccatatatgcttctgtcctttagaatgaatacttggctgggtccatggttcacgcctgtaatcctagtactttgggaggctgaggcaggaggatcacttgagaccaggagttggagatcagcctaggcaacttagagagaatccgtctctgtaaaaatgtaaaaaattagctgggtggggtagtagtacatacctatagtcctagctactcaggaggctgagatgggaggatcacttgagaccaagagttcaaggatgcaatgaatcatgatcgtgccactgtcctttagcctgggcaacagagcaagaccctgtttttagaaaacacatttaaaaataaaaaagtagaatgaatcctcatacctcttcattccatctacattagcgttgaggccttgttccttcattatctcgttgttccgaaagtatattaaagattaatttagcatttatggatatgcctaataggtggccagcaccaggcaaggtgctgtggatgcgaaggtgactaaggtgtgcttcctgttctcacgggggttaccagtctagaagggggagactcttttagcccttgaggggagaaggacaattcaggagcagagaggccatctcaagggaatttccagataagaaagatcctctgggcagagttgaattaactcccagacaggagaggagtcccctgcagccacccttagaagtcactgactttatcccggcatccacttctcttctttatccccatactggaaaggctaaatgtggctccattagagtctttcaacaaatctatttcagcattttgccattaggggaaagacaatgtaacttcaacattaggagcacagactctgaaccagacatctgaatacatactcttgacggagtgattcaacctctctgcttgtgtttccttgtctgtaaaatggggatcataatagcatctactgcaatagaattaatgggagaattataagaggtagcccacaaaaagcatttagaacagttgggccctgataagctctcactaaaagtaagttactagctcttattcttgatgaacttgggttttagttgtcaaaattaagtaacaaagctactgcaacctattaacattttaattttttcccacagtaaagtttaatgttcttcgtgttaggcatttttttcttttatttgattatttgaaatgctttatttcaagttaactacttaggaaaaaataaagtggaaggaacacttagagaggaaactgtcctaagggaattgaagtctagaaataactattctgagagcacaagggccctcttgtactatcacaaacaaagaataaaagtcccagtttacttgtgttaacagtgctcaattgatattcagaaaaggggaccatccagagagaaaaaataataacgttttacaattatcatttacttggaaaaatattcattttggtggagcacaacattgaagaactcaattcagaccagtatgggggcatagacccaggcgcatcttccttcaatttgtttgtccggattagactgtggctttcatctgtccatggtgcagtttgtgctctggaagtgaaatcttgtcatttaggtaaatggcctggataaaaatcccacaaagatgtgaaatatacatgttaatagaagaagtctcttcctttttcttagctctaaaggtgttattttgacctaattatgatgttaactgtatttatcgggaaagttttctaatgcagaagaaccaactacagaatcctttctttaaaatgcatggctaggagacacattttaaattatttccatcaaccttccttttagtagcttcagcaaataagagcggttgatagaaagaacatacaccaccatttaggacacagtttctcaaatgtggaactgttgacatttgggatggataagtctttgtggtgggagactgtcctgtgcattttaggatgcttaacagcatccctggccttcacccactggatgccagcagcaaatcccctgcaggtgcatcaactgaaaatacctccagatattgatccggggaaacaaaatcagctctagtgtggaatgcctgacttggaataatgactggtcacctcagccttgcagattccctgatttctgttcctagatttgcattgcagtctggtaaaaaattgtctaatcgttgacaatgtacttagtaattaacatagcaagtggttttgttgatcaagtgaaaattagctcacctgtcaaaactgtaaagtgggaatccagtactccctagaaaattagaatactgtattgttaatcatagcagttaccacttattgatcactgaagtagcaggcactgtttcacctactttatctctattaaatcttataagacccctgtgagaagaatgttgtcacttttcaattggagacactaagcctcagagaacttgcttaatatcacatagcaagttcgtaaagaggcaggattttaatccggatctctgactcctaagcacaggctataaagttctgcaccattaatcggtaaattggagtatccacattcggctagtaagcggcagggtttttatttcctcaggtctaattggagatgaattgaaagtttgcagtttctaactggttaatatcagcatgttgatactctccccacccccagttctgctgttaacatgggacgtgagcctccgaccaaaaacctccattaggcaatggcaaaaatcttggcttttctttctgtaaaaagcagtaagatgccatacacaaagtgccattttaattctgtgcttggcccaaagtaggcacccaaaaaatgagatgacccccagcaaaatattctgccatgctttctgcttcccactcctaatcagcaagtatgggaaaagcagccgaagcaggaaatctttcagagaagtagatagagggctataagctttttcaactggaagtaatgatgtctgatctcagtagagtgcccaatgaggcatcttgctatagggattttaattcatttccctttttgatgtgcactgtcgtcaatccatgctaatcacagcagtactttctgtagtttttcatgcatctcaatccatttctcactaggtatcccccacgttgctctttgtctcccccaccctgtccatctcgctgtctatggcagaaagcattctctctctcagtcatgtacatatctcttctttagaatatagttagaaaatatgttcttgtccagaagaagcttagaattagatatctgttcaacataggtctatcaatgacttggagatgtgtatcagttgctattatttatccctaacaaatcatcataataacacagtgagttttgcatacaatttgcctatgaaaaccatatgtgtgatttacctttctagagcaagtggaataatttttcttttagcttattgctttgaattttcaagtcacattcttggtttgttaaaacctcaacgttttcccaaaatccaaaattctcaaaagataggggaataaagctttggaatccaaggagttaccagacatcatggcagctgtataagtttagtctttctggtactttacagggctgttttgaaacatgtgagtgcctttcactttgcgttaaattggacaagaataaaactaaacacacacagagcaaggttgaccctgagaaggtaacctatttcaactaaaaccacttagtgaaatgacagctaataatcaaagtcactttttatcaattccttagttagagggccttgaaataccatacaagggcattttaaatgaccacgatgtctatttttgtgcctgtgtatgggggtatgtgtattaggttttatgcatatactataaacgctgctttcaaaaaggagcaaaagagggagttgtattctgctggtctgtctgtcctccctgcctaccccaattctgttcgagccagtgtctgattcacccatcaagaagtatcttattccatgtccattgcctcccacccaaatctctttagctaggggtttaattcatagagtatatgtttagaggctatcacagaaatagatgcaatggttatcaatgaggggaagcacattcgacttgtattttgtggtatattttcatctgtatgttagtggtcattggagaggatgcaaggtactctgttgaatacagtttttactagatacttctcagtcactaaacactttaatcacacctaaatgctttctgaatgtacttttctcagatgtagaatacaattccatgtgtaatcaagaaatgggagggctaaacgacttaaagtcttacccagtaatcatggttatagaaattgtttgaatcaatctagtaatggtacgtgtctgcagtggaaggagtgaggtcagtcaacgatttctccatagttactatttcaaactgtatttcagggcatgggaagggagatcaacttgggccttttctacaaaaacaggcctataaactgctgcaaccagctagttaccaagaaatgcacatacacaaccaaaggaggactcgctgctttaaaacagcccattcagaactagaggaaaaactctgacgctagcttggggaaggctaaatatttcttttactttttttttttattattattctcttgaaagtgtaaatttttgctctcttttaaagtctgtgggctccctcttgtggctttgtggaaaatttcaatttcaaggaaacgctttttctctctagcaataaggaaatcatttccaattaaaaaaaaaaaaactttcattgcttttccttgtaaaagaaaaagtgagaagaagaggtggatacgagaaggaaggaacaaaattaactttaatggaaagtcctatttggtgaaaaggtcattttatatacaatcctgttttacaataatagccaacatttcctgaacacccactgtttgctactagttgtactagataatgcattcaccacattattcattgcctccatgctcaaaataaactgactggctagttagagtagtcattttatgggtgtgagactgtactttcctgcctcaaagggaactggttgaggagatcctgtacctctcttttaatacctgtgaatgaaaaagtaaacatctcatattttcctattttaaaaatgattttttgtatcaaataatttttcttaaataaatcctagagtaggatataggttttatctgaaaaaacatgggaattgttcaacagttaatttctgttactgtttgtctctctctagttgcctgtctcgggaaacttgattgatctttatggaaaccaaggtctgcccccaccaggcctcaccatcagcaactcctgtccagccaaccttcccaacataaaaagggagctcacaggtaaacacctagtaaatgtgcctcttactgcagatttctgtccatttcctgataagacaaagttattgatatagtgatgtgcaaactatatccaactcatggacgtaacttttataggtctctgcagtggttaaaacattatgcaatattttaagacggagaatttatacttgaaaattctgttttttttcaaggagatccttgaaaatctcctgagatactgggaatcggggccaccattactgcatgtcaccaatcactgtgtgtgtggtgaaggtcccctttgtgttggggatagtaggcaactctttcagctgtaactgtctccaccctacctgatatgtatgtttctaacaagcccctagaggcatttgcatttgagaacccagatctgaattttcctttgacacacattcaagcccacaattgggatagcataagaatatatttctcacatcttcagatgcctcctgttgtcttttgctgtattgtgtgcaaaagatttattacacagaggggaaaaaattataaaatggagcaatggatattatttgttcttgaggcaagtgtgaaattacttatttctctactttgcttaatgctttagggaaggcatttatttggtcattaaaacatggcggaaactatattagaactggcattctaccatggtgaattttatggcccttaccacacccctctttttattatttgatccttgcatcctgcaggattggatgaacagactgagaatatggaatatggatttggtacagagaattcctgttccagtcaaggatgtcttaaaaaaattttttttagaaaataagcaggagaaagatgttttttaaaaaccatggatttgagtgaaaagagtaattaataagtaaaaaccatccaaaaccaaaacacaagtagctaccctaccaaaaaggaaaattactgcaagacaacaacaacaacaaaagcaagaatcgtcgggcaggcacagtagctcacgcctgtaatctcagcactttgggaagctgaggcaggcagattgcttgagctcaggagttccaggctgcaatgagctgtgatcacaccactgcactccagcctgggcaagaggaatgagtcctgtctcaaaacaaagcaaaacaaaacaaaacaacaacaacaacaacaacttaagaatcattgaagtggagggtatgtaagtcatgcttctgtgtgaggaaaaaaaaactagaaaatgatttgaactgaccatcacaactgaaagaattcaacttctgagttatatatatatatatatatatatatatatgcacacacatacacacacacacatagatatgcatatatatgcatatatacatggatgtatgcatatagatatgcatatatacatggatgtatgcatatagatatgcatatatacatatataacacccatataataaatatatatggtgtgtatatatatatatatatatatgcttcagtggctataagttatgctaaaaagatttctattttgagataaaattctaaattatggtagtgtaatgcttcagctatcacttctgaaaaggaaataacagagctttctggatccccagattggtcaagtaacatgttttgttttgtttttaattctgttttgttttgttttgttctctgtaaggcaaaaagtaatctcttatcccagagatgtcacaagagttgctatgcaaatagagctttccaattgcagttgccaccaaatgcctctattcctattttgtttttatagactcaagctagtaaatagtggttcctaagttattagatgatttcattacagcaggttttaacagaatctggcaccaacttctgaaaaaatgagttcattctatgaagtagtgaactagttagaagagacagagatccaatttggcagcttttttttttttttttttttttgagacagggtctctctgtgtctcctgagctggtgtgcagtggtgtgatcacggctcactacaacctcgacctcctgggctcaagtgatcctcccacctcagcctcccgtagctgggactgcaagcatgcaccaccatgctggacttatttttttttattttttgtaaagaccaaggctgatcttgaactcctgggctcaagtgatctttccacttccacttcccaaagtgctggaattacaggtgcaagcaaccatgctgggccactactcagtttttatatcagcacgttacacaggcatcaaaaaaggattgaaagcttctatggcctgaaaagaaaatatatcagacccctgataatagagtatcaacagcaaattgacatagttttctaattatcgatttctttcttgctagtatctgtatatgtttacagtgtgctatatataatttttaccagggtttttttttaccattttgtggaagcccagtttttacatattgtatatatgatatatatattgcttttgaaaacatgcaagctttttaaaaagatatcatttttaaaaaaacgtatttttacttagagtcaagtcaaataagcttctgtatgtttgggaaatgagatattttgtagtttacattttgtgcaacttcaaacagttccaacttctaatgacttcattcacgtgcacagcgtgtatttttcccacagagtctgaagcaagagcactggccaaagagaggcagaaaaaggacaatcacaacctgagtaagttggttttatttatgttcatgacatttgatattaatgttccccatatatcaaaaatgtttccagaaattctgtagaggagagttgattcctacagctgttaaaattctctcttatggaagaaaattgtatttgacagaaaccaaggtatatattttccccatattttatctcagatcaaattgaattttgtatatatacttattttcagtttctgaagagtttttatttttcttgtttctagtagtggttttctctctctctctctctctttttggtaagagggagaattgatccccaactacccaattataagtgttgctcacactggaacttattaacaaaaggggattagggaagcaccttctccaatgagatttgaaagaaaaagaaagaaagaaacagatctgaaggggagtaaatggatgaggcagcctcctaaatttctgacatgattcgtgacttaaaaaaaatagccctaaagcatttaaaatattttttacgtgtttaatttactcttgatcaaatcttcaagttgtctcctacgaatactttaattttggtttaatataaacatgtaagacaagttgcacagatttttttaaaaagggattgggcttggaggtaggaaattgtgtgtgaatttctcatctcatggcctcatgtcctctgtttcttaaattgatttttaagaatgtgagtcatatataaacactttctccttataaaaatgatagaataaggccagagttcccctttagtccccaggaatatgcgtgttggtttcaatttggcattgctcttcctgacctttttctgtgtattaagaatatagacacatgcacacagaaaataaatcatatggatttctatatgttttaacacaaacggtatcatattgtccattttatgttgatttttttctactaagcagcatgttttgaagaccttttgctgttagaaatctagatctatctactttttgaaaacaaattgcatagtattttatagtgtgactgtatgatatttagtaacttcccaactgctgtgtgtttatgttgtttctagttttttcctatcataagcaatgccacagttaacatttttatatgtgtctctttgtgtacaagaaagtttgtttctctaggttagaaaccgaactgagaggcacaacttctgggtcctgtgggtgctggtttttactttaaaagctacacccctccccagttctcatgtcaagtgtaagaagctctccttatcttttaaccaagagataaactattatctccaaggcctcctccagcttctaagtaattttaccctaagatatttcttcttttaaaacaccttagaaacaagataattaggcattatccaaaactacttaagtgagatgtggaaaactgagttggatcttgtcaaaaacaatagatacctgtaattaggcacctgaactctcaaggtcaaggttgtcagtaaagtgcaaacatgatcagctcaaactctgaaggctatgaagcaatctaaaagtctcagccaaccattgggaattaatactcaaggttagattgccccttggtcaagctgttcctcttctaggaatttattttgtaagaatattgccaaaatgtacaaaaggatacattcatttattcactcattcaatcagccattactgtatgtatgtgtgtatgtgtgtatatatatatatgtatgtatatgtatatatatatatgtgtgtatatatatatatgtatgtatatatatatatatagagagagagagagagagagagagagacagagacagagacagagacagagaaagaaagagagagagagcgcccctgttttgtgtgaggcacttttctacaatgtgaaccagaaaatgagtttcccatcctgggaagcttgcctttgagttaggggtcatctaccatgtattgctgagtaagatgagcaagggtcagaataatatgtataatatcccattgtgtaaaaatagcacactggggagagacgtgcttgtctctgtgtttatatgaatgtatatgtgcttgggagacaatctagacatcacccttatcagtgacaatttgcccaggcatatagatgttggatagtataaagacttggcttttactttttctttaatacacctttgtattttttgaaattttttactagcttatatcttctttctaataaatgattggaaagggaagtcatggaactaaaaataaaatgtagtacacctaaatattgacagtgaaaggtgtcagctatatgctggtgagtgaaaaaaagatgcagagtcctttttagtatgatcccactttaaatgttttgtttcttatttaacacatatttgttgagagcgtactatgtgccagatgcacaaggttacttggaatgcaacagtgaataaacataacaaatagatcaatgggatacatgaatatgggatggcagaaagttccacgtggagtcaaagggcaggcaagggagtatagtgtcagcatggacatgggaggtagtgaatcagtttcaaagagggtgaccagaaagtctcttaggtaaatctgagtctacctgagggaggtgagtgcagtgctgttcacatatctggaggtacagtgttccaggcaggtggaacagccttatgaagtcctccaatggggcgtgtctggcttgcttgaggaatagcaaggagccagaggggctagagtaattttatgattattatgtgcttggaaaaaaaataagaagaaagtatcatacttcagagttttggggaaggttagctagtggatcaaggaccccacaattccttcttcaaaaccattgaccatcatttagggtttctattttatacaagcctaatggtaggacttcgtattatataaaacggatttcatcattggaataatccctcagccaaaacaaactgcaatttatattgggaaagcagggaatcacattatttatctaggtgtacagactattagtggaacaaaaagaagcatatattctggtatttagagtaactattaacaactttaatccattttgttagactttaaattatttggaatttatttgtttgactacattaattagagacatttatcatgtcatatgccttattatgtcatcctcccctaagaacatgatagttgaccttacactgagatttataaaataggaatgctgtgaagattcatggtacagctaaaaatgctagacttcagttctagggctgtgctatctagtacagtagccattcaccactggtgcctactcagacttgaaatatggctggtccaaattgtgacgtaaaactgaaagtgtaaaatgcgccctggattccaaaaacttagagtgaagaaaagaatgttaagtacttaatttgtaaatgtttacgttgattgcctgttaaaataataatattttggatataatggatttaagaaaatgttaatttcatgtctttctttttactttttaaatagtactactagaaaatttaaacttatatgtaaattatattatatttctgttgggtagcactaggctagggcatgggttttttgtgtggcccatgagttaagaatgttttttacatttttaaatggttaaaaaaggccggacgcagtggctcacacctgtaatcccagcactttgggaggctgaggcggatagatcacttgaggtcaggagctcgagaccaacctggccaacacagtgaaacccccttctctactaaaagtacaaaaattagccaggtgtggtggcatgtgcctgtagtcccagctacttgggaggctgaggcacaagaatctcatgacccaggagatggaggtcgcagtgagctgagatcctgccaccgcactccagcctgggtgacagagcaagactccgtctcaataaataaataaatgctaaaaaaaaaattgtgacatgaaaagtatatacaacgcaaatttcagcatgacaagtaaattctaatgcttttcattgatttgccttgcaaaaaattgtactcgtatgttatattttgaattttgtcagtaaaaaatgtgtggaaatttgttttccctccgcttaagtaaatatctgcataatatcctcaattttgctacttatcccacaaagccagaagtactaacttcctggctctttgcagaaagtttgctgacttctgctctaaggggttaggttagaatttgggctttcaccagatattgttggatgtcctcgccaagtccctaataacagtatctccaaggcaatttcattatttgtaactaaggatagtaactgatttcagggttgttataagaacaaatgagaaatcgtctgtatctaagggctttggaaatggtaaagaaatgtagctcatttttaactgcaataccaagaacatagtaaaaatagggaaaaagtaggttcaggtttccgttgtcatgacctggagaagttaatatgcacatgcctttaatgagatgtgctaaatgcatacatggcactgttactaatagcctttcctgtgctcttttcttgaagttgaacgaagaagaagatttaacataaatgaccgcattaaagaactaggtactttgattcccaagtcaaatgatccgtgagtacaatcgcgtgttaatctgcatcatatatttttcgtacctgaatgttttttcatacgttgtaaaaaatgcagttgtaaaaactaaagtaaagaagtctcccctctccctttggttctattcctaaattcttcttacacctttcttttggttagtctcatcaagctaaaatttcaagacaaaagcattgaattgtgcaaaaggattgttggacactagatgttttggttgtgaggaggtggctttctgaaacctaagaattctttgcaaacaaatactgagcttaaaaaaaatttcctttaatggttcatgcagaacagaactttcaatagttgttaaagctagatttgttgactgtttgctctttgacttgtacagtacctctaaataggcactgatgaacagacattagagacttaaagtttaatgatactccacagacaaaaagggtcaattatttttatgaaaacttgcctactctttgtatgttttaccattgtaggggaaaaaaagtagtgttttaatcctcttattaagtacaggtcagctaatttagatttcagcttttggtctctctttacccaccctgtccccttcagagataacagctgtaaagatgattttctcaagtctttcctaccagcctatagttacctgcaacatcagcagataggacaacaaacacacagtttttatccattagaaattggcccatttgaagcaaggggctagaaaatgtatacattttaatggcccccacaggcattctgtgaaattagcctttgaatatgaccttttagctacctaataaaatgtaaagatgaaatcaagtattattcatgccaggcttattaaatttgctgttcacgttactgttagaggatttgtaacaaaataaaataaaaccattacctattgtgaggtggttttgatgaatgtacaagcacaattccatcttcaatgttttgctttcccaggtttcaaggaaaggcattttcaaacccgaaacatttcagattctcagttctgcagcacaaatttatcctactaaagggctgtgaccttcatttcctatagtcagtcttgcatgatagttgaaattgaattcccattttcctcttctttatcagctttcactttttagcatattcttttaaactgtagcatgtgaatctctttagcaacatattatgaaattatggggctgcagtgaaagcctctatttgcatatcttctttccccgttgtattagaatacttgcgggtttataatctgaactgataatgatctttaattgtaggcattgttttaagacaaaacagactataatctatatggtggtttcccacaccaggtttctagaatgtgccttggggctgctatagagacacagtcttacagactggggtctcagcccggtaccttttctcccaccagagcaagtctgcatttgttgattttatataatggagatctatattcactattctgtgaaaaaagagtccctcttattaccaaacaaaaaaaaagtttgaaaaccctttcttaaactcagaagcataattgattgattggatctcacaaggaagcaaaacccaagataattggttgaaacaatcacttcttttaaactgagtgacccttcaaatatcccaattctgatttctcttcttgctggcctatgtgaagcatcatttattttaactacatttctctctggctgctaaagttacttctcttactttgatcttagctctgaatattaagtctctgcgctcactgtgggtatctcaggacattcccctgggttgccatctttggtgttcagaccccagggatcaactccagggaattctctgggggctggaactgtccctcttatgggagaacttctgtgttgttcttcatgtaacccagatgaggatcaattacttggtgacttgtttaatgaccctccattcaccggttccacctgatacttgtagatgaggaaatggacaaagagaggctagatagcctgcccatgataatccttgattaaaaaaaaaaaaaatagaaggatgctgagtttatgccataaacaatttagtagtgagatctcacagatctgttttaccatcgtttattctcactgagttaacttttgtagttttagaaacctataactctttaacatagtgtttaaggaaactgactttgtaatcaacagacctaactttaagtcctgactctgccatatagtactgtgtggcctaggacaagttgaattgtgtctgtttcaacatgtgcacagtctctctcttacaaggtgcttgtctgggttaagtaagacaatgtgtacaaactgggtgggcaacactaggcacgtggcaaacactcgtgaatggcagctataattaatgtatgattattttatttttaaaattgaatgcttttaaaaatgatacaatggactttggggacttgcggggaagggagggagggggtgggatgggggtgagggataaaagcctacacgttgggtacagtgtacacggcttgggtggtgggtgtaccaaaatcgcaaaaatcaccactaaagaacttatccatgtaaccaagcaccacctgttcccccaaaactattgaaataaaaaaaaattttaaaaagttcaaaaagaaatggagtgctttgaatattgaattttcattgagcctcaaatcctaaaaatatctgttttcctccattttcatcgcagagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggtacgcagcctgagttgtgtaaagtttactgctttttaccgacttcaagacagtagaaacagggatataatgagccataggggagttgacttacgtgatcctaacacagtcaatccttattatttgtggattctgtgtgtgtgaatttgcctacttgtaaccccaaagtcagtatctgtggcacttccacagtcattcttggacatgtgcagagtggcacgtttgagctgcccatggcacgcatttccaggtgaggtcgaatgaccctgcctgaggttgactgtctgctgtcttgtttcagctctcatcctctaaacaagtgctcctttcgtggtctgttgagtactttctacatttttgtggtttctgttggtgatttcgctgtttaaaatgacccccaagcataatgctaaagcactgtctagagttcctgagggcaagaaggccgtgatgtgcttacagagaaaatacatgtgttggataagcttcgttcaggcatgagctacagtgctattggctgtgagtttaatattcatgagtcaacaacatatattacataaggtgaccttcaacagaaacatacataaaacaagattaagtgttgtgactagggtctcacaggaacctaacttgtaattcccctgggaacagtgcttcagtgttcaccaattcagtgttcacagtgactttgtagaacataaaaaaaataagtactgactataccacgttaaacaagaagatgccttagtatttgtagggtccgggaagcagttgatggtcaaaatctgtgtttacagggaacttgggaacacccagaggatcttatattaaggacataattcctggagatagttataaatagtggaattatagcatatatatctttaacttaaactatacaccattagaagaagacatactaattttattaatatgtgccatttgtgcgtcatcctactcagtgggtatatgcaccagtgtaagccggagatggggaattcctctttggtatcaactcctggaacttctctcaggggcttggcgtctcttgttgagtgaaagggcactacttcctctgaaatgatcctcaaaaacagactccctgttatggaccaaagggggtttgtgagggtaattttaatttgctgactttgaacacaacctatctgtaagagtcagtgacaccatatcttcttcttgagtaggctgacccaccttttactagattttgccataaagcaagggttgtctttcaacttttccagtgcaactattcatggagttattttacgaaacagcaatgagaagtatgacaccctagcgaccattgtgtttcacctagtggtgctcctcccggacgttgaacttttcaaacagagcaattcacttataataatggtctccagtcttctgaatgcttatattttgaaatgccacatctctcattcactgcagtgattcctcagctgtggggtggggaggtgggaagccacttccctgttggggtgcattttagattctgggtagtgaagtagaggtagtgtgtaatttgaaagccctcctttcccctcccctcctctactttggcttttgttgttggttttatgttctgtctcttcaataagtagctataggtatttaatctctcgaacatagtctgcctatttataaaagcagcttgtgggccgggcacgtggctcacgcctgtaatcccagcactttgggaggccaaggcgggtggatcacaagatcaggagttcaagaccagcctggccaagatgttgaagccccatctctactaaaaatagaaaaattagctgggcatggtggcgggcgcctgtaatcccagctactcgtgaggctgaggcagagaatcacttgaacccgggaggcagaggttgcagtgagccaagatcgcgccactgcattccagcctaggcgacagagtgagactccatctcaaaaaaaaacaaaaaaataaaaataaaaataaaaccagcttgtggccgggtgcggtggttcacgcctctaatcccagcactttgagaggccaaggtgggtggatcacgagttcaggagttcgagaccagtctggccaacatggtgaaaccctgtctttaccaaaaatacaaaaaaaaaaaaagaaaagaaaagaaaagaaaaattagctgggcatggtggtggatgcctataatcccagctactcatgaggctgaggcaggagaacccgggaggcagaggttgcggtgagctgagattgtgccattgcactccagcctaggctatagagcaagactccgtctcaaaaaacaaacaaaaaaaagcagcttgtactaatgtgttgtttccttctacaagtattaaaatgtaataactattttgaaagagaagctaggttttgttttattttagggttccaaacatgtatattcatatgaaatacgaatattgtgaaatatgtgcattggaaattccatggtgacgatatcttggttttcttccagtgacggtgtgaggcagcctttagaacttttgcatatcacagaaaacattattaattaggaaagctctgtgatgcaattaagccagagttctctagatgagatttatcaccttatttagaaatctgagtaatgctttaatcgctgataaatatttttaattagacaacaaaggattagagtgagatgtttgcctctcttaatccaactttattattctttttctgaaaagacaatctgcctgtgtggaggtactgttcttattagcatgttggtgtagatttacaagagtccatgttttcagtatgggcctaagggctttctttcattttcactctaagtgatgcatgcaaaagttttcacagaagaaagagcatgaatcctttatgtcagtggaactgccattttattaaatagcccagggctttcaaatggtgcctgaagaaacttgtgtttctggagattatgtaaaggaacttgaaggtacttgtgtgacatgtcaagctcctggcttttactcatattgtatccaaagaaggattttgcagacccaaaaaccttgaatttagactgaaacgtggctttgcaggcacatatgtttctcagcttgtgggcagaggttgagaggccatgtcatatggagagtccttcccctctctgataaggaaaggtgacttgcttcaaatttatattctcttgctatatattattgtttcacaaccgtggaagggatagcattggaatggagaagcagaatgcttatcaggaatcaattaaagtctgtgtggttcattttaggagtgcccagggatacactcagaaaggaaaaagggaaagagcttgcttggaaggcattttgcaatgagttacagggggaatcaagggtatttaggaagtgtattacccagctagtgctgctgtagtgaaatgccactgactgggtggtaaacaagagttattttctcataattctggaggctagttgttgtccaagatcaagttgtcagcagggttggtcccttctgaggcctctctccttggcttgtagatgcctgtcttctccctgtgtgttcacatggtcttttttcctgtgtgtgtctgtcccaatctcctcttcttacaaggacaccagtcctattgggtttaggcccactagtaaaatctctttttaaattaattgcctctttaaaggccctatctccaaatacagtcacattccaaggtactaaggttaggacttcaacattcaaatgttttccaggacacaatttagccaataataggaatgtatgtgaggaaggaaaggaaaaaaattgttcatcttatagatgagaacgtacttgttgagttaaaaaaatacttcccctttgccatggtgagatgggctaaatgatgcttctaaaactttagttactggcatagaactttcacagcttttgctatcactacccaaattttttacttcatggcactcttagtgttttagcaatctttttaccatccccctagaccaaaagaaatacctactctttttgttaggtccgaacaacttattaagtatttaggttctaacaacttggtagccatttgaaaaaataaaacatataaattgaaaggaaatagcatttttattttgttattaaataaccatattacttactaactggatgtgtgtgtctgttgggcactgcacgacttctaaagtcttggaatcagattggacaccatcaccccatcgcccttgtttcccaggccacaatgatgttcatgtggcacttgttttccttcaatcacagcaactgccaaaagctcaactttgcaatgatatcatgtggttgaaaagtatatagcacagtctgatgctagaagagaactatcttgagtttagtagttctcaggtagtattgccattgcccttgaaatgttaggctatctccagtgctctgtgagttcattgcagcacacatggggacctcagtgcaaagctgaaggaccatgaaagctgaaggaccatgaactctttactgaatatgtttcttttttcttttctttttttttttttttttttttttgagatggtctttcactcttctagcccaggctggagcgcaatggcgcaatctcggctcactgcaacctccacctcccaggttcaaacgattctcctgcctcagcctcccaagtagctgggattacaggcatgtgccaccacacctggctaatttttgtatttttagtggagacggggtttcaaccatgttgaccaggctgatctcaaactcctgacctcaggtgatccgcccccctcggcctcccaaataatatttttcttttatcagctcgcatttaaaactttatttttgtattttttaacttatcctcagtgtgaacattaatatctgtgagagaccatctctatttttcatacataatcaaatctataaaacacctaaaaatttatttcacatactgccagtggtacttctcctatactttagaacatacagagctcattaatttaaaagaacaaaaaacttttattttgaggatttattgttttccaagtatctgatttttaaaaatagactttatttttcaggacagtttttggttcacagtaaaattgaaatgaagctgcagatatttcccatacacctcattcccccaagcacgcacagccttccccattatcaacattccctaccagagtggcacatttattagaatcaatgaacccgcagtgacatttcattatcctccaaagtctatactttacattccctctggtattgtacattttgtgggtttggccaaatgtctaatgacgcgcatctaccattatagtatcatatagagtggtttcacaggcttaaaagtcctctgtgctctgcctatttcagtgttttatctttactcttattataggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatagtggtggcctattgtgttaatgccaattttgaatgctatctgccatatcaaaaaatggtagtgcacattttcttctgatttaatgaataacaaattgcatgaaaatttagaaaatgccagtaagtactttttttgtttaaaatgccactctaagatgttactttttggttttaaacatttttgattactttttgacttacactcagatgaggtgtaattatgcaccttttttatccccctctgaatttggggagattttaaactcccaaatgccaagacttcattttagatataggagttttatttaaaatgtttcattgagaggtggctttaaaaaagagaaattgtcagagaaacccttgcatatttacagaaaagatattgggtttttaaaatacaaatttacaataatgaaagcttaatatacccaggctgccagctcctggttgccttttttttttaatacactacttaagaatcatttgataaatgttggatttgaattgggaagtgtcagacaaaacatgtctttattccctagctagaccttaaacttctgcccttttaaaaaatatattctggcttaacctctggagaaaatgagcaagaaacttcctgtaatgcttctgatctgactgtcagctttttcctacttttaattttcttcttaaattgtaatatacaataatcaaggcctttcttttttagacctatttgaattatttatattttccctagaagtataactgtaggatcccttaaaaacatgtaaaagtagaaagatttccttttggaacaagagagaatattctgggcaaaatcaaaagcaagtaagttgaaaattggggcttttcatctccgggggatctgcagcaataccttcacccacatttctgtcctgatatttaccagtaaatagtcatttcacagcccataagaatccttcatctttagcttcccccacttacacacagacacacacacacacacacacacacacacacacacaattaacgtgttatagtggtgttacctgaagattagacatttgcctacagtgtgtatgacttcatttgatatccacagagttacatttcttaaaattttattaagccaattcactttcaaataaattatatccgttcaatcaccacacatgacctctcagttaatcttcctgggtttgaatcttatctctgcccatgtctagctctatgattttgcgcaagttatttggcctccctgtgcctcaaaagtagctaccacatagtggtcttgtgaagaccattcgagttaataatactagaatttgtgcttgacagcacatagtaaatgcttagtaaatgatagcttttcttataataatcaccttcattactaaaatggaaaatactttctggaccaactaaaatcatcatatgtattagcagtgacatgcacaccacatttggcaaagcactgaattacaacatagattgaagacatgtgtaaactggccaggggacagaagccacaggctatttaggagaaaggaaccttgctgtttgtaagacctagggtaggaatattttagagaattagtaataaactcaaagtatcacattaaaatatcttcagcacaaatgacctaaaatttaaattgttttaaacctgtacattctgcatgtatgcttctgccatgagaataattatattattttcataaaatatgccttagtgaagctgaaatctttattatattctttagaaaattaaactgtttaatcctttgcaatatacactgatattatacagctaagagtggtgtcttgactatatcctgtcttcagtttcctatcaatattgaaatgtttctcaggattttattttcaattgtacttacatttgatgacttctttggaaaaccatctgagaagttaatcttcataatccagccaacataaatgaactcttagaattactctgtttttatttttttgtgtatgccaagacttaatgcatagccaagtagcatgaggaaagctcctttaagaggagcgttgtaaagttagattttcattatatttagagagaggttgtgatgatctcttaattctttgctgccacatctgaggctcaatagcagtggctttatgtctgtacccataataacatgaatccataatacacgtctgaacagagtgtaagtgaagaagcttttattatcccagttttcccaagaggcatatatcctcctcccctcaaaaaagtgtagagtaaatctgccatattaaaattgtcaaggtcctgtatatacataaaatgtagacatggttaattgtatttgtgttcagtatttgtaggtcttttgagcctattacctataccagatacactggaaagtaatatgagtatacacaaaaccaaataaatttcagcaacgcatgtaaatggtaaagacagtttgcttttgaaaaatttgcattttaaatttctaattatggagtcagttgaagatatatccaaatgggtgcaattgtcactcaaaattccttacatattattcagacagcaaaatctatgtaaatagaagccacgaaactagtgtttcccaaacttcactttatggaactagttccacaagctgttgcacaagttgctttgaggaatgggggtttggaggtgggctggggtcaggaaatgctatactgtagttaattttgaggaagttagctttgggaaatgctgagctaaacaaatgtgaacaagtatttctactgcaagacttctcacattctaaattatgctaatgggattgagagttcgtaacatttcccagtctcatttggccacaggattgtgtgtgtgtgtgtgtgcgcgcacgtgtgtaagacacctgctaattgttccaaagaacacagtttgggaaattctggagattttacagaaattatttaaactcaataaattttttttttgttttcctaaggcaagtatgcttacgtttgtttatgattccataggtagacgtcattgtcattaaaaaagtattactctgaagaaacaaattagcttaggttttcatctccattgaaaatataaaattctgattaaggaaaatattggcattaagaaactgttattcctgaatttaaaaagtaacatgttttcattttcaaagaaaatattcactctggttacacacatgttcaatgtaccttttgtatgagtggtactataaaaagttctttaagttgaatgtctcccacatctttaaatatggacaacctaatgtttaggaaatatttggtttataactttaggttcagcttactggtttttgctggaaggacattaggaagaattgtatggtattcagaattgatgtagtcttgtcaatgactctttttcaatgaaggtaagttctgacagagggatcaggttgtatctccaaagttcggttgttaattggttataggccaacccacaagagctatattaattcttacatgcctgtagtatattataggacttactaagattgttttagaatttaaacactgtattatgaagcccaagggaaaatacattaacacaccttttccactccttacagatgagatcacagatttctttcattcaatgtcttttaaaaatacttttcagccctcactcttcgcctaggaataaacggtgagcagaggaatttcactccagtggaatgaaggaatttattggctcatattaccataaagtccaaatggcaaatataacttcacgtatgcctgggttcaagggctcaaacaagcattcaatctgcttgtctctaattttcttggtgccaacctcctcttggaggcaggtcttctccatgaggtcccctctggcagtttcaaagtccagtagaaagccagcacctctttcccagttgctatggtgaagtccctgtagtagttctgatcagccctacttggttatgatcaccataacccaaaaatggaacacaccagtgggccaggtctgggtcacgtgtccactctgctagattcattcagcagcacctaaaccttgtagaccaagagacaaggaggtgggactcacccagactccaaaggatactgttcccaaagcgggaagaggaatctctgtaagcaaaacaacagatactcattgcttggacttcaagaggactggacaaactctacccttgccaatcttttgccttttcagatgcacagatttgggacttttttcttccttcacccttaaccccagggtgatagaaagggagggaaggaagatattaaatccctacagctgcatctccctcttcctcattattcatggctcatttctcataaccagctctccggctctcaccccctactcaatcctctgccagacagagatcctaagacccaagttttgcaataaaatacagtcatgtgccacataatgatgttttggtcaatgatggattgcatatgtgatggtggtcacataagattacaatggagctgaaaactttctatcacctagtgacattgcagctgtcatgccatgagctcaatgcattactcacatgtttgtggtgatgttggtataaacaagcctaccgcactgtcagtcatagagaattatagcacatacaattatgaacggtaacataatacttgataataaatgactatattacggatttatgtatttgctatttatcattattgtagagagtactcctaattgttaaaatggcaggtccttcaggaagtattccagaagaaggcattgtcatcagaggagatgacagctctatgcatgttcctgcccatgaaaaccttccagaggaacaagatgtggaggtggaaaacagtgatattgatgatcctgaccctgtgaaggcctaagctaatgtctctgtttttgtccttgtttttaacaaaaaagttaaaaattgttttaaaatgaaaaatagtaaaaagcttatagaataaggatataaaaaagaaaaattattttatttacttttatttttattctctttgagacagagtctcactctatcccccaggctggagtacagtggtgcgatcttggctgactgcaacctccgcctcccgggttcaagcgattctcctgcctcagcctcctgagtagctgggactacaggtgtgtgccaccaagcctggcgaatttttgtattttttggtagagacggggttgcgccttgctggcccagctggtctcatacttctgacctcaagtaatccacccacctcggcctcccaaagtgcagggaattcaggtgtgagcctctgcgcccagccaagaaaatatttgtgcacagctgtacaatgtgtgtttcacactgtgttattacaaaacagtcaaaaagttaaaagcatcaaaaagtttataaagtaaaaaattatagtaagccaaggttaatttattactgaaaaaagaaattttgagtaaatgtaatgtaacctaagtgtacagtatttataaagtctacagtagtacagtaatgtcctaggccttcacattcatttaccactcactcattgacccacccagagtaccttctagtcctgtaagccccattcacgagccctatacaggtatcctatttttaaaatcttttatacagtacttttactgtactttttctatgtttagatacacaaatgccattatgttaaaattacctacaatattcagtattcagagggctcaccaagcactcactcctctaaatacaaatggactcttacttctgtcatttctaaagccaactttgttatcatgatgttttcagttgcccattgcagaaacgaaactccatttggaaaaaaaaaaaaaaggcagggaggagagaggggagtttactggttttcataacaaaactccaggggtgaaactcagaatggtgacttcaggtgctcaaatgaccacttcatgcatgcattgctccctcttcttagatgtgctctcctctgtgttggcttcatttttaggcaaactctccctgtgaggtggcaaaatggctaatggccccaaacacaaccttgcagtttatcaaccagcccggaaagagcatttctctcctcccagagtctcattggcccaaactggccagtatgtttaatcctggaccagtcattatttccaggggcatggaatacattgacaggctactcctaatcatatttttacccattgggctgggattgactcagcctttttggaggggaaggaggcaaccctaaaaactgagaagccctcatccaagttgtcctttctgactatgtccacttgcttttccaacaatcagctccttatctttcaggtttcagatgaaatttcaccttctcagagaagaggtcaatgaccaccttacataatagaaaggagactctatttgcctttccttaacctaccatcttgtttatttccttcatagccttgggttgccttttctccttctccttctccttctctttctccttctccttctcgttctccttctccttctccttctccatctccatctcctgctccttctccttctccttctctatctccttattctatcagtttgcttctccttctccttctctatctccttattctatcagtttgagctggtttctcgtccctttcatagaaagtattcatatttgtgatcagtagacaagggttggcaagttttgccacaatattgtcaataagaatacagtcttattttaaaaaaataaaataaatgaaagtactaggttaagagaatctgtttgctaggactgtggaagtatttgtttataagcagcatgttatcacatcttatttacatgagttcttgggagaataaaacttccacatgaattaacttatggatagctgaacttagcgctttaaatggccaaaattttattttcactatttttgatgataggctttctcaagtgtatgattctctacctcttgaaacagactgtaaagaatataattttacctgtgcttgatggctcagggtcatctttaagattattattactttgagctctaacgcaatggtgtccttggaggcttcagagatgtaatgaaggttttggtccctatatgaagaggccctagagagcagcactttcactccatcttctttccccccaaaccccttcagatttactgctccagctctgctgtgggcttgagagaattgctaatccagttaagtctttaatagttaacagaattgtgtcttgtataaggtaaatgtgcctcatgtaaagatctgggcattctgctgcctgtgctgcaatgcataagctttagtgctttgattttggctatgaagaaaacttttcctcccctagttgcctgttttttccactggacttcagctaattagaagttgctggatctgtgacctagttaaataagtttttctataattagaaacacaggttggactcgttagggtcatgagatttcattttgttaagccacttgtaagccattctttcaacactttgtagaaattctgttaggttagtccaactcagatgatgacagagtcagcaaacttttctgtaaagggccaggaaataaatactttaggcttttcgagccaaaaggcaaaattaaatatattgtattggtgcttacgtaacaagagagaaaacaaatttctataaatttttcattgatgaaatgctaagtttaataataattgaatatcattcttgtaatacaactctactatgaagaaaaatggaattcttttgggggaaaaataacattttgattaattgcggttcaaagttcctgtcccctagcctcaaactgattgtaaatgcttatctgtaaaagctgctcttaactcacaggctgttcaaaaacaagtggcaggccagatttggcctgcaggctatcttttctcaacccctggactgtggcagtctaatgtcccctgataactgttttctcttcttcattttagcaatagaatgccctgaattgtaggtcagcacatagccgtatttgtgggttccatagttcccagcctctgttataagtaggtgtgaccctatcattaaatgctgcataatgggatgtgagcagtcctccatttcttcctactgtctaggaaagagtgaaagctgaaatagcttccttggaccagagataaaggtcctatgttggatatggtggagctgcttcatcttgcatctccggaatgctgtgtagaaaaaaaaagaaatggttgtcttatttaagacctgtgtgatggttaatactgagtatcaactttattggattgaaggatacgaagtatcgatcttgagtgtgtctatgagggtgtttccaaaggagattaacaattgagtcagtgggctggggaaggcagacccaccgttaatctggtgggcacaatctaatcagctgccagcacggctagaatataagcaggcagaaaaatgtgaaaaagagagaccggcctagactcccagcctacatctttctcctgtggtggatgcttcctgtccttgaacatcgaacaccaagttcttcagttttggaactcagactggctctccttgctcctcagcctgcagatggcctattatgggacctcttgattgtgtgagtgaatatatatatattccattagttcatatatatatatatatatatatatatatatatatatatattttttttttcctttagttctgtctctagataaccctgattaatacagatcagattttggtaccaggagtgattgtaaaggaacagaatattaaggatggggttctttagtcagttttggggtttctggagctggctgcttaatacgattagaccccaaaattctaaggactctacctctaatagtatggagaacaccactggtagtccttggcattaaccatttagagaattatgcaaaataaatgcatttgacattcccgattcatcgctagtgagaggcaaagagtttagtgactctatacataataactttgaccatatagagagaaccaaggaacataatgaagctggttggttgctcctaagttcagtgagcaaagtgatgaaagaaaatgatgaactcagggattctatgtcctggcttcagtagcagatactgagcctcaaatctgcaaagattgccctgagtgaaagtcttatcttccgtagagaaagagctgcaattgtagaaaaacagacacaagctcttatcatataagtggctgaccagcaaaaaaaggtgcatgtacagctttaccaggtgtctactgttgaagtgagagcattgattggaaaagaatgggaccctgcaacttggaatgggaatgtgtgggaggaccctgatgacgctagggacactgagtttgtaaactctgatgaacccttttggccagaagaaacagcttccccatccccagtagtggcaacattccctccccaaaccacgctgccatgaacctttctacctttgtctgaggagataaaccccgtgctgcctgaggcaagagcgatggcctcccctgaggcagttgccaggcaagataatgttgattctcctcaagagccacccccaacacccctgtttgcttttagatctgtaactagactaaagtcctggtgggcccctagaggtgaggttgagagtgtgacccatgaggaggtgtgctacacttgaaaatacctgcttgagttttctaatttatataaacagaaatctggagaacaggcatgggaatggatattaacagtgtgggataatggtggaaggaacatagagttggatcaggctgaatttattgatttgggcccactaagtagggactctgcatttaatattgcagcttggggagttaaaaaatgttctaatcatctatttgcttggttagctgaaatatgaaattagctgtgagtgaactggaaatgcctgatctcccttggtttaatgtagatgaagggatccaaaggcttagggagattgggatggtggagtggattagttgctttagacctactcatcccagctgggagggtccagaagatatactcttgaccaatgccttgtgaaatagatttgtgagggcagcacctgcatctttgaagagccttgtaattgctcttctctgtatgtcagatccaacagtgggaaccacagtcactcaactacaaaatttaaatacaatggggataattgtatactgaggtggcagaggccaagtggtggcactcaactgtcaaaggcaaggtgggtatagctaccataatggacagcagaggcaaagcagcaatcagaatagtctgactcctgtagagctctggcattggctaattaatcacagtgttcctacaagtgaaattgataggaagcctactgcattcctacttaatttatacaagcagaaaacttctaggtcaaatggacaaaagactaatttgaattatgaaaacagagactcatggcccctcagtcaattcccagacttgagccagtttacagacccagaaccccttgaatgaaggggaggccaggtccccttgaggaaggaccccactacattaccaacaatttatacagtgaatatttctcccatacttccccatggagacctctggcctttttccagggtaactgtgcattggggaaagggaaatgatcagacatttaggggactgctggacactggctcttggattccaaaggacccaaaacatcactgtggtcctccagttaaagtagggtttatggaggtcaggtaattaatgatgttttagctcaggtccaacttacagtgggtccagtgtgtccagtgggtccaatggttccccggactcttcctgtggtcatttccccagtgccagaatgcagagttggcatagacatacttagcagctggcagaacccccacattgactccctgactgatagggtgagggttattatggtgggaaagaccaaatggaagccatcagagctggctctacctcaaaagatagtaaatgagtaacaatattgtaccctggagggattgcagggattagtgccaccatcaaggacttgaaagatgcaggggtggtgattcccaccacatccctgttcaactatcccatttggcctctgcagaagacagctagatcttggagaatgacagtggattatcataagcttaaccaagtgatgactccaattggaactgctgtactagatgtggcttcattgcttgagtgaattaacacaactcatggtacctggtatggagccattgacttggaaaatgcctttttctccattcctgtccataaggcccaccagaagcagtctgccttcagctggtaagtccagcaatatacattcactgtcctaccttaggggtatctctactctcctcctttgtgtcataatcctattcggagagaacttgatcgcttttcacttctgcaagatatcacactggtctattacattgatgacattatgctgattggatccagtgagcaagaagtagcaaacacactggacttattggtgagacatttgtgtgccagaggatgggaagtaaatccaactaaaattcagggaccttctacctcagcaaaatttccaggggactagtggtatgggggctgttgagatatcccttctaaggttaaggataagttgctgcatttggtccctcctacagccaagaaagaggcacaatacctagtgggcctatttggattttggaggtaacacattcctcatttgtgtttgttactcttgcccgtttatcgagtgacccgaaagactgccagttttgagtggggttcagaatagaagaaggctctgcaacaggttcaggctgctgtgtaagctgctctgccacttgggacacatgacacagcagaaacaatggtgcctgaggtgtcagtggcagacaggatgctctttggggcctttcgcaggcccccgtaggtatatcatagtggaggcctctaggattttggagcaaggccctgccatcttctgcagataactactctccttttgagagacagctcttggcctattactgggcttttgtggaaactgaacgtttgactatgaatcatcaagtcaccatgcaacctgaactgcttatcatgatctgggtgctttctgatctatctaaccataaagtgggccatgcacagcagcattccatcatcaaatggaagtggtagatatataattgggtttgagcaggtcctgaaggcacaagtaagttacatggggaaggggttcaaatgcccatggtctccactcctgcctccctgccttctctttcccagcctgcaccaatgacctcatggtgagttctccgtgatcagttgacagaggaagagaagaccagagcctggttcacaggtggttctgcactacatgcaggcatcacccgaaagtggacagctgtagcactacagcccctttctaggatatccctgtagcacagtggtgaagggaaatcttcccagtgggcagaactttgagcagttcacctggttgtgcattttgcatggaaggtgaaatggccagatgtgctattatatattgattcatgggctgtagccaatggtttggctggatggtcaaggacttggaagaagaatgattagaaaattggtgacaaagaaatttggggaggaggtatgtggatggacctttctgagtggtcaaaaactgggaagatatttgtatcccatttgagtgctcaccaacaggtgatgtcagcagaggagaattttaataatcaggtggataggattctgtggacaccactagcctctttccccagccacccctgtcaccgcccaatgggcccatgaacaaagaggccatggtggcagggatggaggttacacatgggttcagcaacatgggcttccactcaccaaggctgacctgattacggccactgctgagtgcccaatttgccagcagcacagaccaaccctgagccatcgatatggcaccattacttgcggtgatcaaccaggtacctggtggcagattgattatattggacctcttccatcattgaaagggcagaggtttgtcctcactggaatagacacttactccagatatgggttggtgtatcctacacgcagtgcttctgccaagactaccatccatgtgctcatggaatgccttatccaccatcatggtattccatacagcattgcctctgaccaaggcactcactttacagctaaaggagtgtggcagtgggctcatggaattcactggccttaccatcatcctgaagcaggtggattgatagatcaatgaaatggccttttgaagtaacaattacagtgccaacgaggtgacaatactttgcaaggctgcggcaaagttctccagaaggctgtgtatgctatgaatcagcgcccaatgtatagcactgtttctcccatagccagaattcatgggtccaggaatcaaggggtggaagtggaaatggcaccactcaccatcacccctagtgatccactagcaaaatttttccttcctgtttccgcgacattatattctgccggcctagaggtcttagttccagagggaggaatgctgccaccaggagacaaaacaacatttgtattaaactggaaattaagattgccacctgaacactttgagccctccctacctttaagtcaacaggctaagaagggagctatagtgttggctggggtgattgacccaggctatcaagatgaaatcagtctactactccacaatggaggtaaggaagagtatgaatggaatacaggcgatccactgggcatctcttagtattaccatgtcctctgattaaggccaatgggaaactataacagcccaatccaggcaggactacaaatgacccagacccttcaggaatgaaggtttgggtcactccaccaggaaaaaaaaacacgacctactgagatgcttgctgaaggccaagggaatacagaatgtgtattagaagaaggtgatcattaataccagctaccactacgtgaccatctctagaaacgaggacagtaattgtcatgagtatttcctcctccttttgctaaaaacatgtttgggcaagtatacacttgcactaagaaaatatcttcattttatttcctttctcccctatcatgtgacataagatttattgactttatataagcatttaagtattgttaactttatgtaacagtatttgagtagggtattggtgcatttgccgttgtatgaaggatagttgtattatgttaggggtaattatgacctcattattgtctttatttgaagattatgtacaatcttaggagacgtgtctgggttcaagttaacaaagggtggacttgaaatggttaatactgagtgtcaacttgattagattaaaggatgcaaagcattgatcctgggtgtgtctgtgatggtgttgccaaaggagattcacatttgagtcagtgggctgggaaaggcaaacccacccttaatctggagggcacaatctaatcagctgccagtgcatctagaatataagcaggcagaaaagtgtgaaaaagagaaactggcctagcctcccagcctacatctttctcccgtgtggggtggttcctgccctcaaacattgggctccaagttcttcagttttggaactcgaactggctctccttcctcctcagcctgcagacggcctattgtgaaaccttgtgatcatgtgagttaatacttaacaagctcccctgtgtgtgtgtgtgtgtgtgtgtgtgtgtgtgtgtgtgtgtgtgtataggatcttttgtaataacagcttagctatgcggacacatatattatacgctgcagttataagaaaggagttttttctcctcctcttccttctctttttcctgctgctcctcttcatccttttcttgaatgatattaattcagaattttcactattccctactagccttactactcagataatctaaattaatgaggttttctctgcttaagcaaaaacaaattacattccctttgtagcttgaataagaatagctgaatttgaatttaaaaggtatctaaggattttgtatgtttcctaaacaaagctaatgagatgtagttgttcttttgtaacagtgggaagcaaaaaacatgggatgcatatcttactttggttagtgaaacctgcaggcagattttatctgtttgttgggattagtataaaagactggataatagtatttaatatttatttctttcattgtcagatgaactttttctttaatcatatctagtttgagatgagaaactgctgactatggagtgttatacctatacacattgttcaaaattgaaaattatacaagaaataaaactaccacaaatgctatgattcactgtagaaaaggatagttataatgatacttttcttaactttctgtgggggcggttggctatgagatatgtgttaacttgctaagttcagatctctcctgccccccgaaagttgacatctcccaacaaatttaatgtgcgagaaggatcctgccctagcaatgtctaacatcaccgtagctttccactttttctcatacccagtctctactagtgtttctgagtagtaaggagcatgagcaaactttctctgctattgaaaatctagctcaagggtgacaaaaacaccacccttggttctcacatcaccacttcctgaaaccactttcatggctggcattactaatcagtggctacagtatctctctgagcctgaacatggcttcacaagtcataaagatgtgttcttggcagccacagctgattgatcacagttgtttctgaatgtgaaacctattttccagctccaatctacttggtgaaaaaagcatgcgtttaggaggatatatctggttcacaaattttcttacccaataagatgctactaaagtgcattatttggcccaatttcaggaccacaagtaggtagcttctctgtcacctccaaaaacaaacaaaggaaaaaatgtgtgccatgttaaaacgtaatctatccttgggagcattcctacattaaacctacaaaaaaaagagaacatagttatttctcaatctggatccagaacacttcaataccagttattcctatgcctttcttttttgtgtacccagtatttaaccaataaatatttgaatggatgagtaaatgaatgctcatgtgtaacagttcaagtaatatttttgaatatgttctgaatagaatttcagaatttggagagaaattagaagcacctcttccaatgatttacaagacagggtgcagagttttaaaaaagtatagtaaatagtataacttttttacttcaaaaagcaaaagtagctatttaataatgtagaaaggaaagatctttttattggggaagtgtggaggtaccacttcttgagtgtgaagacacatacgcagaggaggggaatagaggtgtaagattctgctgtttccaaaagtgggatatgtgttacaaaatgttaagaagtgctcatcacttgacagataaacaaatggacctgagagattaacagacatctctaagatcacacagctgctctgtggcagagcatacgctagtaccttgtttcctgactttgtgttcagtgaggccagcaagagagatggcaacagagtgttttagagtatagtgtacttgcgattttgaggtatgataagaccaacagatgaggagacaattgccattgaaaagatagattcaggtgggtgccactccatgccataggggccacatggggaagcaccagggtaggtcacaagacagagtagggaattacaggcaagagcctctattgtggtttttatgggagggaatgggaaaagcaaacaagcagacctggaattggccagtttgaatcatttccgtgggctctggggtatagaggttgtccctaattttctaatactgtccttggaatggttggggcaggtggatagtggccaggaatgtaagagcccaacaagataggcggctagaagtgtaaagtctggattggctggtttacattgaaaagtaaactcatgggaggaggactcctcccaaagggtggggaggggtgatgggggaggcggggagccaaggcaaggtgactcaaacatactaccaggttgcccaggacaaggcatgtccaacatatgcctataagacaaatgtgaaaacatcaagttacagaagctagatgtgcatttactacactgggattcatggttcagcgaagacaagctattagttggctcaagaaggtagggagggagaagggatgtggggagggggattgaggagtacctgtttaatgggtccaagtttctttgaaggtgatgaaaatgttctggaattagacagtggctatggtttcacattgctgtgaatatactaaaacccactgaattgtacattttaagatgataaacattatgttttgtgaaatttttctaattaaaaaattggagaaaagaaagcagagagaaacaagatacattgctttaggctggagaatagctgttttaaggtagggagaagattgctccacaaacttctacctggaatgggatgctgcagagtagagccaaagtaggaagctgggttggaaacaaatgttagagatgaagagggcaagttggaagggatatcagactttgggcgggggctgctggggttaagtttgttcctgagctctgggtgtgaatgttggggatacagcaaaatttaagttaggaaggagaggggaaagaaatattcaactttaccacaattgtaatgagaccagaaacagaatagtgttttcattcaagtttccccaaggacaactcttgactaatagattgcttcttcatttgtcaaaaaccaagtaaatgttgtctgaagatgaaatattgttacgataagacaatgatattctatttcataaacactggttacgtttgtgtttgttggtttttcttttttttttttgccatgagattgtactagaatttcaataaggatgttggttgcgtttaatgattaggcctttgcatttaactgaaaatgctagactaacctagtttagttatttcgttgagttgtgttcaataatggtgtgctatgagccaccagttaaaatataaatcagctagtaatattgacgtctttttctattctggcaacacactcgcttgcctgcccatgcacaagcactcatgtacgcatgagtgcatgcacatgagcaaaaacaaaactaaaagcatttatcaaagtcagctaaacaatcggtttccaaataccattccacaaaatagcgcttgtgcaaagcatgacattcatctacaagtatttatggttaagtgagaaaaatcaggacaactgtttgagccttccataaacctaaaagtgcttagtttaaagaagtgccctttattctgcatgaatatactttatcatttttattattaaaattacctttcttttataattttaaagattgagatcccaacattgtttattcagattttgatgaaagattcttggcttatgaaatcctcaacctggttaatgcaacatcttaaaaatacatgtaattctacatagagcctatgagttatcctacagagaagaaacccttgtgagaactttggatagttaacaagagttgtttgcctgcctttgttgtttaagacaccaagcacagatagaacacaaggttttgaattagaaggatagatcacttatcatgtaaccttagacaaataatttcaggtttttgaatctcagtttccttatctagaaaatggaagtaaaaatgcccatctcagagggttggagtgaaaattaatgagaaaaaatatagaaaacactatttccacacttggcaacacttgatgactgttgctattttctcttcagttgtgtttgtaccataacgttttccttcaaacaatagttgtcttatctctgtcaaaaataactctgttactagccatcgtatcttggttagaggttgtaaagtccaaacggcatttgatcacagtgtttaaaaaggtataagaagccaaacttcatttttcagtgataaaaagatgaagctttaaaatagagtttcataaggggaaaggctaatagttgtttttcttttatcaaatatgttaatggaacattcataagtctgtggatttttctgcagggtccacacaagttctgaatcacagtaggttctataatgttgtggtgaagaacacggatgctggagacagactgagttttaattctatgctctccattcacaccttataaccttgagcaaggtatttaacttctcttttcctcatctataaaaaggcactaaataatatcccttgttgcagacagttgcaaggataaacgcattaatacatgtcaaaggacctgtgcctgtttcaggctaacattcaataaatgttacctcttcttgtgccacagaggctgattttggactgtctttctaatccagctatgggtagctccaacctacaaattttccagtatttttcttatttgcttcctgacagtttcacgtatccattcatatataagaaagcagccgaaaacagcagcataaaacaaaaggcattttgttacgtccacagattttgtgggtcaggaagtgaacagggctcagggggaattgcttgtctcatctctattccatggtgtctggggactcagctgagaagactccaacagagagtggtaactcaacgactcggagctagaatcttttggaggctccttcaactcacaagtctgatgccttgattggaatgactcaaagacctggctcagctgggactgttgaccacagcgcctacatgtagcctttccatgtggcttgggtttctttctccatggtggctggttcctcagtgggagcaaccccagagcgagtgttccaaaaagccagacagaagctgcaaggcccttgatgacctggcctcggaagtcagggagcagtctaccatactttgctgctccaagcaatcatgagccctttctgattcaaggggaggggaggtaaactccactctggataggagaagtgtcaaagatttcagatttttttcccttctttttatttaactaaattaaattaattaattaattaatttagagacgaagtttttgctcctattacccaggctggagtgcaatggcatgatctcggctcactgcaacctccgtctcccgggttcaagcgcttctcccacctaaacctcctgagtagctgggattacaggcatgggccaccatgcccggctaatttttgtgtttttagtagagacggggtttctccatgttggtcagactggcctcgaactcccaacctcaggtgatctgcccacctgggcctcccaaagtgctgggattacaggcgtgagccactgcgcccagtctttttcccttctttttaaaaactttcttcctatatagctatctccattttatctatagcacttattctccaagttttcgtgattactggtccctaatcttcctcaagctctgtataactttgataaactctcaaccctaaaatctgaactctaatcatccctctggtaatctttttttttttttttttttgagacggagtctcgttctgtcgcccaggctggagtgctgtggcgcgatctccgctcactgcaagctccgccttccgggttcacgccattctcctgcctcagcctcccgagtagctgggactacaggtggccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccccctctggtaatctttgctgctcttcacacagcccagatggcattccctgtcactgcccactccacaagccccacctcacatcctttttttttgcaccagctctacctgcctacagaagagccattaggtagaataatatttgtataatactaaccagaatttccctccatattataacttcctccttggtctatcctcaactttgtgaagctcacattattctgttttatggacttagagaaggaatgtaccttcagacagtaggaaacagaggcagctcctcctagaaaagtagaaaaaacactgaagcacaaatatttggttacaaagattccctcaagaaacttcagaatgagttcccagttaggggagaagaaaaagtccgagagagagtaatgagaacagaaatattggtgggtagcagacagatgagctctgtgcactatgacttaggtcaaagctttagggagagagtaaaaatcccaaatagttttatgggacctgagagcagaaaggacctgaggctgttcctaggtccgtggagatgtagtccctggagaagtggcaataccttgaagaaaaaaatgactgtatttaggtaggatgaggccttagcagcctaaccacccacttagaaagacctggaattaaagaaggaaacagccaatcatgaaaagaccttgcagagggagtcgagaaagactcctatgggcttttcaccaaggataaaagaggatggcattgtggaccaaatgccttgctccctcaatgttctcttcaacaagctccccctgaaacataaaaattcatggaaaaggaaagagaagcccaaatgacaaagattaaccttccatctccttaataagaggtggtaggttctaattctagaaaaataaagcaaaaaaagcacacctgaatgtgtactgtgtgattcagggtcacatatacttaatgtttcacactgatagagatttccagagagaggtgggtgcatacaatagaataaatactatatggcattggtttcattatcaattctaatttctgttgtcttgaaattatattatatattagatccttgttaaatgcattgaaagggactaagagagctattaggtaaatggaaattgttacaaatgggagttgccattcattcatttaaaccttactgagcacctactataggacaaacattgtgttcaaagttggggttacagaaatgaaaaggatgtagtctttgcccttgaaaacgaagctcacattcaaacagctttacaacagacatgatttctttgtttcatagacttggtcttaggttcatagctagacacatgccaatgtgtgggaaatctggtcagtttggaagaagtacgctcttagagttcttcattcaaacacataatgattcctgtggcaattttctccttctgtgagttggtcaacagacaaaagagaaagctttgaaacacatacacatgtatccatgcacaccatctctatattctggaatagagcatgctgccaccacataatatatttagacaaaaaccacttactttatagtgatctttgttcacatgagatctccagtaataaatagtattgccaatttcttcttttgtttgatgtcagtataagatattcatttagaaaatgcactggatataatgtcaccttaattatggtatgggaaagtttaatgaaaataaattcccctttctagccttaggctttaatgccactagtctcttctgtttattccaaagaattacattctggcacccacgaaaatcacataacaaatgcataactaatgcgacattcacacaaaacattacattagttccatatgatcagctctattccagtgaacatcaaaccaaatcacgttattgtaatgtgagttgtgatttaatatcctaatttgtaagtagttttgtctgaacctaacatgttgtttacaccactcatggtggtttcaaagacatagtacacgcacactttatttggcttggctacctctgtccaatgcccccacatagacacaaccctaagtaatatatcaaataatattaatattttactactaaatatgttctcaaccatcttcctaccagctgccaaattacagacaggcatcagttgatttttttcaataactcaaaaatccgtataatgtaacatgcctcagagtttggagaactaaaaattaggaggaaaacaggttataatcccagcccagggaaatttaacagctgcatagtattattatgaagtgaggttaaaatcattccatgagcaaaagtccagtctattttgaaatgagacattctttctgcctgaagtcttttcctcccactttatatggttggctcagtggcatcctgtaggtctcagctcagttgttagctcctaagaaggcctctgactcccctatttagagcaggcccctctgtatcagttactccctatcacgtcactctgtttggtgatctcaactacctgcctgctctccctttttccttagcaatcgaattgctacctaatttctaggtaagcctatggccaactagaatgatgtcttcctattccagctttcccttcagtcacaaactacattcttactgttgggacaaaacactaattacccttacagggaggagatatggccctcttctcacctttgtcctctatgcagatgtaatggctgaaggccaagcagccatctttggtctacgaggtagaaagcatacgttgagaatgatgaacaaatctggatctttgatgaattcatgaagctgccttatgcatacttgaagaacctatctctgacctttaatgtgagaaagagagaaataaacttcctaagctacaattaacattcaacttatatagcaactgctccagcatataaacctgttccaaccgaacaaaatagggcactggtcaatcagaattgatgccagtgttaaaaaattgtagctgcccctatatataggctgaatcacaacacaggcttggttaaagccaaatgattttgaatcttctgtcacttgcagctaaacctaatcctatgaagtatatttcattttctttataaccctggttgtagtctctgattatcttttcattgttttacttgttcattatctttccctccccttaaaatctaatctctatgagggcagagactcctctggggtttgctgctggaacattgctctgttgaatgttaaaagaatgaatgaactatttctttaattttttattgcgagatataatattttgggaattgcagatctggaggagtgaaaagaattctatttggagaactagggttggcagtggaattgacaaaagtttttttttctcccagactcaaaaaaaaaaaaaacctgatgaaattagtggtagataaaaattcatttctagcttctaacaaggaatcacaaacaatggaggacatataaagagagtagcagctttattaataatactttcctactccagtcgtgatcttttgatgacaaccctaccggagacactctttatcaggcactaaagcaatttagatgctgtcacatgcctttcttgatatatacgtattagacataaagcagttttctgttctttagcttattttagtatataattaaaactctgactgtctgctactaagcaacggagcatggcagaggttgatcacatcctatcacaaagatagaaagaagaaaaataataaaaataatcatacacattcctgtaatcagtcttcagatcttaattatgttttaactcctttgttatgccaaaggcaatgcctattggcatttaaaggacactctcacttttctgcctaagttcaatctagttctttaatttggatcctagtctatttatgaaattctttggggggcatttaaggtcataaggggtgatagaaaactgagataggactcaggaggtttaagatccattcagccctcagactggtttattgtgcccaggggtgcagccaaattctctcctctgaggtacagaggctgtggtggggtgcatgcaagactggaggaggatgggggaagaaggaggcagggtttgcaacattggtgggtgagcaagtgcacacgtacacaaaacagccctctaccacctttctatgtgtcttaaggtctgacctctgaagcttcaattgtatatttcactctgattccaaagatgcttttcatcagagccttaatttttacattaatggtatttctttaaaattgttgaagtgtatctgttttggagaatacgcttagggataataactcatgcttctgttctggccccctccttcctcaacttccaaaaagacttcaaaatataagtcgcatttactcattcattcattccctcaactattaattttccaagcccccattttgtaccattttatgttctagggctcatattgtcactcatgggtgggttccattgcttggtgggtgatagtcagatgaccacaaccgagaaggatttattaaacagatattattactattacttacaacaggtaaggagggcactgggcatagttcccaaagcagtagctctccaaacaaaggtaaaaacagggcttttcttgggcttgttagctgagtcattgtatgtagagctggcgtcaccacagcgtgtgtgcagtcactgatcatgcttccacatacatcacgtgtatagaaaatggccaataagctcctccctgggcagggtttttagtagggcaatgaggggagttcactaaagttcatgtctaactcaggcatctctggatccaacccatttttgctattccagggctgagcttcttcctggaacattcatgaaacaacaagaactcaaggtgtaacagttacaaataggtactttttcccagtgtatactctgaaacccagggaccttgattacataatggtgaacaaatccattacctttgcctttgtggagcttccattctatagtgaaagacagccagtaagtaagaggggctctttacaaataggaatggattattagtgcatattgaactctcactatgctagacttacagtcaattcatggtgttatttactcctctcaccaaccaatgaaagaggtacggaggctgtacaatggtagcacattgcctgggcttgcagcctgcctctgccacttactctgtgtaatcttaagcaagttcctgaatctttgcttgcctcggtttctttatctgtcaaatgggtatcctactttatatagggttgttgggagaatcatgcatctgtagctctcacagcagtgctcagcattttgttcaattttccagataaataaatcaaggcatagacagattaaataatttgtcccaatccattcagctaataaaaagtgggaaccaaaattccaaccccagtctctgactgtaccacgtgtgcccttacccacgattcagctttgttcttccagcaaggtctcttcgcctcttggaagatcagtttctccacctgcaatctgggcataaattgcctccctcccacctagtctgttgtgagaatgaaccatgataaggtattttaaagtgctttgaaaactgtaaagcaccacagaaaatgtgtctattattgttatatttatatttttatatttaccactttaatttgagtgtgataagttgtgtttgcatatttgtcatataaggctttctgtttaatccatcatggttcacatagaacctgttagccagcctgggagcctctgtagtgctttcttaaactttcattagtcaaccccactttttgaagatgatccctgtcagttctcctccaagtggaagaggaaatacagaagataggaactgaaaccatctactgtttcggatacttgttaaacgttctgtgaaagttttagttgtttgggcagatggtgaaagcacttcaaaatcctggggacagaattcaacatgagtgagcccaagtaagggggagttcattgaaacgataaaggggcatctcagcaaatctggagaagccaagcatttaagcatgccttaaggaaaccaagttatgggcccagaaccctttctccttgcaagcaggggcgacctccagcgggtttcagataaactaaaagtggctaatgctggccgggcgtggtggctcacgcctataatcccagcactttgggaggctgaggtgggtggattacctgaggtagggagtttgagaccagcctgaccaacatggagaaagctcgtctctactaaaaaaaaaaaaaaaaaaaaaaaaaattagccaggcatagtggcacatgcctgtaatcccagctactagggaggctgaggcaggagaatcgcttgaacctgggaggcagaggttgcagtgagctgagatcatgccattgcacttcagcctgggcaacaagagcaaaactcaatctcaagaaaaaaaaaaaaagtggctaatgctgtcatgtcatttggggaaagatttcattctggagatgtcatgtgcctccacaaaaggaaacgatatgacttctttaactaaattcaaagtattctgttttgacccagatgtatatagatcaacacaagtccttatcaatatacagcataagaggaggtatttaatgtctctttattcagagttgtggtactgcaccacccaaagatttctaaccacgtgagatttttgagagcccagacccagaagacattctttggggggacataaaaaaggatgctgatcagtccccagttaaggtcatacaaggaaatagaaataatctggaattagggaggccagtcaaaattctgctaaaatgatgagctacattaggaaaaattcaaaagtaccatttatctgcagatgtctatgcatttgaacagagagatattctgagccattccactcacagagagactgataactactttaaaaagtaacctgtaggttgctacatttaggaaggtccttaataaatattatggatggcgatataactgatgcttaaatatctgtaatatggggttgagggcagaaaaaaaaaatcagagttggatatactgcattgaaaataaaattccacccaaaatatcaaaaacatagaaattgtacagaggcaggtgagcaagaggagcgaattcttaagaatacaaggtggcctgcttcatcgttctttctcagacttttataatcttcctttgtattaaaaaactaaagccgacatggcctcttgtctctgtccccgactcaacacctgaaccatatatatatattattctgcttctctacagaggtcaactggcacgtgtgtttatttatatgcaaagatcctcaattggctgccccagaaagagacagcatgtgcagaaaagatttagagagatcccaaatgggacacagagagaacgcaattggttgtcatttatcaatgaatcagctcctcaggaatgagatgtctgtccttgtcctgatcagctatgatagggatagagccaccttgcaagacttttttctctttaatcaataaagaagttgtgagttgggcaccctttccataatttctctatttttggtaatttgggtggaattttatttctcatgcagtgtatccaactctgattttctctctctcaattccacattatagatagttaagcatcagttatacaatcacccctaatatttattaaggacattcttaaatggggcaatgtattgattactttttatttattttttattatactttaagttctagggtacatgtgcacaacttgcaggtttgttacgtatgtatacatgtgccatgttggtgtgctgcacccattaactcatcatttacgttaggtatatgtatagattactttttaaagtagttattagtctctttgtgatggagtggctcagaatattatacacctgaagattctctcttatcaatgaccagccgtgaacatcctcagtgtgacaccttgaaaaaagaatttacatctgaatctgtgttttatgcttctagtcaatctaccaacttttggtaccactatacttaaaatactacaaggaacaacataatctgtgccctcaaggagttttaatctggagtgaatcatgacatatataagattttaacattttctccaagcccagctgtgaaatgaataactaaattggctcctcaaaacaacaacaaaaaaatgcctttaaaatatcttctgttagcttgcatgcaaaagttttaactactctcttcctaactaactcttttctggcgaggttatgctttagctgccaccactcaggaaagcattataattgtagcactagcttagccaaaaggccaagtttttgctttaggataaacttgttaaaattgggaactcagccagggtcatgcatctaagaacattgtgaaagcatcttagggttgttcatctagctatggtctaattaattttcaaatggacaaagtagtttcttgggccatataacaagcattttcattcatttaagtgaagctggatttggctcaaagcagggtcatgagaaattctaatggctccttctcttctttgtgtgtcctcaggagagcttcctcgatgtcaacaatgcaagatttgtgctgcgggcaattggagtagaatcagcttcctgagagccaagttctttgacttcccctagaaggaaagggtatggaaccaagcatatgggaaggctctctaggcccttttacattattggatttagctacgctcacataatgaaattgttgagattgtttaaaccttctgcagggacttctgttagcagaaaagaaacttgtactaaagccataagaagattgtattatagatataatggaatcttttttatcttttgcctggttttctgcacaggactgacatatttttctgggcatgaagccaaaggtctatttaatttctacttaaaatttcccatggccactaatactctccccctagatagctgctttataaatgaataaataaagacaaagccactagaaaggttgtgaatccttgtaagctttttttttttaaggtggctattttgcactccaataacatctataaaaagcgtgttcctgaatctttaggacaatgcttcactgctatcaatcaaacttccgtaaaatattgaacttatctttgtcctaagaccacagccatgattaaataagacttgaatataaaaatgcaggtttacttgcatcagatgagttctcgtgaacatatgaggttatatcactcctatttttactgcatttaggatttttgagtggtaataatgtttttcaatttaaaactgacttatttttatttttctaggaggtttttgccaattaggtgacaggttttttttgtttgttgttttgtttttgtttttgtttttgagagagagagagagcaagagtgagagagagattgaagtcggggagagaacccagatgttagaaactggcccaagcagtcagcttctcataaaggaccatcctgacagtttgactgtaaaaaaggcaccccattgagcactacatgttccaggaaatggctggccacggaaaaccttctgttcctagcattcatttccagaatgtccccagactgcttgtttgctccctcccagccaacaaagggcagtcaaatgtacctgaagatcaattagaaagtcaccctggcttccagaaatctcacctttatagaaccctcagcagtcagaggctgtctcagcctatccttttttattctataaaaatcactctcctctctaacacccgggaaccctgctgaaacgaaactgacagcagatgggttcccttgccatcaatttatgaataaacagcctttgttcattttgtctcgaacttagttttgtctttgacagatgtaaccatgacttaaagcaatacccggcttgtagaagaagtatttacttattcaacaaatatctactaagtacctactaagtgccaggcactattctcagcactgagacgtaagatacgtaatttgtcattggtgactcacttcttgtgaatccaagagctccataaatagtggtcatttattattaacaatcctttctgagataaaaacctgctttttatagtttacggagaagtagcttttgttttataagtgtaactgcaaccaaatagttcccacatgatatcatagcccacttgtgatacgggagtaccgggaacggaagagcgtggtccctttaaatgatacggaagtggggaagggaagtgaggggtagaggaaggcgggtccctggctcggctctacccccatggatctaggtgaggacaggcgctcctgctttcccgcccaaatgttgtattttccaagcctacccttgccggccacgcccccaacctgggcctataaaaaccgccccccgcaggccctagcgggcagacacactgaagtcgctagacatttgaggaacacatccggggaagaagacacaggtggctggtcatggagagcccgctgggggaagagcacacagacaggcaccggcaggccattgaccagcgggacaaggtggagtttggctggggcagtgggaggagagctggggccgccgagctgccctactccaggggaaaaccacctcccttctcgctcccccatcaccggagagctacttccactcaatacaactttgcactcattctccaagccacgtgtgaccaatttttccggtacaccaaggcgagaaatccggggatacagaaagccctctgtccttgcgataaggtagagggtccaattgagctaacacaagctgcctatagacggcaaactaagagagcacccagtaacacacgcctgctggggcttcaggagcacacacgtccactggggcttcgggagctgtaaacagtcagccctagacactgtcgtgggatcggagccccacagcctgcctgtctgtatgctcctctagaggtctgagcagcggggcgctgaagaaacgagccacactcccatcacacgccctgagaggaggacaagggaacccgtaccgtttcacttgtgatagagataaagttattattgttgtaattttaacttatagaactataatataatggtacaatgatatatattgacaatattcctctttcacccacattttgtatctgtgttcaagattaaatgaaaaaggatattctcaaaaagctagcaaaaccaaaagcaagacgttatgccaaatgtaaacatatttctgtttagcaaatagcaggagtgtataaaacatttctcttttcacataacagaatgttctatgcttactgtattagttaacaaattcaagtctgtttattttgtttgaaattccacttcatccataaattacagcattacacaataacaccagaaggacaatatcaccattgtttgcttttacagtcatctcagcccacaaaatgcttcccattgtcagcttgctatcatcaagctattgttgttttcctctttctggggtcttgtattaatatcattcaaattatttagacactcaacagtgtttttgctatcagtgcaaacctctaaagagctggagccccagcgtgatgaccaaataacccttgactatttatcttgccgtaagtcattatttcctgaggccctggagaagctgtgttgccatgtgtgcactgcagggacggggagcttctcctgccggagctggtttgttccactggacaatgagcccttttctgcttggctctctgtatgggcacatacacaatgaggcggtttagggaagaggggtgatgtgggtcattgataacaacaatccccgaacttcttaaagaattgttgagccccctaaaaatatgttgtctttatgaattatccttaaccctttttaattgcataaaaacttcaggcacttgaaaaaaattaaaaaacgaaaagtaagtctgtctctagtatccctcttctcctttgtagaattacatcctttattcactctgccactatttattatgtgcctcctgtgtgtaagacatactgttagtcattggaaatacagaaatgaatgggacagacacacttcttgccctcatggaacttagggcctaatgggagatacaatgttaaggttgtttctagtgtttttttttttttttaagaatatgttctacatgtatacatgtaatatgtattctctcccatttttaaaaaacataaatggtggtttactatgtgtacgctttttggttttgcattattcttttaacagtatgtagaggatgcattttctactgtatagtgttctgtcccccttaaatagcactctgattttattttgggggggaatcacgactttctaattttgcatactccttgtgggattgtaaatcaggtcccctgtcctcaagtagccaatggttaggtatgcaacccagcttatctctctttagactcaatctcaagcagatccagagttactcaggatcagaacaatatttgaaaggcattaccagaatccagacaagatgatggagcaatacctgatgcccagtggtctagggtagccgattcctgttctgctctccaggctcctgtccattctgtggatcaactcatattgctccaattcattttgttttgcttgcataagccagaattaacttctgttgcttgtaaacaaagagagttaaccaaagacatacagtatatcagagtatagagacctactttactctcggtcattgcctgcatgagtcttctttatatggatgtatcacagtttatttaaccactcccttgtaagtggacatttaagtctagtgttctgtaaataaaaggtcagaatatacgtctgtatacagtatatattcttgcatatccacctttggacagatgtgtgaatgtgttttgtagaaatacatttgtagaaatgcaactgctgggtcaaagaattagtagatttttaataacatcaaacagcgttgaaggcccccatataagaataacaactactgactgaagacataactaattaaaaaaattaattacagcttatttgtaataacttcttattgtcactgagtgaaaaggtaattctcgttgaatttacgaaaagtgactaataggaaatttagaaaactcagagaatatataaaaacacaaagaaaagccagccaccaagtcgcttataattctctcaccaacagtggcagaattacatttagtcatcatcattattcttacatccagttttatagttatttttgaagaggattattatcaactatcaactctgtcatagctggaagtagaggccactaaaacagatttcttaaactccaagtactgtatatggattttctacttttttttgtttttgattactaatttagttgctagaggtcagagaacatactctatatggttccaacctcttgaaatttattaggagttacttcatggcctgttatcaattgtggttacattttacatgtgcctgtgaagaatgtgccttatctagtttgggacagtattctatgtacttgctttgaattgggtttgctagttgtgttcttcagatcttttacatctatactgattttgttcagttggcctgatagtagcagagaaatagatgttaaaatatcctactatgattgtggatttacctactacttgttataattctgttaatttttgattcatgtattttgaggttatgttgttaggtgcatacaaatttagaattcctgcattttcctgaggagtaaatatttgttatttatttgcctctgtttactccaatagtacttttgacagaaaatatattttgttttatttcacagtttccattttgttagtttatatggcatgtatttttactctttttaaaaatattttgccttcaaccattatacttaatgccttttaaacagtgtatagtggtttgttttgttttgtttttaaatccagttggatagtctttgtcatttaaatggagcatttagtacatttatagttaatgtaattattgatatattacagagtgtctcctatctatctagcctatcccctcttctttttcttttctcttttatgtttttggataaattttattgaagagtttttcttatctcatgctttgctctaggagtttgaaagttttacttatattattttggtatttacatggttattaaatctatctttgacatatcaaagtctaatattaggacttttaactttattatgaacattagtgatagccactttaatgctatttattctctactgattaatatgacattgtgtattttaattttatatattacaaaagccagtaagacattagtattattgttttgtacattcagtattcattttgacacatcacatatttaccatattttttttgctctttactctttttgtatgtctgttctttcatctgggataatcttccttcagcttaaagaatactttttaatatattttttagtaagtatctggtgacaaattcttctagtcttttagaatgaaaatgtctttattttggcttcattgggaattaatttttttaatttgccagtttgacaggtgataatggtattatactgctttaatttgcatatattttatatatttactatcttttttctttcttctcttgggtacttaattttttacaaagttaaaagcttcttttttctttctgtttcttttgtctttttgcaggagaggaggagaggctgaatttttcatataactggggttaaaatactattatgattttggtaacatctgtttattgtgcacaggtgttcatgcacacacacagacacaagacacctgtctaagagctgcctatggctagtaagttagctcacataaagttagtaaagttagtaagttagtaagttgcccacatagagtgggcagacattttgttaacaacaccaagacgtataaaacattctgtaaatgttattttataaaaaattctgtaaaaatttttgatttcttgggacaaacttttatttctgataaagcctattagttcagaaggatgtcttggtaccataaaaagatatcagaaaaattacaaattataatcaatatgtactttattattctgtaggtgcaataatgaaagaaaacctgggtgacagtcaacttgtagagctaaaagggatcctagagacaacatagctaacacctaggatttcttacagcttaaaagaggtacagatcagtcctatcttctaagacttccaaaatgttagaaacaaagaaatacctaaaccagcttacaacatttacaacattttttaaagtttgaaaatttcaaattaaaatttagtcagcatacaaaatacaatgcaacataactgcattggtcacaagttatagtttttaaaaacaaatactaacaccacattacacaggcagtgagttcagataatgagacataaagttttgtggagaacgttatctattatccatccttgagtatctttctctgatcacgtgtaaaacaatacatagagttcatgtttaagcatctacacctaaggctttaaatcctaggccaaatgacccacttagccactttttttcattttactgatgacaaaatggaagcccaaagggggaactgctttatccagcattgtttcactgagtggcagagcccgggctggagccagaactctgaatgctagaccaatgttttctcatctgagtgcgttctctctctttgctacaatgtttcagtaagaggagatttttctgttgaaatttcattgaagggaagagataatcctgggccaatagaaattcactccttcaatgaaatattttattttaaaagttacctgaaagtctgtggttattctcttatccctcctgcccttgtttaagttatatattgatgaataacagagcaccccaaaacttagtggcttaaaaagataataatttattattattcacagtacttacattaggaatgctagtagagcttatctgggcagttcttctgttccatatggggtgggctgggctgggagctacaagaagatgctacttacttgtcccacattgcatctctgaacttcaccatgtgtccttctttctccatgtggtgtttcatcatttagtattctggcccaagcttttttagagcgtggcatctggctttctacattcaaagtggaagctcttaaaggcctcttgaagaccttgaccagaactggcagagtgtcacccccaccatattccaccagccaaagcaggtcacaggcaggaccagattcagaaaaaggggcagagcatttacctcttgatggttggaatgacatgcaggtacagggtgggaaggaatggagggaagtcgtctttggatactattcaccactctcccttagcacgtacttggtatttcttttctgaagaccagaacacattgcttctttcaaacttgtttttattttaaagcataaattagaacatgagttgcacatatgcttacccacttggtcctttccttattgactaaagatagaacagacttgttctaaacaggcttcagttaatgcaaagtatgtaggccacccctatagaaacttgcttcataatcaagaattcatgtaatgttttagtttttcttttgcctcagccctcctggtattagccaataaaagaattatagttttaataactagttgacagagctgattttatcgattttaataaataatcaaacatgcctgaaagcaaaaacatcaaacaaatgatttaaatccctaaaaccttgcctgtgctaatcatgaaactcagttaaatgactaagataaaacagattagtgtcattaggcaaaaaaagaacatgcaccaattacagaatatgtcttatcagtttgcgtaataaaaacctcaaatgctagatgagcagctgtgctctcacacatttgtggagtgtttcagactcttattttaaatagtcatccaagggaaaccaataaccacatcataagaaagaggaagggaatgtgtattaagggcccgcccttccctcatggcgttctgtccttttgtatttttcctgagccttataaagtttggcgaagctggatacaaagactcagagatgaagtaagtagtccaaggacctacagctaatgagaggtggaagtaggatttgtacccaggtcttagtggttaaccaagtccatgtgatttctaccactcctatgctacttctcaaaagggaataaaaccacagcttatcaggagcaatgctccttggatcaaccctaagacctttcctgtttatttttttattttttccttttttttaaattatactttaagttttagggtacatgtgcacaacgtgcaggttagttacatatgtatacatgtgccatgttggtgtgctgcacccattaactcgtcatttaacatgttaatgctatccctcccccctccccccaccccacaacaggccccggtgtgtgatgttccctttcctgtgtccatgtgctctcattgttcaattcccacctatgagtgagaacatgtggtgtttggtttttcgtccttgtgatagcttgctgagaatgatggtttccagcttcatccatgtccctacaaaggacatgaactcatcattttttatggctgcatagtattccatggtgtatatgtgccacattttcttcatccagtctatcattgttggacgtttgggttggttccaagtctttgctattgtgaatagtgccacaataaacatatgtgtgcatgtgtctttatagcagcatgatttataatcctttgggtatatacccagtaatgggattgctgggtcaaatggtatttctagtttaagatccttgaggaatcgccaccctgacttccacaatggttgaactagtttacagtcccaacaacagtgtaaaagtgttcctatttctccacatcctctccagcacctgttgtttcctgactttttaatgatcgccattctaactggtgtgagatggaatctcactgtggttttgatttgcatttctctgatggccagtgatgatgagcattttttcatgtgtctgttggctgcataaatgtcttcttttgagaagtgtctgttcatatccttcactttttgatggggctgtttgtttttttcatgtaactttgtttgagttcattgtagattctggatattagccctttgtcagatgagtagactgcaaaaattttctcccattctgtaggttgcatgttcactctgattgtagttttttttttgctgtgcagaagctctttagtttaattagatcccatttgtcaattttggcttttgttgccattgcttttggtgttttagacatgaagtccttgcccatgcctatgtcctgaatggtattgcttagattttcttctagggtttttatggctttaggtctaacatgtaagtctttaatccatcttgaattaatttttgtataaggtgtaaggaagagatccagtttcagctttctacatatggctagccagttttcccagcaccatttgttaaatggggaatcctttccccatttcttttttttgtcaggttgtcaaagatcagatggttgtagatacgcggcattatttctaagggctctgttctgttccattggtctatatatctgttttggtaccagtaccatgctgttttggttactgtagtcttgtagtgtagtttgaagtcaggtagcatgatgcctccagctttgttcttttgacttaggattgacttggcgatgtgggctcttttttggttccatatgaactttaaagtagttttttccaattctgcgaagaaagtcatcggtagcttgatggggatggcattgaatctctaaattaccttgggcagtatggccactttcacgatattgattcttcctacccatgagcatggaatgttcgtccatttgtttgtatcctcttttctttcattgagcggtggtttgtagttctccttgaagaggtccttcacatcccttgtaagctggattcctaggtattttattctctttgaagcaattgtgaatgggagttcactcatgatttggctctctgttattggtgtacaagaatgcttgtgatttttgcacattgattttgtatcctgagactttgctgaagttgcctatcagcttaaggagattttgggctgagatgatggggttttctagatatacagtcatgtcatctgcaaacagggacaatttgacttcctcttttcctacttgaataccctttatttctttctccttcctgattgccctggccagaacttctaacactatgttgaataggagtggtgagagagggcatccctgtcttgtgccagttttcaaagggaatgcttccagtttttgcccattcagtatgatattggctgtgggtttgttataaatagctcttattattttgagatacgtcccatcaatacctaatttattgatagtttttagcatgaagcgttgttgaattttgtgaaaggccttttcttcctctgttgagataatcatacggtttttgtctttggttctgtttatatgctggattatgtttattgatttgcatatgttgaaccagccttgcatcccagggatgaagcccacgtgatcatggtggataagctttttgatgtgctgctggatttggtttgccagtattttattgaggatttttgcatccatgttcgtcagggatattggtctaagattctctttttttgttgtgtctctaccaggctttggtatcaggatgatgctggcctcataaaatgagtgagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcagcttcttcctggtttattcttgggaggggtgtatgtgttgaggaatttatccatttcttctagattttctagtttatttgcgtagaggtgtttatagtattttatggtagtttgtatttctgtgggatcggtggtgatatcccctttatcattttttattgcgtctatttgattcttctctcttttcttctttattagtctttctagcagtctatcaattttgttgatcttttcagaaaaccagctcctggattcattgatttttttgaagggttttttgtgtctctattcccttcagttctgctctggttttagttatttcttgccttctgctagcttttgaatgtgtttgctcttgcttctctagttgttttaattgtgatgttagggtgtcaattttagatctttcctgctttcttttgtgggcatttagtgctataaatttccctctacacactgctttgaatgtgtcccagagattctggtatgttgtgtctttgttctcattggtgtcaaagaacatctttatttctgccttcatttcgttatggactcagtagtcattcaggagcaggttgttcagtttccatgtagttgagtggttttgagtgaatttcttaatcctgagttctagtttgattgcactgtggtctgagagacagtttgttataacttctgttcttttacatttgctgaggagtgctttacttccaactacgtggtcaattttggaataagtgtgatgtggtgctgagaagaatgtatattctgttgatttggggtggagagttctgtagatgtctattaggtctgcttggtgcagagctgagttcaattcctggatatccttgttaactttctgtctcgttgatgtgtctaatgttgaccgtggggtgttaaagtctcccgttattattgtgtgggagtctaagtctctttctagatctctaagaacttgctttatgaatctgggtgctcctgtattgggtgcatatatgtttaggatagttagctcttcatgtggaattgttccctttaccattatgtaatggccttctttgtctcttttgatctttgttggtttaaagtctgttttatcagagactaggattgcaacctctgcctgtttttgttttcctgtttattgccaaaccttcgccatagcaccaaggggaagatggatgctattttcactgatgtcattcttgtgtcttagggttcctgttaaaaccccaacttcctgttaataacctatttgtaatttcagcatatgtaatgtctttggagtaattggctccagagtggcgtatgtgccattgtattagttagttcttttgctgctataaagaacttttactgctttcctagactgggtaatttataaaggaaagaggcttaattgactcacagttccgcattgtcggggaggcctcaggaaacttacaaacatggcagaaggcaaaggagcagcaggcaccttcttcacagggctttaggacggagtgagtgcaaacaggggaaatgccagacgcttataaaaccataagatctcgtgagactcactgactatcgtgagaacagcatgcaggtgatgctgttgcctggttccaaccttgacagcaggattcagttaccttcacctggttccaaccttgactcatggggattgtagggattacaattcaaggtgagagccaaactatatcagccgtatactgccctggtttttatactttggggtattactcaagggttcttcacctttttatacccttttatttttaattactgtagatacataatagttttacatatttctgaggtgcatgctatcatctgttttttgtgaagtttactggaacaccatgactttatttatatattgtctatggctacctctaagaaaatgaaaaaacaaaaacaaaaagtcttccactttgttatgcagagcaatacaattttccttagttctcccttaaaactccattccaggtctcctttcaattccaaagatttggtcaaagctttgaaaatacctattgttaggacaaatgatgttcttaaatttagggcccctcttctcagccctaatatgtgggtaaggagagtttgttttttctattagtcattcagaatgtgtataatttgtctgtaaatttaacaaagccaactttgacccctgagtgctttcatttagttgaagatttaagagagtgaagagactccataattgtatgtgagactgaaatgaagagtttacttttttttttttttttactatggaagtgaagtcaattggttaagaagtgtctgaaaactgtgggtatttcagttccatttctctgatactatagcaaagaaaacaaagattggcaaaatcctataatgccattcaaacatagcctgggagggaatccaagaacacaggctctaaaacaaataaatcacttgctattatgaagtatggaaagcacagtgatctcagacctaaagaaggaaataatcactgctcatactgtgtttgaaaacacaagtattaaagagagaactgtggaaacttactctggaagtttcagatgaaataaattcccagagatgagtgcatctgacaaccagaaatggcaacgctgtgagttagaggtgatatggtctttaggccagaagagaaagggatggtgtgaatggtctcaacccctttctctagctccctcctggactgagcaggagagcctgctggttccaatccatgatccagagctggaggaaagagatgtgactccaaactgaaatcatgaagcttgaagttattttcaagcagcagtgtctgttggtccctggggaaggtaaaatctcttttacctgctatgggagtcaaaaaatggctcctcaaaaatgtctgcatcctatccttggaacctctgactttgttacctttacaagggaaagtggactttgtagatgtgattaagaatcttgagatgtgaagcatttttttttttgttgattatccaggtgggctcaatgtcatcacaagggtgcttaagagggaaagaggaagccatgagggtcagagtcaaaggaagacttgaagatactacactgcggactttaaagatgaaggaaggggcgaaaaccaagaatgtgggaagcctctagaagctagagaaggcaaggaaacaaattttccactagagcctccagaaggaacacagccctgctgacccactgtaatgtctgacctctagatgtgtaaggtaatacatttttgtttttttaaggcactaaatttgtggtaatttgttacatcagccatagaaaactggtgtacttacttgcccctttttattctactaccaagaagggtctttgacatgacccagtgaaatcagaagacatgaattgggccagactgtagaaggtgcaactttgagtgtgatgtagagaatggtgaggctttgctgtggcaaagttttctgtttcttacctttggttgtcaatgggaagttctcgtacatagataggatggtataagggtcttggggcctcttctaccatacaaggaagcaccgttcttcctttttatctaccctaaaaggctgagtaaagaagataactgtgatcaataatctactatccagtttgtagactctggaggaagatcatctagttttgaaacatacttgctgtgtcattttaagcaagtcagttaattttggttttcctatttttgagaaaaggataaaattaactacctgttcctttatttaggtaaaacacttgaacagtttctggcatatagtaaatgtgatgatgatgatgatgatgatggtgataatcatgattttaagttccgaatttgtctaggttttgactctggctttgttatttttaggtttgtagtcttgcctagttttttaaagcctgaatgagtttctttttttaaaaaaatatgaactagaagcaataagagtagcctcctcaaaggttgttatgaggagtaaaatcatacatataaagcatttggcacatagtaagtgctcagttatagtcagtcatgttgctttatgaattgtagtcaatggagctccaggcaaaggaggccagtacatgagcctccctaggatgtaattcttcttcatcttctttcattccgcttctccttctctttctttcagggtagtaagactgaaagtctcagaaaggcactgttaaattcttattcctcaactatgcaactcaaaactggggtcctcagcagtgagcgaggggtgagagaagacactgtataaacatggcacatcctcctggaaagtcaactttactcaaaggtaaataatttaacatatttttctttttaaaacacacatggatgtattatgaaggagaatgcaaattttgcatgaatttttaagaataggtgtggattattcaaccactttcttattgcagctttagaaacccagctcaaactagctgaagcagaaaagacattactgcgcctataagttgaaactttggagggataaatttcagaggtgtggctagatccaacggctctctggaaaactctgtgaaaaaaatgcttcctcaagtccagaaaccagaagctcaggaaattgttgcttggttcctcttgttagaggcagagattattcaacgacctacagggtagcgtttgaacattgttaccaggaatctttactttgccatcttccaagtctgttctcctcagtattggtttcatttacaagcaggccatctctgccctcatggcaatgatggtctttactccaggcttaagacccttactatctactatttccaaagcggagagagaacttcccacacctagtgacctgtgacacaggattttatccttcgtacagagggaattcagttggctaacataatctgccttccaatggagtaagaatgtctggactctttccttcacctacccccaagacatggaggcgtctaaaagataaataaaacttggcaactgaccgaaggaggaagaggggatttcaggcaaaatcaacgctgttcactacgaggagacttcagaaaggttgcctgcttctggggagcatagtccctgattcctcaagacatacgtttattcttttcttcaatgtctttgcctgcagtcaaaacaaaaccattacctttagccaagttcacacatttcagccaaatccatatgcatcggatcagttctgtaggttatgggtgagcatgaacatataaaagaggcacctgcctgtgcctatctactccatggaatttcaaaaggggccacttatggagaatgtctttagggacagaaccaaccaccctgtctttcctccaactctcaaagtaacttctggctttaatcctcaagtgtctatgctggagtttaagaaaaatgtttttcatagaattcatgtgtatgatattgcatgagttgtccatctttgtatatatctcaagacttgtggtgttagttaaagattcagagctctgtgtcctgaacacagagtaataccagcattactaaggatgatcgtgggattttaaaattcctcccttagatagatcttacgaacttatgttaccaatcaacataagttaagacaaaaagagcaaatttagatgtaaaaccatcttggggccaggtgctgtggctcacgcctgtaatcccagcactttgggaggccgaggcgggcggatcactaggtcaggagatcgagaccatcttggccaacacggtgaaaccctgtctctactaaaaatacaaaaaaattagccgggcatggtggcaggcgcctgtagtcccagctactagggaggctgaggcaggagaatggtgtgaaccctggaagcggagcttgcagtgagccaagatcatgccactgcactgcagcttgggcgacagagcgagactccgtctcaaaaaaaaccaaaccaacaaacaaacaaacaaaaaaaaaccatcttgggacttccctcagcattttggggaaatgctctctgattttaaaaaaagtactggatggccagaagtgctgttcttttttttttttaaatgttaacaagtcgtttatttacccagtgtacagggaaaatcaacctatacatcttgtctttggtaattgagacattacttagtatctgcaatgtttagaaatttgcattgttgacatttcctgtcatcaggtcttacttgaggtgtctttctttctttgtttattatactttaagttctagggtacatgtgcacaatgtgcaggtttgttacatatgtatacatgtgcaatgttggtgtgctgcacccattaactcgtcatttactttaggtatatctcctaatgctatccctccccgcttccccaccccacgacaggccccggtgtgtgatgttccccttcctgtgtccaagtgttctcattgttcaattcccacctatgagtgagaacatgtggtgtttgcttttttgttcttgtgatagtttgctgagaatgatggtttccagcttcatccgtgtccctacaaaggacatgaactcatcgttttttatggctgcgtagtattccatggtgtatatgtgccacattttcttaatccagtctgtcattgatggacatttgggttggttgcaagtctttgctgttgtgaatagtgccgcaataaacatacatgtgcttgtgcctttatagcagcatgatttataatcctttgggtatatacccagtaatgggattgctgggtcaaatggtatttctagttctagatccctgaggaattgccacactgtcttccacaatggatgaactagtttacagtcccaccagcagtgtaaaagtgttcctatttctccacatcctctccagcacctgttgtttcctgactttttaatgattgccattctaactggtgtgagatggaatctcattgtggttttgatttgcatttctctgatggccagtgatgatgagcattttttcatgtgtctgttgtctgtataaatgtcttcttttgagaagacattgagatccttttgagaaggatctcttcacatctttcactcactttgtgatggggttgtttgtttttttcgtgtaactttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcttagattttcttctagggtttttatggttttaggtctaacatgtaagtctttaatccatcttgaattaatttttgtataaggtgtaaggaagagatccactttcagctttctacatatggctagccagttttcccagcaccatttattaaatagggaatcctttccccatttcttgtttttgtcaggtttgtcaaagatcagatggttgtagatatgcggcattatttctaagggctctgttctgttccattggtctatatatctgttttggtaccagtaccatgctgttttggttactgtagccttgtagcatagtttgaagtcaggtagcgtgatgcctccagctttgttcttttggcttaggattgacttggcgatgtgggctcttttttggttctatatgaactttaaagtagttttttccaattctgtgaagaaagtcatcggtagcttgatggggatggcattgaatctctaaattaccttgggcagtatggccactttcacgatattgattcttcctacccatgagcatggaatgttattccatttgtttgtatcttcttttctttcattgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgcacattgaatttgtatcctgagactttgctgaagttgcctatcagcttaaggagattttgggctgagacgatggggttttctagatatacaatcatgtcatctgcaaacagggacaatttgaattcctcttttcctaattgactaccctttatttccttctccttcctgattgccctggccagaacttctaacactatgttgaataggagtggtgagagagggcatccctgtcttgtgccagttttcaaagggaatgcttccagtttttgcccattcagcatgatattggctgtgggtttgtcataaatagctcttattattttgagaaacatcccatcaatacctaatttattgataggttttagcatgaagcgttgttgaattttgtgaaaggccttttcttcatctattgagataatcatgtggtttttgtctttggttctgtttatatgctggattatgtttattgatttgcatatgttgaaccagccttgcatcccagggatgaagcccacgtgatcatggtggataagctttttgatgtgttgctggatttggtttgccagtattttattgaggatttttgcatcgatgttcatcagggatattggtctaaaattctctttttttgttgtgtctctaccaggctttggtatcaggatgatgctggcctcataaaatgagtgagggaggattccctctttttctatcaattggaatagtttcagaaggaatggtaccagctccttcttgtacctctgatagaattcggctgtgaatccatctggttctggactttttttgttggtaaactattaattattgcctcaatttcagagcctgttattggtctattcagagattcagcttcttcctggtttattcttgggagggtgtatgtgctgaggaatttatccatttcttctagattttctagtttatttgcgtagaggtgtttatagtattttatggtagtttgtatttctgtgggatcggtggtgatatcccctgtatcattttttattgcgtctatttgattcttctctcttttcttctttattagtcttgctagcagtctatcaattttgttgatcttttcaaaaaaccagctcctggattcattgatttttttgaagggttttttgtgtctctattcccttcagttctgctctggttttagttatttcttgccttctgctagcttttgaatgtgtttgctcttgcttctctagttgttttaattgtgatgttagggtgtcaattttagatctttcctgctttctcttgtgggcatttagtgctataaatttccctctacacactgctttgaatgtgtcccagagattctggtatgttgtgtctttgttctcattggtgtcaaagaacatctttatttctgccttcatttcgttatggactcagtagtcattcaggagcaggttgttcagtttccatgtagttgagtggttttgagtgagtttcttaatcctgagttctagtttgattgcactgtggtctgagagacagtttgttataacttctgttcttttacatttgctgaggagtgctttacttccaactacgtggtcaattttggaatgagtgcgatgtggtgctgagaagaatgtatattctgttgatttggggtggagagttctgtagatgtctattaggtctgcttggtgcagagctgagttcaattcctggatatccttgttaactttctgtctcgttgatgtgtctaatgttgacagtggggtgttaaagtctcccgttattattgtgtgggagtctaagtctgtttctagatctctaaggacttgctttatgaatctgggtgctcctgtattgggtgcatttatatttaggatagttagctcttcatgttgaattgttccctttaccattatgtaatggccttctttgtctcttttgaactttgttggtttaaagtctgttttatcagagactaggattgcaacccctgcctttttttgttttacatttgcttggtagatcttcctccatccctttattttgagcctatgtgtgtctctgcacttgagatgggtctcctgaatacagcgcactgatgggtcttgactctttatccaattggccagtctgtgtcttttaattggagcatttagcccatttacagttacggttaatattgttatgtgtgaatttgatcctgtcattatgatgttagctggttattctgctcgtcagttgatgcagtttcttcctagcatcgacggtctttacaatttggcatgtttttgcagtgtctggtaccggttgttcctttccatgtttgtgcttccttcaggagctcttgtagggctgacctggtggtgacaaacagaagtgctgttcttaggaattaatattccatattaacacattcaagggcctgagaagtcttgcagtaaggaaccctgtttggctttgtttgacagcctttgtcacacttattggcaacttgggtaacaactattaaaatttggtggaatgtgagttccctgaatcctctctgtgaagaaatgcttcttcaagtccagaatccagaagctcaggaaattcttgcttggctctcttttcacaggcagaaacaatgcaaaggccttaaaggtagagttaaaaatgctcttgtgcatcacaaccagacaaatgatggtgttcctgcagcatatgagggactgggccgagcaccagttgcaattatgtgattagccaaatccccacgtcaattttgcagaaaagagtactaaatatggatctaaaagtcatgtttattcccttttattctttcctttagccttctctgtctcctcaattctttatttttccacaatcaagagctaagagattaatgcagaaagcaaaaattcaacaggaacatgggtcttcaggcaccctagacgaaagagtacaatttttgacctctcctaggaaatgaccaaaggaactgaaattatgcaaatgctctggatttgcactgattttcttctattagtctgcccaccaatatggagactgtggcatctgtggtagtggcagatgaatcaacagaaccaggcctggctgcaggcaaacttgtcaaagaggtggtggtgtttattgcagagtcttcccatccctgtgcagcttgggatggcagagcctgcaaactcctcatactccacagctttcatccacacatttctcttcgccttctaatcatctgattgagcctacttggatctcattcctttcccattagctaatgagaatagtaacaataataattaataataataatgataatagcagtagcagctactgttgatcgagcgccttttacaattcaggcatgatgcaaagtaagccctttatggacatcattccacgtcatcttcccaacaactgtaggaaacatgcatccttatataaacataccttgttatttagcaatgaaggaatgagatttagaatgtttaagcaagtttcttagtgccagaaagtgagaaaatggcagaaccaagttctgaaagtgttggtaatggtgaatgaaatgaaatgtttgtattctagcagaggccctctggagattatgatgccatagcttcaagaacggagttaaatgttggaattttattttccatggaaagtgactttagagcatttcctcttttcaccacattggctgttcatggaaaacattccctgtgtgtgtgtacattcagggtggggaggtgggaagagaagggaggatgtgagacgtgagaaaaccttttccagtaacaggccaccaaaacacatttcctgtcataattagtgtaatgagttctcattttcagttaaaatatattttttcatattagattttcttttatttcagtttgatatgtttacttttcaagaaagaagccagtatatggcctctttttcagccttgttaaccttttgctgtttttataactgtttacctatttttagacattttagtcaatgaaaatgatgaagttcatccacttataaaataaaacatctgtggcaaaatgaggaagtggcaaaatgctaaaagagcagtcaagaaaaacatagcttgtttaaataatgccaaatgtatttctactaggcctgattatatttagttttttcacttttcaaaacctctctttggtcttctgtaattaattgtctttaaggatccaaatcattttcagtggaacggctcaaagattttctcagattgtggtgatattaacagggaaaaaaacccatcatcattatatattttattattttgggattgttttcaagccaccagagtaattggactgtagcctgctccaattaataaggtttttgagtgcatttgtacaaatctgtttttttggaagcaaaaatcttgacttaaaaaaactagcttgcagctgagacttattgctatgcatagataaaacctgagggccatttcttttttaataattattttcaaagaaacctatgaaatcttcatcaacatttttaagaagtagttcttatcaaggggaagaaagactttgaggtctaaacctgtttaggcaccagaatggaggcggtaggtgacagcgtttcacatcacctgctgagtattagtagtgcttgctggaaggcaacatcttaacgagaagggccttttgttttttaccaatttaaagattttgttcctccaataatctgttgtccttgagttggggctagaatatacagggatttctacaaaccgattctgcccagtaattcaggggattcaaatgacaacgtgatattccaactggccccccaaatgtacctaatttgatttcattaagaaattgttgccgggtggggggagggaggagggatagcattaggagatatacctaatgctaaatgaggagttaatgggtgcagtacaccaacatggcacatgtatacatatgtaacaaacttacacattgtgcacatgtaccctaaaacttaaagtataataacaaaaaaaaaaaaaaaaaaaaaaaagaaattgtattgtgatactgccagtagggaagacagacaaccagttatttatgagtcctcgtgtttttttggttcttttggtctttcagttgggaacatttatggaactaattttatttcgtattgcaaaatctatgtagcactctgacttgtatcataaattccaaagacaattctaattgactagatgaaataaagtccctttggacttagcatcttaccatttcaccatgtcttcttgggttgtttctcaagaataccattaaataattcactgattctcatcaagtttggtgcacagctaaagggcctaagcccttctaaaagattcaagtttcatttggtttgactttctcattttgaaacaaaatattagctgacaccattttcaagtggaatagctctgccatgtaaaaattgtttttgttatcattttattctggggatgaaggaaagattgagtggatacatttcttgtgaagaaaaagttgggttggtatttcatgtaattgccttgaattaagacaatggttagaagaattgggtccaattttcctattaatacagtattccactggacactaaaacatcgctatgatccgaattgcaaaatctcacctcatctcataatctctgctttgatgttggcttcttaaaattcattttagtgaaaagtgcaaataatttccagtctcaaagactaggaatcttatatgtttctttaggccaggcacggtggctcacgtctgtaatcccagcactttgggaggccgaggcaggcagattacgaggtcaggagatcgagaccatcctggctaacaaagcgaaaccccgtctctagtaaaaatacaaaaaaaaaaattagccaggcgtggtggcagacgcctttagtctcagctacttgggaggctgaggcaggagaatggcgtgaatccaggaggtggagcttgcagtgagctgagattgctccagtgcactccagcctgggtgacagagcaagactctgtctcaaaaaaaaaaaaagtttctttatttctttatattctttatttataatatgtttcctttatttcctgtagtcatgaatttcttactgtgtagctattactcatgccactgttcaaaattaacatctgggaggcagtgttcatagtaagtaaaaatgtgaatcttaactctgctgtaacttctcctcctacttctccttgattcagtaattatcggtggctcccatttgtccactatcagaaatttagctgcatttgcttgttgtttgaagcaaggtatgatctctatttcgagctcttgccatgtccatttcttttgtcatgtgtatgtattccaataaaactttatttacaaaaataggcctgggccaaatttggactgcaagccatagtttgccaacctgttattgagtcttacaacctacaccatgtccatttctgtctctgtccttctgttcatattgagctttcctcccagaatgcccacagtttttccttctgcctgtctccagctgaccttatcaggcttggtgcagctcttccttcctatttttttcctaatcatggttacccaaactggtctatccctaatttcacatctgcctcaatcactagcaggtctacgcaattctgcctgggattgcactctcattattctgtctgtctcatttcctcagttagattggcagttctttgacccaaagaacaatgtctcacatttcttttatattcctacaatgagcggtacaagtctagacatatagtggaaatggaaccattgcatgcttttcactgatatacgatgataaaagcttaatagtttcctattatttttcatgatttatcttctctgtttttacaaatccacttcttctagttgtcacaaattaaacattaggcagacatataatttctgattggaatagaaactagtagatgatattagaccagcattacctcaaaaataataataaaattagctgatatttgtcaacaactcatcatataccaccaaatgaaatgtaggatttgagaaaacaagctgtttgcccaaagacatggagccagtaagcagcaaagcctctgatgccaggagacccctcccagccaccatgctctgctgcctcccagctgaattttgcttccccgtaatccgtggttcttcacttggtccttgaaagatacttacatggaagaggcaaaggaaagcattcggattttcctttgttgacaggggctttgactacaaacctcatcgtagaagaccgtcatttaggctggttccaagaaaggctttttgctttgttttccagagatgagaatctaaactgaataatctgtttgcttctaccttgtgcagatcttggatcttaacattgatagcaaaacaaaagatgcagaggaaaaggagtgagagaggcagaaaactcaagaatgtttaattccttggggctgtttagtcaattgtgagaagaggtggaagatgacctaagactgttgaggtcatgagcttgccccattcttggtgaaaggggagaagatggggctggaagaggccttgagcttcctgtagataacaccatgggctaagatctacatagttacaaagggcatgttattttatgataaaatctgtgaactccagaatgtttgccagttggctgatgtggtaaagtccgaggcatattgtcacttaaaagaatttagagaaaaagatattttggaataaataccatagttttatgttaatgctgagtctccagttgttttatgttttattttatttttatttatttatttttttgagatggagtttcattcttctcacctaggctggagtgcagaggcacaatctcaactcactgcaacctctgcctgccaggttcaaacgattcttctgcctcagcctcttgagtagctgggattacaagttcccgccaccacacctggataagttttgtatttagtagagaaggggtttcaccatgctgaccaggctggtcttgaactcctgacctcaggtgatccacccgcctcggcctcccaaagtgctgggattacaggcatgagccaccgtgcctagcctgttttatgtttaagtagctaacaaccaccttaaaccataaatcctgttcccagaaagaagtcagaaaatagcaaacagaaagatgaagacccttgaacaacatgggagtttggggcaccaatcccacgcggttcacaatctgagtataacttttgactcactacaaacttaactacaatagccttctgctggccagaaccctgactgagaacatgcagtctgttaatacgtattttgtatgttatatgtattatatactgtattcgtacaataaagtaagctagagaaaagaaaatgttattaaaaaaattgtaaggaacatatatttgctatttgttaagtggaagtgaatcatcatatggtcttcattctcatcatcttcatattgagtaggctgaggaggaggaggaagaggaggggttggtcttggaagaaaatcagcatataattggacccatgcatttcaaacccatgttgttcagggtaatggaaatgacaaacaatgaaattttagtaatttataaaagtaaaaaaagagaaaataattttggaaaatcgtttaatgacacagtgaggtgtttcttacttagatattttattttgctaaggtgctaagttattttatgaaatgaaataatgtcattggaagatgatatttactgctgctctccagacattgaatatattctgttttaacttctgagaacaggatttctgatttcaggaactagtgttcctgatttagtgtagttgttagccgattgaatataagacagtttgaaggtcaggaattaatttattttattcatttttttccattccttccttctttctactttttcctctgtttcagtctttctcacttgtctctctttcttcctctatgtttctttcccactgaaatcaagatttcctgctggttagtaaagctttcctaaatatctgagggtactgctttagatgacagactgcagaaatattgaagacatatcaagtccctgatcaccacagacaagtggtctagactaggattttttcctctgtccacaacatcctgtgggaggaaaattgttaagatcacataatatgataatcttatggtagcccgagagatgctgatggaagctccaagtctctttagagattcatgttgatgatcacgcagtaaaaggagcaagggtcctctgagtttaccacactaagtttctgaactggttagcaatgtcaacctacttggtggaaatatattaattggacaaaattgtgtgatggtgcaagcatgacattttatcctatcagtcttttctttttctcttagcataatgaatattgattaaacccagttaaagaagcatccccggatggtggaataaggcaacaaattgaattgggacatcattttagcactgactcctggaggcccagtgcttaaaatgagaaagtagggctgattcccagactctactgggagtttgtaaaatgggttctttaaaaccattttaacaaagaagtctgcgaccctgcagatcacactcctgttcatgattcagaacgttgaggcattttcatttgctataattttctttgaggttgagtgttcataatgatttatttcggtagttagctaaaatatttgtgtcctatttagacaaagtaatggagagggaagcattgtggactttgaagaatggaaatgggagaattgagctttaggaaaaatgtatcatcagccatgtagaaagtgagaatttggtatagactaattaattgtgactcaatttttgttctaatacccttgaagacatcagatgttaatctcctttctctcctttggagaatctactgaaaaatttaagtgagcaagaggtggactaaattagagttttcttgaaagccttgactgaaatttatcatcaagcttgtgctaggttatctctcaatataccaacccactaattttagaaaccttccctctttgtcatcaaaaatcaatttaatgtcatgaagaatcattttactaaatcgagcaagttgtaaagattgttatgagggttggagtaggttgatagcaacaaatactggtttattttagaataacactaccaaggtggatctatgcatttattctcttacaccaaatctattcttagacccattcatccccagatgttgccatcttagaagccatacatcatcagagtaaggtgctcctataatgtattgcactaatatattgtgcaaaggacagcactgatgataaatttcttaaatgatggtgctgtctaaggctaatgactctaagagcaaatgcaaggtaatgcggtgatttcttttcgggccccagcaaagaatacagaagacatctcaaagccgttttcatttgggggtaatattgaaatagacagtatttaaaaggcctttgcaacacacaattcagcagtattagggcaaatgtgaatggctttgcattttcagttaaaagccacttaatactttacctcgttgagtccttccttcttgcctgcctgcctgccttccttctttccttccttccttccttccttccttcccttccttccttccgtcccttccttccttctttccttccttccttccttccttccttccttccttccttccttcctttctttctttctttctctctttctttctttctctttttctttcttgtctttctttcttgcattttagacagctaaaaaacacctcaagttgttatttgatgaggaatagcagttgaggccttactctctctttgtgggaatgatgtgccttgtgcttctttgaatatgttgtgtttgctttcaggtctttactttaggcaggagatacattcccaagaccattcacacaattgcagccagaggggtgaactgatggggagaatttgtggctgtgagactcttgttctttgaaaagatttgtgggtaggtggcaaattcctgtctatgccacagagttgtgtcacatccaggcccaggaaatgcctggttatgcattagttggaaaaaaatccctaaatttgagaaattaagaggtaaaatgaaatatttaatggaagattttggtagaagacattcctttgggctgtgtggtctattctctttgtgctaaccacagcaaaaactgtgacagaattatttcttagtctaggggatgaagcctctccaaatattttcattctcattctttgggcatactcaaaatgagatgtgtctcatgtttttctagtggtaaaaatgtcatccacgcagtggagttttctcaccgatgataatgatagtagtaagaggtaaaacatatttgtcattgccagctactggtctgagtgctttcatacattgcccactgaactcaagcaggtacagttgttaagcccatttgacaagtgagcagtctgggcttagagagattaagacacttgttccgggtgactaggagatctggtatttggacgatatgactcctgtgtccatgagctaaaccattataccatattgcaggtgcatgtaatttaaaattaatcctgtgtcttcttctgcatcacagcatgtgataggaagtatcaagtcatagactggacttgaaaataaataatttcattgcccagtgcattggtttttatcagaataatacacttaacccgtccttcttttcagccagacacatacataataataagagtaattctctcctctttgactggatgtcatatcaaattttaaagtcttttaaacataccattatgcctaatctttgaacaatggatgagaccaatgtggaaccttttcttagtttaatgtcccttcaaagttctcttctctctgttgagagctagaatagtgcttctaaacctcccatttagccagaaagtagcattatctttctattaattatcccttaatttggcggggcgtggtagctcatgcctgtaatgctcccagtttgggaggctgaggtgggcagatcagttgaggccaggagtttgaggccagcctggccaacatggtgaaatcccgtctctactaaaaatacaaaaaattagcaaggcttggtggcatgtgcctgtagtcccaactgcttgggaggctgaggcacaagaatcacttgaacccgggagatggaggttgcagtgagccgagatcacaccagtgcattccaatctgcgtgacagagtaagactctgtcaaaaaaaaaaaaaaaaagcccttaatttgttggtgaaaatagctgcttattgaattaggtcctttggggtataattttaacttccaataggaagaattggttgaaatccttgctttttactatttgagtatcgtttgcattagaaatcatttctctgtccattacttgagagattctcacttctagaatcgttttcttgaattcatatttattccagcttcctccattgtaaagaaaagaacttgatttcaatgatacttttaaatgaatttaatcttgattcatactctgtggaatatttgtcttgtatgagtgctagtaagagagaaattggcatgacaatgtaaagcttggtttaatatttttgccaataaatttgtccagatgtgaataagaaaagttaaataaataataaaaatagctgagtgtttagtgttatcaaatcaaatgtttataaaattttaaaaaatttcacacattatttattgccctattcagattttcttttttgttgcttaagtgattgagagactgggaactagcgtctaactttacttttcttctttgtcaattttctttaagatggaaggacattgctggccaccttaagagactagattaagcaaccagttctgatgggtgatcatcttgcttcactttctacaaatataaccagatagctaagaacaaatagctaatattttcaaaagataactacagctgttgagtcctgaccatatgccacacatgctattaggtgattctacatcattatctcacttatgtctgacatcagtatcctgaggtggttattaatggcctcatttttcaaataaggaaactgaggctcgggaattttaaatgaactccataggtctgtaagtggtggaagtgaattttaagcatgtgtttgtctaacaccaaaacccaatgcaaaaacaatgaaaataaataatccaattcaaaaatgggcaaaggacgtgaatagacatttgtccataggatatatacagatggccagtacacatatgaaaagatgctcaactcaacattgttagtcattaggaaaatgcaaatcaacaccaaaataagataccacttcacactcattatgttggctattattttttaaaaaagaaaataacaattgttggcaaagatacagagaaattggaactcttgtgcattgctggtgaggcgtaaaattgtacaggtgctgtgaaaaacagttcagcaatttctccaaattgaacatagatttactatgtggtccagcaattccactcctaggtacatacccaaaggaattaaaaacaaggactcaaacagttcttgtaaaaaggttgatggcaacattatccacaatagccaaaaggtggaaacaacctgtgtccatcaacagaagaattcgtaaacaaaatgcagtatatacatgcaatacaatattatttttccataaaaaggaatgaaattctgatacatgctacaacataaatgaaccttaaaaacattgcactgaatgaaataagccagacaaaggacaaatatggtatgattccacttatatgaggtacctataataggtaaattcatagacatggaaaataggatagagattaccagggtttgggggagatagggggtatggagagttatttaatgggtacaaagtttccatttgggttggtgaaaaatttctggaaatagagcgatggttgcacagcattgtgaatgcacttagtgccactgaattgtacacttacaattgttaaaacagtaaattttatgttatgtataacacacaggagagggtgaaatatttctgggcaaagaaaagactaggtaagaactgaaatgtaaagctaagtataggcattgcttaaaattgtagtgactatcagttttaacagatggcaaacatttttgcaggaaaaaaaaatccttattttaggtgtatgcctgattagtgggatttggttagcttttctaaatgaaaccaacttggtcttccaagagaattcgatgatgagacattaaaacactgtagaccgacagagtttgtaatggcagagtggttcttcatgcttaagaataaatacagccatcagcacagtaccaggctcacagtaagcatgcaacaaagagttgttgaatggaacacctaaaattatcaaaaagcaacagctatgtaataatttcaagttaatggtaaagattacttatgagttgtgttttacacatttttgtgtgcaatgcacatttttccctaaccataagttttataaaatggaaaaataatgcaaactggcacactcaatcaaaggcactggaattctatttttaaatttataggaatttgggaacatgattcttttagggatgagagctgcctagaattaggatgaggctgttattttgatcagccaattaacatttctaggctgccctctgaacagccacccatatttgtattgaatttatgtcagagtacatcaagcaaacaggaggagaagggtacaggcaaaaaaaatcttttaaattaatttgaataagtctggaatagaaaaaaaatagccacttgcttaaattattttaaaggtaactctttattgattgagtttatagcaacaaagatttgataaaaatatagtaaagatgtattgaaccgtgaattttaaactccttcagcctagaggattttgctttctctgtctcctttacttagtatttcttaaattacaaaggctgggaagaaaacaactttactgtagcattttgatttgagtgaaaagtatttggtcatatatttgacagctagggctgcagatcttacgctttctattaatgagttgatatccttttatctgtgttcaaaacatgtggagtttgatggttagtaccatggaatggcttaggataagttttatggattgattgatttaacaaacatctgaggaactgtggtaggggccagctgctctgcagcagggtgtgttcctcaagagttcagagcccagtgcagggaagagagcactaagccaacaactacaatcaactataggaagtgctgcaacagggctaagctcagaggaccttgggagagctcttctctttggacaaataaaggaaaacttcgcaatgatgtagcagatgctttgggggcctttcataatagctcctcagtccacttctgatttcgttgcccaggtgggggacaattctgacacactgagagtgtgagctgtgcctctcagcttgtctgtggagggctttctctgaggcatcaagatctggaagtataaagtgtccagttacttaatactcctgggggtaacatctgacgtgaggggatggaagccaattgactttaagtagacaatcctgagaaaaattctccgtggttttcaaaggccctaacattgtctatagcaataaccttgataatgcagctttacttacttttccttcttccctttctcagtcttcctacctccctctcctacttcctataatcatttcccaagtaaatcacctgcacttgagcccctgattcaggctgggctttcatgagaatccaaactaagagagaatgtggcatttcagctggggaagaataatgtgaggagggatttgttcatggtgtatgtgggcagaagggctgccataacatcaccaagaaccatggggtgtttcttggtggcagtaaagatgatgaagcatcagagtatgctggccagtgggacctgagaagggagagagactggcgaaatatgctgggattagtcttgaaaaaccgtatgagacatagctagaacttgggactatcttgcaagtaacagccagccagataaaatgcttagcagggatgtcatgcatggaggtcagagaccagaagtcaggcagttatgagactattgtaacaggccaggtgagagaggatgaactagggcaggtcagatatgaatgaggaagaggagactgcttggagagaggtggaaacagtagactcaatggatttggggactacatgggggccgaaggaaagggtgaagttcaagttgtcatctagctttttagcttgggagattggatgaatgacgatgtctttagctagaaaatatggaaaaaggaggatgtcagaggatggggaaggacaggagagaattgggcacgcaaaatctgaacagtgtcagtttgggatatgtcctctggaagactcctatgagctatcccagtaagattaaatggacaggtgacaagatggatctatatttagggagaaaaaatggagctagagatagaaatttgaaagttattaacttttgtactggataccatggaattagatgaaattgcctgagaataaatggtgaaggggaaggagagatggaaccaaagctgggccgtctgtttgagcatcacataagacatcaaataaaagtttatattaacaaaataaaataatcacctatatttccaacacatttcctggaatatacattacaaagttgcacgatattgctattctctatgtatgtgtatgaagtttgactgtctatagatttttaaaaggctatatttagtaaaataatttgatgaatatattcaccgaagaatgggtttggctgaattgatttctttgtgatttttgaacttgtatgtagatactgccattgataagagccaaaaaagaaaatgtttaagcctggaaaccatgcagtatatataccctccagcagtttgatctgtgggtgatttgaacttagggcacccctggagtgcagagaaatgccatcaaaacttttgttctgccaggcgtggtggctcacgcttataatcccagcactttgggaggccacggtgggctgatcacttgaggtcaggagttcgagaccagcctggccaacatggtgaaaccccatctctactaaaaatacaaaaattagctgggcatggtagcgggcacctgtaatcccagctactcaggaggctgaggcaggtgaattgcttgaatctgggaggcggaggttgcagtgagccaagattgtgctactgcactgcagcctgggtgacagagcaagactccatctcaaaaaaaggaaacaaacaaaacccttttgttctatggtgttgtaccctacactattaagaggaaatcttaggttagaattgttctattaattttttactgctgtgtaacaaattactgtaaacttagtggcttaaaacaatatcaatgacctcacagatatatagatcagaagtctgagggggcttggctggattctccgtttaggatctcataaagcccaaattaggatgtttacctgcctgggattttacctggaaattatgtgaagggggggattcacttcgggcccatccaggttattggcagaatccaggctgtggtgttgtaggttgaaggtccctgttttcttgctgactgttggtggaggactgcctcagccctattccttagggctgtccacatcctgtttcatgtgtcccccagccccttcttgaagtcagtaacagcacactgagtgcttttcacactgaaaatctatttcttctactgttgactagagaaaacactcttttataaggctcatgtgattatattaggtgtacccagataatcttcctaccttcaggtcaactgatcagtaactttagtacaccggcaaagtcccttcatatcagtatatagattgatgtttaattgaataaccagcagctaggaatccagggtggccattttagaattctgccaatgttatctagcaattcagcaaatgttatgcaactccgggagtaccaaaagtgacctgttagtccctactgactagaccatcacagccttttagccgaaccctccgcagtttctcttgaatttcctcatttatctattctgctgattctgcattccaaaaaatttaggaggcaggctggtgataacctttcaactgatgatagcgggaaaggaaggaaagtagggtctagtcattttcaaactaattgtttctgagtcacactcattgtgtacaaatgtgtcttgtgatttgtttatatctatcaaaaagaataattcagtatgatctatttaaaaatcctatatcataggtaatgtaactgaccaaataaataaagtataacaaagattaaaatacagaattatagttagaaagtgggaggatattgggaaaacaatatatcaaaaatagtacctgaagaaagttaaaataacatgtaagtccaaaggtaagtatagatgattgtcttcaatgggcttacagtcagataaaatggttttaatttttttaagctaaatgatgatttttttagagaaaagcttgtaaataagccaaatatataaaaccctaaaaggtgagatacttggtttggaataagggagagaggccaatagtcccacactttcagcttctttatatgcctctattctaaggcaaagtctctttgaggtccctggagtattgtagattctagtatggaaacacctgggttagagatgagggctgactacagtggacatttataatttcttggcgacccaacatctatctcatgtgtccaacagcctgtattttctcctggtgaacaagctctcccccactgtctgctcacatggtttgaagggattgatatcactctcagatgaaggcttttgttctcattagctcaatcataagtatgtcctcctaactcagccacagtgattgtttaaaaaagtgggcatataacccaattctgaccaatgaaagttggacccaggacttttgttctagctttgcagaaaatatgctcttattcttctactggacaaaaagctgagaggaaataggtctgctatagccatgtgactgccactgtgggagaacctgtctcataatgaattcaacccatagaacaaagccaggatgagtcaaatcaagagcaaagatagggtgaattgcattttgatcatgttttctgagcaccaggaaccaggattactctttaacttttcaggaacataagctctttctgcttgctctatattaaaaaaattgctgtgaggaatattcttaaatgatacaatgaccataatggaaagtcaaattactttgtgctgaatggaggaatcaactaattactatgcaagagtaaaagaaggaaatatgatttctttatttagtgttggaggataggattgtaaatagcataggatgatgattaatagaatgtcaaaaggtagagaggaatagaagaggacatttaatagaggttgagattagtacaggaggatgtggtatgtttaatattttcaatgcctggaacataaggtatggtacaggaatgggagtctatgatattcatgctacctgtagtgagcatctattgatttgtttttttttttccacccctccttaagggaacagcaaaccatttccttttgattatggctttacccaattctatctggactgccattcacactgtccttcccctctggcttcaacaattagcctgagtggtagtcatatgatcgaagaagggtcaagcagggtccttctctagaatgaaatatacagaaagatgttaagaaatccctctcagggccctaaactgggatggtataagttgaggatgattggttcataactcaatctcctcctccgccccgactacttttatctccagtgcttatctacagtagaagaggatgagcccaacagtctgagggctgggccaagagatggagagagaaaaaggaggagaaatacacacagacaaatctggtgatattatctctgttggcttcaccttgggcttcccagttatgtgagccattatcccttagcctttcttttccatctcttaagctaacttgagttctgtttctgtcacttgggaagaagactccaatgctatttcactcatcattcttgcacctgtggcagacattactagttgattacagcactctttccagttgagctggaatacacccttagattgcttctccatgtaatgcttcatgtagacactctcaattgacctaaggtgacatgaaaactatttttaaatcttacgtggagagaggaattgtcagataaagctaataaagttgttgagctcaacatctggaaagatttgaatgccatactaaggtgttcgattatattaacctggcacttccatactggggattattacacttgagaaaaacaagtcagagaatatggcttagcaagtctaaatcactggagtggcatttggcatgtggtgagtttcttatttgtgatggttttttgttaactccattcaagaggggtcaggaaacttcttgagtattgccacggtttggatatggtttgtcccaaccacaactcatgttgaaatttgatccccaatgtggcagtgttgtgtgatagggtataatgacaggcatttggatcacaggagtgcatctttcatgaatagaagaatgccctttgttgtgggtgagttctcattctctcaggaaagattatttcccacaagaatgagttgttaaaataatctggcttcctttgtctctctcttgttttctctcaccatgtgatatctttgcacatgccccctccctttccactttctgccaggagttgaagtaatctgaagccctcaccagatgcagctacccaattttgaactttccagccaccagaatcatgagccacataaacatcttttctttataaactacccagtctcaggtatttggttatagcaacactaaatgtactaagactagtatcttaacataatttatacagaaaggcattttgcatcctggacctcaaatacagcatcagaatgaaggttgaggtaactgttattcattgtaaatacagtttcagtaaatgctgtaaaattgtgatggaaattttgaagtaaatgaaatttccttaaagtatttatttttagatggactctgggagccccacagtcagatgaagcctctatgaatcagaagagactgaatgaatagaaacaatttttcaaacagagttgaaactggagtcagaatagcataattcataataggagatcatcttgggtgaggcaaacacaaatagaggtttgtggctgaggagttgaataaaactgaaccagtgtgaagtggtttaggagccagtccggagctaacagggagtatcctggtcagttttcttggaaatagagcctgagacagggatgtggttatgttatatgtgatttttgagcaacaggtcattatgacaaacctctgtgaacagacagagagagaaagaaacagaacaggaaaggaaaaaaagtgaagcctagcctcagtctgatcactaaaagtgggagaaatcttgagactaaactgcaccactgagtacttgacctgccccagccctttgaatcttgtctccattagttattggccatcaaggaggttaagcaatttaaaatcgtccaaaagccatccaaatggggagggactgggaggaacctactataatagctaattttatgtgccaacttagtgggtgtttttgggtgaagctgaaatttaaattggtagactttaagtaagcgaactgccctccatgttgggagtgagcctcacccagtcagttgaagacttgactagaacaaaaatactggtctctccaagcaagagggaattctcctacagactgcctttgaactttatctgcaccatgagctctcctgggtctccagccagatggccacactgaagatttagtcttgccagtctccataattgcaatcgtgtgatccaattccttaaaacacatctcttcacacacacacacacacacacacacacacacacacacacacacacacacactttctattggtttttgtttatctagtgaaccctaatatgcctattggaagtctctgtctcaggggaggtggttcccatcagccaaggacaagtcttctgcaaagctcacaggtacaagctcttagaagtggtccctgcagcaactgggtgcaccagcaaggaacaggaatcttggtggagtgccattctacttcagggaggatacatttggacaatgcttttatggagtgcttgaagaatgctagaggaataaacagcatggaattaaatttattttagttgcaagtgaagttgatggcccttcacaagttcctcctcagtatattgtcagttcttgcaaagctccttttagtaaccatttatttgttagtatggcaacatgatatggtgatttcaactttttgggctttaaagtcagagacacctgttgaaattccagctccctacttaccagctgagcaacatttgcacatgtaacttaacttctgagttttgagtccacatctatatgataaatattataataaccacctgaaagatgtgttgtgaagattaaaactaaaattgatatcatacacagaaagcagatatatgtcacctgtgaatactaaactcttctgtgccagacagtgggttaagcaatttaaaatcatatgaggctaaattcccacaacaattttctgaagtagatattcaacctgttctctaatgtggcaactacggtgcagaaaggttaagacatgtgcccagggtcaccagtctgggaaacaaaggagctaatgtttttctaagtttgtatcaggaagtaaagactggtcatcattctatcctttgtagaaaacagcacagtgagatactgttcagcttctgataaatagaattctagaagctttgtgacttggttgtcactctggaggcgtgggatcctgctccgggaatctaaaatcatgagtcaatgctgcaggcttccaccaccctttggaatgctgcagtaagagagatgagaagtgggaatgtctaggatgccaggtgggaggggcacttggccattgcatcttgaatccaatgtgtccagtgagcctcatgctcttcccaccgcctgccaatcatggtggctaagggaggtgagtaaatggaatccaggggaaaatgagacttctcaacttcatttttgtatgccataatcaggatgcaaatcaaagtctctgggactgaaaaggtcataaatggaaaacctgctgcacctctgagttttcatagatttcaatgatttggtctaaatccagatatcgtctcaaaacaataaaaaggctgctgaatggtaactgaggaggactgctaaactctcagcgagctcctttgacgttaccaggggcatttaattttcatgttcttgcagtaaatttgaaagcaaattataaaagtaaggctcagttttggtaaggctccaatttatttgcatggggcttcttctaactaggctttgggggctgctggctagtaaagtttagatttaaagacctttgccaaagtgtccagtgtaaaaagttcccgcatttgtggaatttccaaagacattttgttgtatgctcctaggcctcgtattatccacaggtttggaaagtgggatgtggttgctgggaagtaatatttttaaagggcaagtgtgataggaatcaaatcactttgtctaacgtatttagggaaatcacatagtgtctgcttctacgttaaaatttaattattgctttagtttcacaatttgcctttcaagggaaattgaggcctgtaagaggtgttctgcatagtaattaggatctccaggtctcagtttcttcatctaaaacatggtgataatagatgaagtaaatttaataatgcttgtaaagcccttagtgacattggtgacatatattatatattaagtacagtcagccctttgaatctgtggattcgagcaaccacagatttaaaaaatttgaaaaaaataccaataaaaaataacaatacaacatattaaaaatgcaaattaaaaaatacactataacaacaatttccatagcatttacattgtattaggtgttattagtaatctagagatgatttaaagtataaaagaggatgtgcagaagttatatgcagattttgatatctgtggggtcctggaaccaatcccccatagatacagagggatgcctgtacttataataggaagctaatatagcaatcattaacaggaaaaaaatcttgcagttataggatgaacaaaaattgtttgcaatccatgaggctgagaaatagagcaatctacaggttttgacccagacattatttggactctggtgcatgatcaatggctttgaatgaggttgcttttttgaaggagggaagatggatctccgtctactctgaacttcattcgacactgaaaaggatgacgatcagtgtcatggtgtatcagggttccatttttacaaatggttgcacatatccctcatttgagagttcaaatgagcagtttaggaagagaaaatgagtatctatgtttttgaaggccaacctgggaacgcaaatctggaatttgggatctcactagaaagcctgtgttatttaaatttccaaaatgagcccttctaatgtcacctcaagctaatgtgtgggtctgtttgaataacagctttgagcaatttcttccaacagtgcctactaagcaatccaggataaaagtattgtttttccatgaatggtggaattgtcaggaaggcaacaaattgcaccagacttttgctggtgaaacagaattcaagcatgtttttttgttgttgttgttgtttttactttttaaaaaaacctttgagagactactgatgtgagaatactatatgcttgctagagattctacagatgacaacacactatactagaatcttgccttatttttctctttccactagccccatcaaccatctctcaccagaaagaataggtgaagaggttgagttgtagatctcatttctcctgttttgctgcttgtgaagtctgccaacagaatccaccttgacaaagtcaaggactgtgcgtttaatgttgaactgagtgaataaattatgcatgaaattgtgccggagtctctagtgtgcagaattgctccttttgatatgaaaggttaattcagaaaggagtccaaaatagctggaaattgtggggataagtggagagtattcactgttgtgagctgttattactagaaattgcattccctctctggcttccccagagatttcgctttgccagtgaatataaactgtactcaatagaatagcatttaggagtaacaagagtgtatgtccacacacaataaaatattctaatggtgttttaaagagaagttgtcctttttcatgtatatcatgcaccccaaggaagaatttctattgtatttaggtcaagaacaaggcatatcaaaagtaatgagttttgatcatatatgtgttacaaggggctgtttgagattcccatttcagagccagggctggtcctgccactgattagttatgcaagcctggcttttgataaaaccgaaagcatccttgagaaggaaccaccccaaattgttttatcactgcatctcacgcatccgtctttaatttaatcttcagtaaatttatggagttcttcaacctgtttcacttaaatgtcctttttacacacatccttatatcatttttacgttagttcattatttccagcagaaaaaaaatgtagttggccagaaagctaaattttacttaaaatacacgtacacatatttttggagcttgttagagactcctttttgtgtttctatcacaagggaacagaattgtgccaccagactgtggtagttgtttatttttgtcgctcttatgtacattttcagaaaccatctccttaatctccactgggtaccagtagttttttctctaattataaagtgatatcatttctgacctggggtagtttttaattttaatttctgctttgtgtttataaactgatagactacattatcctgttgggaacattggcagaaagacttcagtcttttgtgttggttttaacaattagatattcattcaatgtattaaaatgtgtttggggccaactaaagatgcatttttgatgtagatttttttcctttctgtgttccacttatctatatattttacattagcaatgaagcttttaaaattctagattggtgatggtgaatagctgtagtattattaaaaaaaatctaacaaaagttaaagtgaacaaaattgatccaattactcttttttaggtattccttttttgtttcaaaatgtttatgcagcaaaatatatataaatcttggcatagggaagatattcctacgaattttggcagatgctgggttaaaataaagtagttattgaaacaccaaggtgcctgtggggttttttttaaatgtgttttttgttactttatggcattaccaatgagcatttagaatgaccaatccttagcccactaattaatgccaagtgtattaagttttttgttctgctgcctgtgactcattagtctgagctctggatagcaaattggcaaaatggcctcttgtcactggaaaatcttcctagtacacaatgaaaatatattgcgcttagggggtaaaggggatgcagatttttttttcaggtgaatctggatgttttaggctgctaaagtttgagaaataagtcccaagacactatgcaatgtgcttaacattccgatgattatagtggtatgtacctaggtaatgttagctgctgtgtacttaaacatattttaagccaaccagatattcatttttgatgtaagttcaaatgccttcaacagatcaaactgaaaaatcattaaatcaactttgtagcactgagaacaggtatcaaaggcagtgaagatacggattggtgtctggttataatttacacaatgtgcaagacagactaaggagtagaaattttcctattactgtgtaacacacacatgcacaaataaaacaaaaactggaagttcttctaagcaatatttattgtagcattgatatacttacaatatatattacataaataaaatgtaactgtgtttacatataaaatctatacttcacataaaaaggaaataattgtaaatattttatatattttaaatgttttatataattttaattaaactttaaataaaatactttaattatattaaaatattacataaagtaaaatactttaattaaagtattacataaggtaaaatactttaattatattagagtattacataaagtaaaatactttaattatataattaattatatatatataattaattataatatatattataattaatatatataattaattataatatatattataattaatatatataattaattataatatatattataatttatatatattaattataatatattataatttatatatattaattataatatattataatttatatatatcgttaattataatattaattataatataattaaagtattttatttaatattatttatttagtatgttttaaatattttacttaaaagtatggtgacagaatgttgacttttaccccagacatttttgcaggcaaagaatcacccatcgaaacaatttagaagcaaatggaggatcttttccataagtaattaatacctttaaaagcatgtttgaaataattagttaagcaagagaatcaatctcttttaaaagcttccaattcactagaggctcattcagtagcacacacctgctcaccaatagtccaatgccctgccaccattaatatatttttttttcatccaaccccctttttctttgaggggagggaaagttgatatatattttcttaaaaatatatttgcttcttccgcccccactcctttaccccaaggtccaaaaacatgatgcattcatttctcactccaaagtgaagcgactagtgaatatttagaagctcgggttttaaattgcatatattaaatgcacataaaatgaatatattgtttgtgaaatattaaaccaagtaattttttcccagttgttgagcacaaatgtgggcttttaatgcacatgtgttaccttgggaaaatctggagctttattagctcttctttaaatcatacaaattattccttttaactgtaaatgatctcttcttttggtaagtttccttaactaaagataacttcacaaaagcacatgtcagctaacgagaaacgcaaggagaaaataactctgttcagaggtgatttatctttttaagcatcactcgggggccatataaaaggcaatttttaaaatgcaagtaatctttaggaaaatattatgaaaggacactgttagtattctgttgtgttgtattagcatccatttcttgggcaagatgtttcattttaacaatatcctccactgcatgaaaattaatttattttcttctttggcacaactccatgcctttttttctttatcatcccagtggatgaaacgatctgagtgagcaacatattttttttgaaagaacaaatgtataagtgaaggtgaccaatgaaaatatttagttaaaaagggaaaagtgattgatgcagatcttcccggtgagcactttggagtcctgctgattggctataagaaacaaccatctaccccaacttttgagggaaatcattttaatccatgaatgctgcatattgattttggaagatttgcaatgcggtacatgtaatgggtatttttgcagctggtaccaaatgtatccaaaattaatatttattttacattattcattttattcttgtactttccaatttttaggcatacaaattaatacttaccttgaaatacttttgaaaatcagtatttttattacttggaagcctgggaatcctgtttcttttgttgtttcacattgcactacttttctattgcttttgcaacaaactactgtaaaccctgcagtttcaacaatacgtatttattattgtacagttctggggctcactgagcaaaatcatggtgttggcagggctaaattcctttctggaggtctaggggataatttatgtctttgctttttcctgcttctagaagtggcccacattctttgtctggtggccccttcctttatcctcaaagtcagccctgttcatccctctggctcccttccatagtcacatctttctctccctctgacatcatcagggaaaggccttgttaaggactcatgtgactaggctgggcccacccaggtaatccaggttaatctatgagctcaacatccttcacctttgttacacctgcgaattcccttttggcaggtgaggtcacatactcacaggttccagggatttggatgtaccattgttctgcttactgctcacagaaagataaagaatgttaacagtaatagcagttactgtcattttttagttgatgcctcttttggaccccttacaaaagtgataaagtatggtgcatagtatgcactaagtattttttgggctaacgaatgaatgaattaaggataaaactattgcacaggaacaaaaaaatatagtagatgctcagcaaatagtaggtattattattattatataatttctctctctctctctttttttttttttgagacagagtctcgctctatcacccaggctcccaggctggagtataacagtgtgatctcggctcactgcaacctctgcctcctgggttcaagcgattctcctgcctcagcctcccgagtagctggaactacaggcacacacctccatgcacagctaatttttgtatttttagtagagacggggtttcaccatgttgtctggctggtctcgaactcctaatctcgtgatctgcccaccttggcctctcaaagtgccgggattataggcatgagccatataatttctcaagtatcttcaaattgtgccagatgtgtgtgtctttttccatttgtgatactatagaaaaacacctgagactggttggcttacaaagaacagttctggagcttggaagtccaagatcaaggtgcctgcttcttgtttagaccttcttactgtgtctttgcatggcagaaagcggaagggcaagagagcgtgaatgttgagtcaccacatggatgaagagcagaagagagttgatctgctcttgcaaaccattttttatagtggcattaatctatttatggggagtggagccctcatgacctaaactctttccattgggcaccacctccccacactgttgtattggggattaagttttcaacacatggattttgagggacatattcaaatcatagcaatgatttgaatagcaaaaataccactcaggtaattaaaagacacattttggttaagagtttagactctggatttattcattcatttttttttacacattccacaattccctattactaaatacgtactgtgctaccggctgtgaatacaatgatgagcagaacagatgtgctctcttgcctcatgatgctttcaatctagtggaaagggcaaactattaggtaaataaacaaattaaggttcatatcctggtgccataacttaccagctgtgttatgtgattctgggcagatgacttaacctctctgaaacttgatttcctcatctgtagctgaggttaataggacttaccttgagaggtttttataaagattaaattacttattacacataaatttttattacaatccttggcacataagaatcatttttaagtaacttttaaaaatgatcattattaggcacctaaagaaagcttgactctatttttgatgaggaagtttcatcctttatagggacaacaccaaatatcaatataaactttaagagggtaaaactgtatcctaactttctctcactgattgctcatgctaaattttcaagaaaatactattactactactattgctactatacctataactattaatattattacaatacttacctttactaacttcttcttatgtgtcagacactattctaatcactatgtctgcattatattatttaatgcagatcacagccctgtagtgtgaattggtcgctcttatagaactcacttcacagctaagaaatttgagagaagacggttaaaccctacatctacaacaggagagtgacagagccaggattcctactcaggcagtctgactcaggtgtcaaccattctttggaaggcggcaggatttgggataattttccaatgaggcaaattgcatggtgtaggatggtgtgaaaacagaagaggactatagcactgagaatttcattttgctctgtattttctaagataaaagatcaaagagacataactcctaagataaaagagacataactcatttgttcatatatttattctttgatcaaacatttactgcatacctaccaggtagtgggtactgttagaggtgattaaatttgtgtcctcaaggagctcttagtacattgtcgggacaagtagtcaccatggagtttgctgcctgtcttaatagaggtctgtgcatatgatgcttaggaaacttcagtacatctcacctagcattctcaccagccttttcctgggtggccaggaaaggctacccagaggaaatatgtcatgaggaacaattcatttgcttactaaaatcttagaaaattacttactggcaagatatgtggatatgtacataaatgcatatcacaatgattaatgatacaggctttggagttaaaactggctgctttcaaaccttgccattgccatttatgaacctttgaccttataccctttaagtcttaagaatatctctttctttaggttgaggtgaagactacaggtagagatcttggtaccatgtctggtgtgtggtaaatggccaaagcccattaatgtttattatcatcattattgttgtcactagcatcatcatcaccatcatcatcatcattatcattataattcttttagaaataattctcaaacaacatgacaggaaatgagggattttttgttgctgttgctgaattattaagaaacagtacgttggtcttaatttttaaagctggaaaaatttcagtcactttataagtccctgtgatctcatagaaatatatattactggaattgatgtgtggaaagagcacagtttgtttttaccccagctgaaaacgtgcaatgacataatgtaaccctttaagataacagaagccagctgccccattcacatttaaatatgagtcaccttccagggagacttgcaagattctatgtgccaagctggaaaagtaaaaaattgccagcaaggagggaaagaataaattcacaattggaaggaggtattacaagctaaaggccccacctagccaattccctctcagagcagaaagtggcatgctagtggccagagagaagaactgccccaccgtggcattgtgatctatattactgaaacacagaggccttgtcacatttagaaaattctttctactcgattaaaaatattttgcgttctgtgtaaatggcacatttgctcaggtacaaacacagtctgctgcaatgaatttctgaaaaacgcaatatagttatttatgaattcctccatctcacaaccccacccaggaccttggcattgggttggccagccacttccaatgtcttccagtacagcagagcagctctcagaagaaaaccgaaggctatagggacaagaaaagacaggcttgaaatttcaaatgatgtctttgtgagtgtttgctgagaacctatcagaaagaagagacctgtatgtggtgcttgggaccaacattttaaaaattaattacatatgttaattgacttgacacataggcaattagaagaagttaaaggttagtttaaaggaatgacagactgctaattaggattcccctcatggttgaatcagatttgctatggatctgtcttggtcaactttcacctgaatgataattcagtgatcaatgatcagttggttgactcgaaatccagaagtcactttaattttggcagtttggagaggcggaggcatagactaatccatgtgcctggaagaagtcatgctcaccaggcacagcagtgggtgctgttttcaagaatagaggcagactggctgggtgcaatggctcacacctgtaatcgcaacactttgggaggctgaggccagcggatcacttgaggtcaggagttcaagaccagcctggccaacatgacaaaaccccatctctactaaaaatacaaaaattagccaggcatggtggcacacacctgtaatcccagctacttgggaggcagaggcaggagattgcttgaacccaggagatggaggttggagtgagccaagattgcaccactgccctccagcctgggccacagagtgatactccatctcaaaaaaaaaaaaaaaaaaaaaaaaaagaaaaaaaaagaatacagcagattgttagagaaggtaaaatgggaagtataaaggtgaacttgaatttggcttttcaagaaaatcttttggaggacaacttgataatatgaatcctacactttgacttctaattttatttctaccaattaaacaacatagttcaagatgtacataaggatttaacagggaagatgttcagagtagcattgtttaatgaaagattggaaatcatatataaatatttattaggttggtgcaaaaagtaagtgcggtttttgccattctaatggcaaaaaccacaattactttttgcaccaacctaatagaataggggattgataaataaattataaacatccatacaatgaaatatttctgtgctgttaaaagggttgtttagcgttatatttatggacacacgaagatgggatctatttattgctatgtgaaaataaggtggtagatctgattttggttatgattttatataactagcatctttttgtacaatgttatttaggttaaaaaattgtagagtgtctcattagatctctttccatttctattaacttaataaatttatgttggtggagttctgacatttaatttcttagctttgtaaaaagtaatatttaattttattaaagagaattcaggctggtgcagtggctcatgcatttaatcccagcactttggaaggctaaggcaggaaaatcacttgaactcaggagttcaagaccaggctgggcaacgtggagagactgtgtctttagaaaaaaattaaaaagtaaccaggcatggtggcatgtgcctatagtcccagctactcaagaggctgaggtgagaggatcatttgagccctagagtttgaggctgcagtgagctgtgattgcaccactgcatgccagcctgggcaatacagcgaggacctgtctcaaaaacaaataaataaataataaaaaagagagagaatttaaaatatataacctatttattttcttaactctgtaactacttattcacaaaaaaagcaaaaataaagtattacccacaagaatattcccactttgacaatgtccccagaataatcacagtctctcacatactctatgtggccagtctaatatcagtgtgaccccactgcagtgtcaaaaaatatattttgcaggagtaaatgacggaggagcactcccaatctccttgagcaaaagccacctcatctcttctctcccctgttacctcagcagcttcctgcaatcatagaaaaaaatgggagagtaacacattgtccactagatatatgtgaagaagcactttataatttcagcattaaattttatttgtacactgcatgtatgctactaaaatagtagcaaaaattggtcaaatgtgagatttggggaatgccattccacctaacatttggtggtggtaagtggaattctggcattaatgttatgtaacatatgcatatttgcatgtatgtttaaatcaaggtttctcagtcttggcatgattgacatgttgggctgaataattcttcattgtgagggggtgttctgtgcattgtaggacgtgtagcacctgtgaacaaccaaaaatgcctccagaaattgccaaatgtcacctaggagttagaggttgggagaatgtagggacaaaattgccctcatttgagaagcactggcttagattgatatatatgtattccaacgttaatgcgtattatttcagggtggcaagaacgtgaatgatgtccccttttctttctgcttctcttgttctactttatacatcttgacttgtgtttcttgtatattaaagaaaaaagtcaaaagacaaaaaatgcgtaataagcctatcagtgctctgaaaagcagagcatacagtgctgtcactcatggtccttgcagttgcatagtgctttggaatttgcagttcccttcacatatgcttatcatccttttggagcattcatatcctgggaaataggtggatatggattattacttttcttctttacagggagaaatgctgaagtctagatcaaagtcattgtagtggttaaatagcagaagttgcactagagctgcagcttcttgactcttgaattacattaaccactgctcactgatagggagcctgtagccttttccatgcattacatgtaggcatggctctgagctgtgtttgccctaggggcttgtgtgcatatcactgtgatcatgaagacttgtcaatggggcaattgaactaacacatagaaaagagatcagaaaggcaaggcattcccctgttaaagatgagagccactagtggtgaggtctcagatgggtgactcatttccttgactgagctcccacatagagtcccaagccattctgaggttttcaacacacaaggagactgacacgtgctaattttgtaagatactgtctgtgaaatattttatgcactcagtttttctgtcctggatgcatatatattttgaggaattttaatggaattagttcagttaattcccagggaaacagacccttccaggtttcccattatactacatatctgggggtctttctttttttcactggtgcatttcctatggaactattaacactgctgggaattatgcatgtgcattgacaggtggatatacccacatgttgggaatttaatttctcagtctatgtatgtcttggataaggtacagtaattattattatccattaatactagaatgcacaaaaatactctgagaagtaaatatttaatatttcacactcattgccttttttttaaatttactgtgtgcataacaagcaaattgtacactttgtcttcctgcagtcttaaaattaagctcttttacttttgaataacaactggttggcaaacacttaccatttaattttcttacgttgagtatgaagcattccagcatatctgcaaagtagtcaacatatagatataggtgagtgtaagaaatcttgctttagattttaattttagttttaattttaagagcattaatatcttgccccagtgactacacttttaatttaacctgctgtactcgcattctcacatttcaaaactgacaagtgaatggggagggagggaaggctttatgtagtgttgaacttggcataactcctttaaaagcagtaatacccatctctggatcttggaatgcacagcaaggaagagagcccagcacataatttggttctccaaataattcctgaactaatcaaagaaatctgtacctcataacgcctccattcctcctcttggatcctgtgtctgttgactttgcatcctctcttgttcggtccttggtttgaccttcaaatctgaccatttgtctttagggttgtgacattcttttctatctgtgacttactcaagtctagcaggctaaacttgaccatggtcaccatgtataacattaacccccaaagttaaaggatgagtttctatcatccaaaattcctcttagcttagattcagcattgcaaactctgttctgtccaagagccaggcaggcaatgttgactggtggagcgggcagtgggcaggacaacatggagtgatgaggactgtggtcagctagaaaaagttcgggactaatctcaacagggaagtagctgcttcatccctgctcaatgttgctatttagaaatgtgtacctagacttgccagatctttttaatttttcaggagaagtcagaaatttagacttctggctgaaatatcttgattttcaaatgtagcataaaatttctaatttttaaaaacaccatgcatatcaattacagaaatttgaaatgctatttgatgatgtcaaggaattattattaaattttggtgtgatcttgatcttgaaactgtagttgtttttttaaatgtccttatattttagaaatattaactgcaatcttaacagatgactgatgcaacatttgagatttgcttcaaaatgatccaagggttggggtgaagaagaggatataaatgaaacaaacaaggctggccaataggttgataattatcaaagctggatgatggaggaatatatacatatttaaatttgtatatgtttgaagtttccataataaagaattttaaaaaaccatggccacaggccagatttgacttcaagctactagagttgtctctgatccatgaatttgtctatacacatcccaatctacttatatttttaatctgtactatatttggttgtagtatttttaaaagtttatcataaatgtaccactctaaggctatgagagctgtcccttatttcacaattcgtgaacttttttgaacaagtgcatgttcatcccatttactttgtacatttttaaacctccaatgatatttcccctgagctttcatccttccggaagaatttattattctctccttatataaaagttctcaaatttatcgacatgcatttcagaggctttccgttgaacttatcttatgtgacccattgtgtcttttctaaggcatgtggaattttgcataaattctaaataatgtgttgttgtatgttggaaaaaggagagattaatttccctttcaattattgtcaccttgttacctatttctccttccttttctttcaggatctgaaccatcctatttattccttcctctttggactttgagctctttgaggacaattgtagtgtgccatcttagtgcctagccaatacctacctcataaatagcctttcatttactcagagatatttatgaagccccttacttcttcccactccttcaactccactcctttcttgccaaaagtgttgtctcactctctgaaagaagagagcaatatttcagtgatcctttgggcaatttctgttttctttccaggatcactgcagactgagccagagccccatttatagattaatcttgacacctttctttctttcccattcttttccttcttgtcacacctcaaagttagagacaaagggcttcttggaattccttttgatttttactaatctcaaatttgatagccatcaccatgtgattgtccatctggccttcctttgctcctttattcaacaaagatttactgggcacatattatgtgtcagtcactatgtgtctattatcaaggatctcttggtaaacaaaacagacaaaaagtcttttcataaataaatgaagaggatgagtaagaggatttcaacaacagaaggaaagacttacgagcttcttaagaactgtatctgttcatcaaccgttcggctacctttcaggttttctagttttgttttctttttgtacatagttatttagaaacaacctgtccccttttccaattttcatgacccatttaatgttttacatattgtttctctctctctctctctctccccctctcttcactaaagcttttcttggaaatacactatcgaggtggaaagtgatttaacaaagtaaagttaaataatattaaaactcatagtgtatctattaaaatgtttatatttcacatctaacacttcttattacatgttaaaatacagtggtatttaaattaacaaaagattcttactcatgctacaagataaacagccctaatccagatactctttccactgtattaggcagtgttcagtccttatcagttgcatatatttttcctatgacaggaggccatattttgatgccaaagttaagtagtgctatattgaaaaaaagcctaatctatataaatgaactagtttaaaaatatgacggcatttagtcaactaatcagctatgaaaatagctgcaaccagagaaaacatttatctgtaggaagtatctaatctatttgtgtcccaaagaaggcaggcaggaatgtatggatgtgatagttagccaaagagactgtgcaaagagaaaaagaaatagtttcttaatactcctactaaattacattcagagcacttcctttctattactttgtcaccacatgaccttgcccaattttagtcaagtcagaatgcaaaataagtttcgtggataattttgttattggggaaagggggttaaaaatgatattctttaaatatgcccttcttttctatcttacccccttccctctctacttttgaatgcgtatcttcttttgaaagttaccagatcttcaaagggtacagtatttttaattcattttaaaagaatgtttctatatacattttttaaattttggattattctcgtgggactaacacaacactgaaaatttggcatctgcaagcataattcaatgaagaattgtctttgccttgtttgaggacatttagttttgaaataacagcattagaatcttttgaaaataacagaacatgaacagaaaattatttcccttggaaaaaactgtagctaatttttcctttggctgatttgctgctgaaatcacacattcgtataaatgccaagctatacatatgcatatacatatgtatatggatgagtgtgtgtgtgtgtgtgtgtgtgtaaaattccactctacaatcatgctataaattggagaatttgtctttttaaactaacactcattcatatacaggtcaggaagtattgcagaatgttggtgttgctaacacatttcatccaagatttcaattaatcaagttttacaattcccccatgcagtgggcaaacactgtcattttctcagctttattaatgggaaatttgagtggaaaatcctgttccaggtcaaacaaaatccaggtcctcagagccaaagagaaagggaaacttgagatatctatttgatatttcagttgaaaacaagtatttgttgagtgaatgaaatatacctattaacaaaaaaggttttgggatctgaattagtcaaaatatctcttcatttttttccttttgagaagaacgccatctaaactgtgaatttaactgaacttcattcagcctcaagaaagttgatgaggaagaaccagatacacatacataaatgtaggcagttgaggcttgcattgcacaggggttgcaagtgagacagaggtaaacagttctcacaatccagtttgctgaatgcaaaaggatcctgccatcatgaattagaatgggcactgacctccttagcataaagctgcatttctgcttgactttactttgaacctgcagttaaaagtttgtcttagtttggatgcggtaaaagttccagctgattcagaacagatttgggtattccagacagaatcaccagatctaacaaaaaggtcttctaaaaattcaaaggggtttcatgaagctatggggaaaatttcaggtttatatactttgaagtataatgtatgtcctggacccagttctagtctcagtccataaaaaccctgtgctggctttgtagccacagtactgaggagaagtaagaattttgtttagatggatgttgggcaattgataccattctcatttaacttgctgataattgcagttataaaatgggtcagccccagcaaccattcttgtccaaagttcttttataattacattgtcttgtttgttcctctataataggaggcctgcaattgatcacttgctacttaccagtgactgtatataccatcatataaatctcaaaatagataggttctattctaattttacagtttaacaaatcaagtcagagagattaaataattgactaaggacacacagctaccatgaagtggaattcagatttgtatctagtttgtaggatcccaagccctaagcctataggaactatcactactcttgtcagcgggaaggtattaatatacccgttttataggttgaggaaatcagggaggctagttgacctgtttaagttcataagaagttagttccagagcctgggctatatctggtctctattttttctaacaaggagctcgttctaccagaccccagacttgtaggatgatagaagtatgtgctggctagaagagctttatatgtattatttgtaaagtgacatgtttattgtaaaataaataataattcaacctaaatcaatagaaatttaattttaaatcagaggacgagaacattaggtaagcattttagatagagatcataaattcaaaatttagttcctgtagtagccagggttattcagataaaaagaaccaatgggatatatagatatatagaaggagattgatatgagagattggcttacacaattatgggagttgagaattcccatgatctgccatctgcaagatgaaggcccaggaaagctgatagtgtagttctagcccaatccccaaagacagagaaccagggggaactaatcatgtaagtcccaatctgagttcaaacacctgaaagtcaggagcactggtgtttggaagtgggagaagataaatatagtggcttgaaaagagagagcaaatttatccttttgttctattcaggccctcagtggattggatgagtctgtccacattggtgaggacagtctgattcaaatgctaatctcatctggaaacacactcacagacacaccagaaataatattttaccagctatctgagcatcccttagcccagtcaacttgacacataaaattaacccccccagttggcaagttaaattggctatgggggactttctagctgttttagtgaatgacaccagcatttattcatttgtcttacaaatatttagaatcatgtactaaatgttcactgttaagggtaataataaaaagttgaagaagacagactgtcttgaagatcctgagtgttattggtgataaagatctgatatacaggaatcatggataacaaaaatctatgaagtgctgtagaatgtatgaaaaaagaaagacctttgtcagttgatgttagtgaaggactcttcagggagattgttgatcttgagctatgtcttaaaggaagaagaaaattgggatttgttgagaattagatgcaggagaatcactctgttagtgcaagacttacttattgctggaatattgagtgcccacttcatgccaggcactgtgctagttgctggggacgtggctatgacaaggacagaatacattcccttatggagtgtttggcctagagggaaaccaacagttaaacaaggaattattataaagtctgtgctgtgagagcttggagaaggggaacttgaccagcaggagagtctgggaggcaaaacctcccaggggaagtgctattttctctaataaatatgaaaaagtcaaaagatgcactgactatggtcataggcactataattcatatacaataacttttagtcaggaaccaatttttattttcctctgccattccaccatttctgagcaaacttttctgctatctattgatagatacttaggcttcaaattaatttgaaggttatcctggggaaaatattatgatggcttattatttccatcacctcctatttgctgtcacaacttggggggagatgctactggcatctggtaggcagaggccagggatgctgttaaacatcctacaatgcacaggacagtccccacagcaaagaatgatctggcccaacatgtcaatagtgcttcagtaccctgatctagacatagaaaaacttggactgagtttgggaatctgagcagtccatattagcaaagcttagaatatgtacatatgaaagggaataatgggttagacaggccatactgtagagggtcatggatgtaggtcagtggaagtctgtacttaagtagtggagaaaagatgagaggaagagggagtgagtgggagtggaaaattatctggatattttagattggaagtcgtgagagcttaaactggagacgatgccaatgaaaatggaggaaaaaggatgtatgccaagatgcagacatccatgcataaaaggatgtatatcctgacttcaggaggagagggaaggccattccaaaggtggtagctttggcagtggtgctgccattcatgagtaatagacaaggcaggaagagggatttgggggagaaaaatgaatttgggtttgcgtgtgttgtggttgagataccgacaggacctccagttgggactgcctagcaggcgaatgcaactgtgagtcaggagctcagagccatgaccaagtctagggaccatgctaacatctttgttctaagccagaggtcctaaattggcaacctgtgggccccatctggactacagatgtgttttgtttggcctgcgtaatgtttaaaaaatctttaagatttgtaacaacatacacatcgagagactgcatataaaaacccatcttttctgcttgtcttgaaatatcagagcatctggcaattctgggttctcgtttctgcatgggcaaagcctgagctgaggcttggctgcccactttccacagggcatgatgtctccagtttgcctcaatccccaccatgccctgttaaatgtcacctggccagcccacctcccaagtttactttacctgcctaaaatttgcgtttgcaacgcctgggttaggttatgactgtatcagatgctagctccctccgcatctacccacggctacattcattccccttgtgtctcctcaagtgtgccttatgccttcagcatctctggttaccctctcagggttttcttttgctgtagatatgcacaggtctcttgtcacttgcaacagcttcacttgattctgccatctcccaagttcttttttcctttgactcattcattttgttgaatgaataaatgattctatgtgtaaacaaaccagctgcttacacttatgtctttggaacccccagactcccattcgttctctgcagtatttttgatccctggccttagtcttcaccattctacaggcaaaccctccacagtgatcatccagcagccaagtgcgttggttttttcttctctctaagcacattgcaaccccatagtctgtgtgccactgtttcctctgcccatggtgctgagacacccgcatggcccgtttccccacttcattcatgcccatacaaataataatatcggcatgttaaggaggcctctcctgaccccactgtctaagaaggcccctctccccatggcatgctctttctccttgccctgttttattttcttcacaacatctgccaccacctgacattatattaagtagaaccacatgagaatgcacattttgtaggtcaaaaccggacaaatactggcaatttcttgtggtttgatttaacatattaatttgctcattttctatcctctcctccttaaaatgtaagctcattgaggacagactctggtttgctcactgttctatcctcaggccccagaacagtagcaggcacatagtggatgctcagtacatatttgtcagacacaaacattttgagatgctcttcatgatctttctgtagcagtcaccaataaccataatctctttgatattgcactgctcttctgtcattgtgacttttatcctccctctaatgtctcctctctgcccattctctggcttctcacatcactcctttccaaaggggaatgtcccaaaacgttcaggcctggctggctgtttcgctctgccatttcttgcctcctctgaaagtcagtcgtcctcatgtgttcatctctgagtttggtgtaaatgacttccacatctgtacctgcagccgtgagctcagtccaaagtgagcagttagtattggcatcagttgcatattggacattctattttgggttgcccatatcttcagaaatacagtattccaaaaatttacatcttcctttatttttgaaaatgttgacttcatcacctggtgtcccttctgcccttcactacaaaactgaagcacttgggaagttctttgtctcctgctttgtctgcagggaccctcttccttctgtcaccagccccccccacccccgccgcattgactttccttgaaatgcttctcacattggtccctttcttttctttctcttgacaaatatcttgattaatgctagagccttttatctcactgcttcgtaccttttccctcaaccctgcacattgagaacagattaacttttgtataatatttgaataggttcattattctacaccaaatatatctttagacccacctgcaactttgtgaatattttggtctttttccagcctgcttttcaaatcccatttcctgtgatgccttctgaaccgcttagctctccaaccccattggattccttgctcttgcttgaagatgcagcacatattcccagtggcagcagccctaggtgttctgggaggctagcccttcttgagatccccatcagcttctcttcttttaggtaggatccgtgtgcctcctctgcaaacatagctgcaaagaattacatctttgagcagcccttcccccgcaaacagattttcatctgaagtccctcctacagagaaattctagagctgccactgcatatccctgtctccatctttgctgactttgtttccttcccccagaaactcctttctgtgaatcaaatccttatcacaggagacagtacaggagagtggttcagagcatgagttatggtgtccaggtaactggagcttgagtcttaaccttttacactcccttgctgggttacccatcagcaaaattcagctgtttaatgaaggcaatatttgtaaagggcttagcacagtgcctggcatatcttaagtatcattagcatcagcatcatcattcttcatcataatttaagggccactgtctacagtaaatcttttcctacaaggtcagtcctcagatctcacctcctaattcctattgcacttcttgtctgggctattcagaatacatccactttacatttcatgattatatgactaggttgtaagctctcagagggctggaaccatgtcttacccttctgtgggtccagttctaagtgccagatctatacatggctttccacaaatatctgtgggataaaaaattatttgagactgtgaatgaagcacaaagctgtattaaaacagagttccagtgccttgtcatttaatcagaaggaaaatgccctgtgtttctgtctattgtgctgtcttaaaataggaataatgaaatataccaagtacgtactaatttggcagtcattctcagaaatctgggactttacactttaattaagcacttgtagttaagcgtttggccagaagatggtgcagtgttcaagggatccttctctctcaaagtcaaaactgattttcaaggaataatattgcaatccgaccaagtctataaagaaatgggagaaagtgatgccagttcagctttgacaccatcctagggcttagcaagtgtcatgctttcatgtagtttcttccttcctactgcctagcataatgagctggaggactcttctaattagctaaatattattgtacatcagagtggggccatgcttcctgtacattcttatttgggttttgccagccaagggaagaaagctgttagaggcaggagcagatgtaaggaaggcacaaaacatgccaagaagtcatggcgcgtctttgctattggatgagtcattttacttctcatgtttttattctgatattagtaggaattcttcaagtcaatatgtcttactggaaaaatcttttgtgtgtggtgtgtgtatgcatggcgtgtgtacagtgtgtatgtcaaagttttctctacccctgaaaaagttatataaataggatttgattgctaaaatatccaacgtaaaatgcagactgacataatcttctcattattattatctttaatgcaatgtaatgtactgagccagaaaaataatactgcagtttgatttcagatgtgctgtttacattggttggaaactaatttaaagaagaagactcaaagttggtgctgatcagccatcttttatcaagtttgtgtatcatacacttgttccatttttttattttttttgctatgtaaagtcttctgaaaattgaaaactaatttattatcatgtagttattagcacaatcacaaaagaggtcactggtctttcctttaatttctgtcacaggctgcaggccgtattatgctaaatcaaggatacggggagataattaacatagcaactctggcaattttaataggtgagtgatgaacatttagagtttggcttcgaaatccatgtcttaattaccacccgcctgcgtgcagtgacgaggatggggctctagcacacctattacagatacagtctgttgggccaaagttttcatgagttgtccataaaactattattagattgagagacttcaaggcaagaaagaaagaaaagtgctttgtgttttgttttttttagaaaaaaaaatgtgagaaatctgaagccattccaatgtgtgcctctttcagaagtatccactctactgcaagagttctccctggggggctgttgtcctctgtgggacatatggtaccgtctagagacatttttggttgtcacatctgggggaggatgctatttgcatctcgtgggtagaagccagggatcctgctaaacctcctacaatgcacagcacagccacccccacaacacacacacaataaaaaattggccccaaatgttaatagcgccaaggtgcagaaaccctgccccagaactgcccactccatcccttgttatttttcaccgctggttgccaacaggtgtcaccgcaggcccatttctatctgcagcattatcaaagagagtccataaactcttgtaacatatggaacgaaatcccaactgcaaagcttttgtggaaggcagttacatgctggtgagctgaggcctatgtaaccaaaattgatcaattacacaaattaagcatagcccttaaggaatttattttattggtctggacatctgttgcagtattgtccaaatccaaaactcaaatggtgcctcgggttgccaagttaggcaagaaaatctagtagctataaaagtacaactgaaaaccctatattaatatcacgtccatctgctgaatgttacataaatatgcagactttttattttccttgggaataacatttatttttacagtgcccagtttgacattcttatgacattctgttcagtttattacattgtaacttcaaatgtttcttcaaaaatgcatttataatgttgttgttaatcttttttcaagggtctgtaccacctgtttaacttatagttaaatagagaagtcctttttcttataggaagaatgggaaatctttggacaaagagtctcagaaaagattttgagtaacacttgtgtagtgtaaagggaaattatataacagccatgaatgctaatattccatcctgctcttttacaagttgaaatgtaatctccattttaaactaaattagcatcatttccaaacagagtatcatatttatatcagatttatacaaccacatcagattactattaacatgtaaaatagtctcttttatgctgctggtaaaaaatagattgaagagaatgatttgatttccactttaatgtcagggatttaaattaatctgagtggacatgtttaggttgagagttgctccaacattgaagaaacagcaggtaggggcggctttaccttaagaacctgttgtgatcctggcacgaagaaaaccttgcagttataaaagtacatctgaaaatcatgatgttcctatcatgtccatctgccgaatgttaaataaatatgttggttggttatttaaatatgttcagtggctaagccaactggaaaattataggatatgtgtaggaaaacttagaggacatttttcttcatgtttttccccttcattctcagtctatatattcaggaaaacactttttagtagtcaattgttgaaagaattctaatctaataataagaccatctagaagggtcagggaaacttaaaagcaaaaccagaactgaacaaacaaacaaacaaaaaaaccaaggcaaacaaaacttggcacaggtatcggagagatttccttacggtattttccattttaaaagaagaaaaagatagatagaattttatcaaatttattttaaaagaacacttttaactgtaaaagtggttcatgtttactatgggacatttaagtaatatgaatctaaaagtgtattcaaataatttaattttaaaattttaagtgaaaatatattaacccataattagatgggtgggagattcaagaaaagggtaacaataggtactggtttttttcttactagaaattcatgattcattgactgtcatttgtaccagaattcttatatacccctccacctcgcccccacttggaactaaagaaaggagggttgtctggataaaacccaaatacattcacttttagggaaacacatttccattgtaaaagaagataaactttcagggaaatgaggaagatgtctgagagtctgaattggtcaagaaggcaagaagagccagtttcttgtcatttatgcattggtggactaatcctgtttgaaataagataagctgcagctgtgcctgtactggaaaaggaggagcataactcctgcaatgtcacctgcaaagaattttcatgccagaggttgccttatagtaatgtggggtgaataactcattgaggtagggtgacataaaggagcatctaccatgtacatgggagacctgattttttgccctgcttttgctactgtcatttccaaatcaaatcagttattccatttttaaaataaccaacatggaaactgtttcacaaaacaatttgtagtggtgggggtagagtctataaaaaggtatccatatctctgaattcagcagtttataaatatctaggaggccttgtgatttatattcatgcacccagttatgtagatggatggttgagaagagaaggtaacttgcttttggagagatagactctaactggccaaactaagaataactcttttgattcccaatagtcttaaaaccaacaagcattttcttttcctgttatagaaccgctgcatttattgaagtcatgagcccgtagtctatctttagactcctgatgtaatttctgaatcaccaaccatttctgagaccacaagatatttaaaaataagataagaaatattgactgagactccctgaagcctgcaagggaaacgaagataccgcggcagaggtttacagtggaatttctctcctgtagttcgtgcacattgaaaatgacatgatctatcccaaggaatagcttaagacctgatccacttaaacagctccaagtgatttatcataaatgtgcttatttggaaggtttagcagtaaccgcttatgggaggtggtggggttaactaccaaaattgtacataacttggatcctgtgtatggcaattaatcaagaaattatattctttgactttctaacaacccacacagagtgctacatctgtggcatgtttaaagagagagcgagggatgaaatatttcttctaataaaatgctaatggctttgttttggagaaaaaatattggattattgtggtgttagatttatctgtatgaggatttctcgagtcacagtcagtaagtacttctgacagaaaaccagctatgtcctgaatacaatatcccagtcttctaaatgacttcaggattatggagaggcccctttataatactgaagaaagaacacaggaataaatggtgtgatagagaactgtagcagtcgaagttattactgtgagcatttgttaaatgttcaagagtatttatttaacccaaagcacattggaatatgttaattaagacaggtgaggcatcccattgatttgtggtgtctcatgggcataacttgcacccacttagttgctctagtccttaggttttcaagattttgcggggatgcctactgtggttaggaacccagagctcactccttggagggttagtttcacaaattcaatatctgaaaacctaaaagtaccatcatctaaaaagaaaaatttggggcaacaaaagcgccaaagtataatgtcattttcattcctatgatcctttgtgatgtggttcaaatggcttattttaatatttcacttttcaatcagtagctttttaaaaatgacaatttcacaaatgcttatggagcatctactttgtgcctacactggccaagagacagaaagatggaataatacctgacttctaccttttaagatctcatagtgcagcaaaacagagagctgtagcaaatatttgtaatgtgaaaagagcaacactcatgaaacagtccagtgctggacacttactgtagtagagacactgcatcaatgattctcttttacaggcaagggaactgaagcttgtagagaggttagatcacacagttaacaagaagagggacaagcatttaccggaagccctgtgtggttctggatactcacatagtgcttgccagacgcccggcattgtgtttagggctttacactcatgacctcactcggtcctcatgacaaccctatgcaggggatactataattatccccatttcacagatgagcaaactgagctctgagaaggagcaacttgaccaaggtcatgtaggtaatgtcagagcagcaatttgaatataggctcttgacaactaaactttactgctgtgagatgtagaggcatttctgcctggagctgcgggaaggtacagagattagggcaaataaattataagaagattagaaatatggtcttgataaggactttgaagataatgcttatatcagacttccttctgatctgagtcaattgaaggatgtatttttgaacctttcagaaatctctctataagttatagatctgaattttagtgagaatctattccattcctcggagtgcgaaaatccaacacaatgtctgggaattcagacttataaaaatcatacagaagtaattcttaaaaaatcttttattttgaagtaattgtaggctcataagaggttgtaaaaataagagagttatagtatgcccttcacccagcttcctccaaagttaacgttttatataaccatagtacatatcaaaagtgggaaatagactttgacaaaatactattcattagaccacagatcatatggggatttcattagtttttagatgcactctattgttttgtatagttcttttccattttatcacctgtatagatttgtgtaaccaccaagaagtaatttgttttaagctggcataaagaaaaaataaaataaattgttttgaacaatctatcattttgttgtatggtattgttatgtttaggggctgctttgccaaatatcttactcttttaaaataatttatgttttaatggaatattaccatggtgtaagaatgattattcatagtagaaaaaggttgctaaaaaaaaaaaatccccttgggggacataaattgatcccattaagaaaaataaggtttccatatatttattacttaaagcttacttgttagatttaatttttaaacatttacagatggcagtgataggctcttgatttttctatgtatttctgtgtatctcaaatgagtatgagcaatactgtattgaggtgtatattgaaagacatcgtcttatattaacatgggaaactgtctattgccattcagagctttttattttgtagctcttgtttggaagaaggatatggaggtaaaaacccaaatttttagtatgttcctaaaagccccagacgtctgagcttaaaaaggggttaaattttaatgaaaacataccctctagtcaatgtgctttaaattataattttaaaagccaatcattttcttttttgactgacatgtggcattttggagaaatttttaaatctttaaaatctgtaagaaatgaatttgggggtcttataggtatcgtatttagaacagggaaaaaaaagggatagctcatagtgaaggggttgaattaaaatcatttgtaattatgcatcacaaagaggtacaatcacagtgcatccatttatacgtgcatctgtgcatctgcctctgaccccagctttctggtttctgtctcctttctttacaaaatcttcagttatgcgtagatgcacacattagagaggaaattggggctaatgatttaggaatgtgctaattaattctcattatgttctatgaaccgaaagaaatagtgaaaggttgtctgcatatgcgtatacactatgtatatttttccacagtgttttcttctgaaggaaagttatgctggtttttttttctttttttctttttaggttcttacacacagtgacagctagcagagtctaaaatgctgacattatgacttagagatgtgataaagagaaacatctattgcattttctgtaagtaaatgtggtgccggcattgagagaacatacgtaatcagatacctgttctccctgagtttcttaatttaagcctcgcgattcctaattagcagttagattgcatccattgttattttgtctttggttatcaatgatgatcaacctttgctaaacaaagatatgtcatcatgctggggacactcatggatttttttttaaaggttttaacatttgataataggttttccaatagcttgaagggtagcttttaacatttcttttccagctgaagtatttcctgagttctgtccaagccctctgtagttaaagaaaaggctttttgacactgaatagacaatgttgtggctttttttttccttcttcagacaaatgtataggcatttagaccgccacgttgtactctcgtaattgagataccttgcagaaatggcaattaagggtgactcgtgtcaaaaatattcaggacaaattacattttactgatttttaaaaactttcaaaggtactctctcctctttctttctcctttctctcttcctgcctccctcccacccgctcctcgttttttcttttaaatattaagtaaactatttgcatttttacgtctcatcaaagttgttccaggttttttctgggtttactgaaactccaaatcgactactcagatcaaaacaattagtgaagtctaaggtattcttaattcctgaaatgaaaacagaatggacgttcgggacgttctgttttgctctggctacccgcttggcttctcgctcagaatattcttgctctcaagttagttccagttctgtttattttgtcctgagctcagtgaactttccaaagccctactcttcaaacaacactttttttcccccgccccgtgagctggagtttattttgtgctcacccttcattctgtgagttgtgaataattttaacacaaagaaaaaaaaatctcctcctgaccacggagagaagaggggattttagaataaagataaaaattgctgttttagcccccaaagcaaaggacttgggaaagaagagaaaaggggggaaaatagaacagcaaaggaaaaaaaaaaaaaaaaaaaacagaaaaaaattttttataagggtgtcagtacaaaacaggtgtttgatgaagctcaagcaaaacaaatgacaaagttagcattgaaaggccaaatacgtgatacacatttaaactacttaggtaaatttatttatgaaataaatatgcagtttttcaaatttgaacatggagcaaatgtttacagattgaaacttatcatttcttgattaccagtatgaagtagggcaatagtcctattgaaagccattcttaattgggctcattgtaaatgtttggttaaaagaaaagattaaagtgagctttggcctctgtggaatgctgaggctggtgaaatttctggttctagcattatcctcaaattgtctcacagagaattatattttacaaagttagaaggcggaagaaccctactctttgttttaggtttgcctagcatccagtcagagatgggtaaataaggacagaaccatgggactccagtggccttacttaggaggcccatactaatggcaacggcaagacagtgctacatagacataaataatctgtgattgcagatgtgcaggtacagtataaaaaaattattctatccttatagtcttaggtgttggcacatttcttttgagcccatgtatagaagaggacaacatgaaaaatgaaatattcaagccgtggagaaaaagaaaatatattgttgtattttatttatggaatgcccactatgtgctggttctctactggccctagagaagtacagctgtgatcaagacagacatagttcctgcccccatggagcttacaatctatcgcagagctagaccagggaaaagagtatgaagtgtgtagaatgagaagtagagagtgttacaggaacacccagaaaactaaggttattggtttagttgatttttccccctctttttttcttccctctttttcctcttcaccgtctcttttcctcttccctttctttctctctttcccctttccctctctctttgttcctctctttccctcttgatctttattttccaaacagaattcagccaaactcattttttaaaagagaaacagtctaacattatttagaaagagcagcatattataagtggttacagccatagacttggaagggtgtgacccagattggaatcctggctctgccatcaactagcctgtattcttactcaaaagatattatctgtgtcttcttttattaaaaatagggctagaaatatgtacttttaggaatttataggaattttagatgtgaccttgtaagtaaagtctctggcttcctttctagcaggtagtgatcatgctaaaatcgttagctactaccatattattattattactattactattattatttttctttttattttgtagaagcaatgtctgtattatacaacagctaaaaaatagtgaatgatgatattaatcaattgaaagaattttctccaaaaacaatgactagctttggaattacgtaattcttatgttttgttttgcctattcacaaaagctgttgtttttgaatgttaaatataaaaaccattttcaataaataaatttttagataagatactagagccatattatttacaattgtgttgtcttttcctgtgaacagttttaggattaaagcttgagccaaatttcaatgagcccctttaggagatagggaaatttattaatacttactttgattcaagagtgattgagacatatttcttaatgcacccatatagagtaatgtgatagatttttgtgtgtttcttgtgaaatcagttgtactgtattagagacaaaccctatgcaggtgtgaatatgtatttatataatttgatagtgctaaagcacaaatttatataatttgatagcactaattcaaaaattaaaattgttataaatttgtccttaatcaggacatttaaaaatcagtcttcgtgaacacttttagattctggaagtgctcacactacatccccatgtacaaaaggtgaaggtgacataatcacatgtagaatttagatagcctcctctctggtttgtacatagtgtgcatgtcccccacctccaatcccagcctaggctttagcatcattgaacatctctcttccaggaatggtccatttactcacatgccttctgttttgcttgtgtggtctgatcagcctgaaatgcctttccctgtcgggatgaaatcttacttatcttttcaggtctggttccagtgtcgtctatggtgtgattcatctcccaatacccctgggtgcaataaaactggtcccttctttgtaccccgtagctctttgttcctctcctcgtatgtgatggctgtttgagcatcttttcacccctccacaccaggaactcctcagtgagttcttgagatctatgccctattcacctttccagaaaatttgattcctgtcttcaaggagtttccagtctgggcaaggaagcagacatataaacatggaattacgttgcaatttggaaagtgatgtaaaacaattatctaaattagtgtacacagatgagcactaatttactaaagaatcttgcttttctcatataacaactgagcagtcggcatgtaggtgtagtctgtttcttaaaatagcaatgttttcccagtcttcatatcaatatttatgttgttactcatgctctgttaaaacaaaacaaaataaaacaaaatctctcaaatgacattgtatatctaatgttagtgatggggaatttaggagtctgttgaaaattgtgacacatagcaggactgatgcttcatactccaaaccaaataaagtttcactggaccttagctgtaagctaagactttaagtgccacttatttgttgagttttgccactctaaattgctcagcttggcacaagatctttaaaagaagttatagttcaattggtttgtggtttattttctattatattaaaatgacctgcttatattaaaatgacatgcctttcaaaacctactagtgctttaaaacattgttgtagtgataaaagatttccaaatgttattctgaaaagcaaggaaaaggatttcagacaaactcatagcgcagtatagtggattatgtcgagctcctggatgtagctataaaatcatcttttctttcatataagcctagagttttgggcttttggaaaatgttttctataattgttatttttcgatacctgtttttttttttttttaatattcattctgaggtagtcctattacagtaggctcataacaccataactttacccatatatagccaggcaaagctttctgctgttaagtagaacttatgaatacttaagagaagcaaagcattgctattcttgagcaaattcggagagtttagaaacattattttgaaatgtgcttcctttaagtcagaagaacttaattaagttcccagggttaattgtttctgaagtgttaacatgtcatttgtctattcaaactccaaagcaaatctaatacgggatttaataacctgtttatgtgaatagaaatttagggtgagggtggcgtgggagaagaaggaaaagctaataggcttttacctagttagtgggtttaaggaagaattctttctgtctttatttgaaacaaaaggtaaatcctatgttcaaaactccttctatttgggagtataaattgggatgacaaggaagttttggaacaaaacagtatttttacactttgttcatttcatatttatcactagcttgtttgctaattttcatttgcaagaggcaattcttccagctaactgggtgcctcaatgggccactgatttctttgaagtgacagtctgtaaatatgcataaaaaagggatgcaattagcgtgtgtgtggttcagtgcagcctgattccattggcaagtttacccacagtgttgataagctacattatctagaaaattggccgctgaaaaacagcacctctgattgccagcaaaggttccagataacagggtgctgaagagaaatataattgaggttgaatatattaaccaaggtgtcacatgctccttagaagctctaatttatcagcatgttggaatttttattaacatttggaatgcgtttctaccacactaatgaagtggaattggcagttcaggttttagttattgtcatttctgagaagttaaatgtaatttctcgttagacacagttatgtaaatatatttgttcaggggctgaaaaaaattatacattttacaaaatacagatatgttgttaagaggcagtgtgacaaatcagtggtggcttgagtcctgaaaatcagccatgtatttatgctgcattttgtacattacagctcttctttgtggggggaatttgagagaaatgaaggaagcttaatttcattaactctgtgactggctcgcctttgtgaaaaacagttaaaattagccactgttttagtaggctagcacttctaaaaggattttatgattaaactatttttttaaatgaaaacttgctcaaattataaggtgaattaagctttcatggacgatatctgcttttcttttttctattcttcttggaaatgcccaagatttatattcattttctaattccaacaaataggtttgaaagatatttgttaacaagactattaatttctattataaaaataaattgagatgtgcaaatttgaaattattttagattgcatacatatgtgataacactatatgttttttgaagcaaggaaataaaaatcataaactttgggataatgtttccttgggaataaagaggaggaaagagtcagaggtatcaggggaacatacacaggcagtttcagctgtatattaatagctactaagtttggtgatagatttttgagtgtctgttttattatgatagttcgtaattacatatatgtaacatgtgtttatatagatcctatatcagaatataaaacattttcaaaaggaaataactcaatttctattgactcgtaaattttgttttcccatggaaatgattatgaattacagtctgtagagcactgtgtatttgtaacatgcttagtattagttaattgcacacatctccgacctcagggaatgatgccacatttgtcctccattagtaatagatacgctggtcacaaggcattggttccctagagacaaatgacccacggaagaaattctcagctttccctttgcattcactccttagcaactgccagtcttctactgtcctatagggctcctgatttcattccttcttcttctactggctgcaaccactcttggcattccttgaccccgtttatccctgctgcaatacttccgtgcatttcacacacttaacctttagccctcaatggtaaacttctcatctctatcacctatcccatcacatgtgtgtggggggaagatttagaagatgggggtggggaggagtggtgttccctttattagaaggaacttctggttggaattgaacttgacacaggagaatctcatgcccgttggacagttactcttaggatacccattatggtagatgtagtaaattgtcgcttagcacacattttgcttttcttccagtgtcaccagttagatagcaaaaatctgtaattctcagactctcttgcagctagggttctgcaaaaaaattaggttcacataggtgcatgcaggtgccgtttgaaaggtaatattctaagtgtggttcactaagtctctgggtgtggagtggcaatgtggtggccctgattccagatcatgcttttatcactgtgtctttgaaattagctgttctgtaggcagccttcagattccccacattcttgagcaagcagatgtggagactcccctggcccgccaatttttcagtgtggttacctcgatttatctgcttctttggcccttcctacagttttgcaggctcttatttctgtgtgttaaatccctttctgcccaagtcctttacttttaagcaactgaaccctgatcaatacccctgcaaatctggttcagatgactccgtaacagggccaggcccagagtaaagcaatacaggcacccatggcacaaaacttaagttgttgggcacgttcagggtcatggaagtgtctctttaaattttatgtcctgggcaactctcttgcctcactttagtgctggctcagctcagtaagcaaatagcagatgttatttatttaaaaataattaaatcacatctataacagatgttggcaaaatacaatccatggactaaatctgacccactgcctgtttttgtaaatatagttcagttggaacacagccgtgctcttcttttatgtactatctatggctgcttttgcactgaagagcagaattgagtagttgcaacagagaccgcaaagcagaaaatatttactctctggccatttacagaaaaagtttgcagattcatgctctatatgctactgtggatatgcctaaatgtgtggggtaagactgcctgagatcaaattctggtttctctatgagtctctggctaagttgcttaacttccatgagtggtgtgctggaatcacccaaaacttgtgggtatctcttcttaactctaggtccattgatcatcttgatagcctgaaatcagccatggtgggagtatttactttaggaaaattgggaaatgctacaaatcgaggcttccccagagacccacgaactgaacacttgctgcctctataagtatggatggaccctgacttatgatggtgtgacttatgatttttttgacttcacgatggtgtgaaagtgatatgcattcagtagaagctgtgcttcaagtacccatacaactgttctgttttttccttgcagtacagtagtcaataaactaaatgagatattcagcacttttctataaaataggctttgcgttagataattttgcccaaatatgtgctaatgtaagtgttctgagcacacttaaggtggattaggataggctatgatgtttggtaggttaggcatattaaatgcatttttgacttacggtactttcaacttatggggggtttatcaagacgtaaccccactgtaagtcgagaggcatctgtactagattcttctttttccaaatgatgtgacacacacacttagtgccacatctggagcctctttaaccatcagtgcaccaagcccccagctgctgtgagtgctgcagctaacagcttatagctgtgctctcctcaggggcagcaaatggcttgctgatatgggtggcacaaaagcccagctcctttgaactattctgtcatgcaatttatgctcccgaatgcctctcttgccatggtttagaccatggctagactttgcctgggattcttgattggctttttcaccttctctatctggcttcacttttttcattacaggtttgttctaaagaattaagtccaggatccagactaggtgaggtgaggacagcgaagtgcctagagcacacaatatcaggaggcactcactgtcaggccaaacgagttgtacaacccttctaggaggaagaaaacaggtgcctcctaaaattttatggcttagctgtttccctcttcttaccctagtctggtccctccttgcccagataaatcacatgcacttgaatttctgctttagcctctattcgtcagcaacccaacctaaggcaagtggcagtataatggattgttacctattgattgttttaaggactaaatgagttaaggtatgggaaacagcaatgattgaaacagtaatggggaatgaacaaatacatgtatagatagaaatggtgatgagacagatcactcctgtgcctttgtatgtactcttctccctaccttcagtgcatgctctgtttctattggcttatctaaatgccattgtccccctcctccctccaaaaccctattttgtctataaaactcttactggctacagcattctaaatgacattaatttactctacataattctccaatccctgactccgtttttttttttttaaccaaataatttttttccttccattgtgtttatgtcctataaatcatcatctgtataacttacttgaatagattgacaaatgtggtaaaatcaatataacgatattgcaaaaatgatccttagaagtgtgaaaaaagatccagctgataacctttgaagatgtggttcctgtgctttctactaagtgttcaagtataaggacaacccagggcctatagttcactccatgtgcagcccagggaggtgggtattttgtaatgcctacaaaagttgtttctttgaacgacagacttctaattgctatattgataggtattcccagatatcttagccagttttgttcattgatactgtcaccatctatctcagcactctaatttcttcatagctttctttgttgttgttttgtttttgtttttgtttttaagacggagtctcactctgtcacccaggctggagtgcagtggcgcgatctctgctcactgcaagctccgcctccaggcttcactccattctcctgcctcagccttccaagtagctgggactacaggctcctgccaccatgcccggctaattttttgtatttttagtagagacagggtttcaccatgtcagccaggatggtctccatctcctgacctcgtgatcagcccatgtaggcctcccaaagtggagggattacaggcgtgagccaccgcgcccggcctcttcatagtttttatcaccacttataatttcctaattaatttgcttactgacaatctttcatcctaacaagactgtaagctccatgaagacaggctcttcactcactccccattgtttgtagcccaccttgtgcatggcaggcactcaatgaatatacgttgcagtgactgacagaacaaatgaattatgtagacattttcagaactggtgtatagtgacatagtatgggctcagtatatatttgcagagtgagtgaatgaatgaagtcacttaaaggaaccttctggcacatgtttcactggcaaagagcttctcttatttgagtttgataaatattgttgcacttttctacaaagtacaatgaacaatcaatagatattcacaggtgcttttcctgaaattaatcctcatggagaaaatgcaggaatgtgacacctaaaattgaaagtgtgacaccacaaattattgactctagaagtacccaagtcatgaggagaaagatgagtttagggtaaggagtgtagccaaaatgattagtgtgacattcaaatgctttacagattgacacaaagagggatgggttcacatcagagctgttgtgcaggtgtagtgctatgacttggtaatgggaggccctgctttgactgttattccaacacaggaacaaatcagttgatgttgaagatatcagtcaactctgtcctgatgttggcctaagagcctcccttagaacttatgtagtgggcttgtttggagatcatggagtgaacaagggcggtgggtattaggagacccactctggctcaaataagaacagtgctgcttctgtctggtaacacaatgggagagagagtctaaacaaataatccatataacaaataatgtcgatataattgtgattaatattagttaataaaagtccaatgtctttaaaagcatttcccagaaggagctaacctaggccaggggttcggggcagtgtgtgtgagtgtctctgcagaaatgacatttaatctgagaatggaaggttaaacaggagttaggctacatgttggtggggaaggtggtttggagagaaattattgccggtaaattctcagccttttttccttaggaaaatgaaccctcaaaccaccttggtttctgctccttttcttgctttcacatgcacttacttgccaatacttagagggaacacaatgtagtcagtggaaaaaatgtggagtggtatgaacagatgtttgaaccccagctctgctcttcactgagctgtgcattcttgggtagccttcttgttttctctgagccttatctgtaaaacaggactgtccatgaaatgtagggaggattaacaattactctcccaatggcaaatgctgctatagcatctaccatgtactggttttaaagtaactcatttaatcttcctaacagccccatgagatagatgtggttgctatccccatttctcagatgtagaaactaaggcaagaggttaaataatttgaccaagatcacattggctggtaaatgatggagctaggattcaaatccagacagcctggctgtaaggtctctgtgttttgctactaattcttgatttttaaagtggtccccaggaaagggagcagaagtaatcttcgttgtcatttccttggctattggtgaacctcagaccccaaggacttttgttgatccgtaggactcctcaggggcacagggcttggttatcagaagcaaaagcactcacttttatttaagagctcagtattgtgatcatttgccagaattggccgtcttgaaaggattgtatcgcttgccatttggttttcattctgaggccgcatgtgactataacgtaaatacttatgggggatatcattactctgaaatttaaagtttacatgtcagctccctgtctttatagcaactgctttgggtcatctctcttcttgttcaagccaggaactctggaaaatcattctcatgcacagatttctatgtcacctctatccccgacttctagcaactcagggaagggtggaagtggttccaccttatcccatctgtataagtcaccaaatcttggccatgacctgtgttcaaagacagcatcaggaccttaaattatgagttgttctccaacaattgctggatttctttgaatgcctctgggcgttgagggcatcaagggggaggtcttcttcaaggcagtagggattcatgctcttttggctgccttcctttctttcctgaagctttgtttggtgaactcctgcagatcctctggtctcagttctgcatatcattttagaacatagccttccttccttgacttccttccctgcattgaattctgacctcttattatgatctgtcatctcatccttacttaaccttcacacagtatctccctctgtatatatatttttgcatgattcattttgttgtctgtctttctagtgaaactgtaagctgcattccaagtaggagctccgtaaataagggtggaatgagtgaatgaatgaatgagtggagatgagtagcacttacatagctatgattcctagcattagctgttttcatcattcaggctaattggaatcccaaccagagaccttgagatttactatgaaatataccagcacatacactttaaatgaattttgattccccatctcactcttccaccttgacactttcacatcaggatgcccatcacacgcctctttctcactttttttgtgtgtcgttcttcagcatgagattcgtaaacaaacctcagtgggagtgccctcaggaactcatccaaatcattttgcctggagactgtttattaggggttacctctagcctgctgcaaccttttctagaatcatgtaagggtaaagtggcgaacaagaatggatttgaaacagaaaccaccatagcaattaacactaattaacagagctaagaaaatctttcattaggagcgtctaaatcatgcagcctgcttctacttagaagggaaagaaaagtggcctgtgaaccatttaataaaatttgaagagattatttttcttcctcatttctcagaggatatactggggttggagaagacaatttgtttagaagtggagtaatgggaaaggggtacaggccccttgccttcgtgcctgtccacacttcccatggttccgacccttgtgttgagttgctcagccaggcacttccctgcgttacctccatgacagctttccctccccattaattctatattttcaaattctagagtcataaccatgagactgacattttattacttgcagacaacagcagcaactacaaaaagagacaatatctattcagcacctactgtgttccaggcacactatatgaattactttgtttaatttgcaagcaattttgtgaggtaagtgccactagtatccccaatttgcagatgggaatgggactatagtatggtaaaacaactaattacattgacaaagtaatggactgcaagcttatccctcccagacacaaagtgtacattagaatagcatgtgcttggaaacaagatgtcttacctcaagactgggtggatgtaggtgagttctggggaggaatcagtgatggcagaggggagagggttagttacggtttctggataaagcggtcaagaggtcatattaggaagtggcatggcttcagaagcctctcacatcaaactgtagagtgggcaccttttccaactgtatactggtttgaccttaactatatatagggtcaatgactaagtttttaccaagcttcccaatcctgaaaaaaatattttgacggcaagaaacagttaatagttatctgcttaatatccttcttgttggtaagggctgactcactgaataaacatgcgagaattctttctgggttccccctttttcattatcaccttcatgacttgattactagctgggatattttattgccactcaggacattgagacaaatgtagggaagccagtccagtaaggctcgaacatttgtaagttttaagacacccttcatttgctaaattccctccacctgggggtgctcagtgggactactttgatttgggtaggtttcctaatttgagtaagtcttccattaccaagttcacattaaattcacttttggggacctcttcttgatatattgaaggaagtcactcttcctcccaaactcctgacttacccaaattttatgaatacattttatgtttcttctggattttgttaatattttaataagcataatatggttgttgttagtagactcagtttaaacacaaataattatatagtgtcagcttcttacaaactctacattgcagttactatcaatttcacaatctagttcctcccaaatacaggaaggactagtgtgagacacagagcaatagaacaagttctcttgcagtgagatactcttttaaagaagtcataagctgatcaacaaatgaaaccttaatcatagcctatggctctagggcttctgtttcaattttaaggaataaaacaatactaagaggtctaggctgtttaagaatatctaatagttggctatgggtttcttaaaagcatcacttctcaagtaagtatttatcacagtcactgtattatttccaaacaccttttaaaaaattcttattggatgtggcaagtcatttcaacaaaaggtcagtctgttattactaagaaaaccagtgaaggaagcaagttttatctttggtgctgacaaaaatctctcctgagcctggctcaggggccatggcttgccttctctcttctcacatcaccagggagttatacctgatagctctactttgtggactcatggttatcctctgtgggtgtatcaatctctttatcttctgcctcaagtgtgaaaataattttccctcattttaaccaagacgaatttgggtattttcaaagggatctattacgtagtaatgaaagtaaaataaaatacatgcaaagatagagatctgagcttttcctgcccataattttactctggcatggttgagctaggataaaatccactgggttgtctggtaaagcttattgggcagcctgccctggtttctttcaccatgctgagttctgtctgggttggatgctaaaacaagagcctcagacttccaacttgaagcagattttggttacaagtcctcccaggcctggtaagatttttctgtctcttctagaactggcttctttaaattctgtaaattcagcccccttaatctggggctacagggttcttgaattctttcaaatgtccttgctggagaagtctttgcatgtaatgagttctcatactgattatgattagttccaacagcagagttaacatgcgttgagcatttttcccttgcaatgtagtgtcctcagtaatttacacatgtatgggtttattcatttaatccccatgacaatcccaggaggcattattagttttatttagctgaggggaaaaactgaggtatagagaaagtaaagctacttgcccaaggttgcagagctcctggctgagccccaaatacagcccgcggctgtttgattgaaaagttgaagcaccatataacccctttctgaacctgaaagatgccatctctgagcttcaagcaatctttaactggcctttgctttctccaggaggacactgaggattcactatattgaagttctcttgccctggatctccgccatgttgtttttctgaaatattcatagtggccaatggttaaaggatactttccttatttgaccctgactttgtagctttgggccataaattgtcttctattttgaccaagtctcattccagaattctatctgcaaataaacattagcttatttaatttgatggaaaattaacttaaaaagtttcctgagagatacaaatgtatatttttggaggagtagccagtgccatgcactttaggtacatattcttgccgacttaggggtctcagcctgagacctttttctctgtatgcacattcgtccaaaaatagattcaacctttgaaatgaaacagatctattgactcagtaattttgtggattccttccacagggaggaaggaatatccttcctctgagatccaagtggtatagccacgcatgttctcattagcagagatgacactggagttattttctgactcagtagaaaacatgagagaagagaaggaaggctttcccatttaagaaatggagtgggctggggaaggcattatccttgttatttatcatcaaaactgcatttggagaaatgtgccaagaatgatcagaagagaatcatgggcacttcagttctccagaacttcactgtctatagcagacacacactgaagcagtcacagctctaaaagaaggcagtgtgcttatttataaataaatataaataaataagcatactaatttatgcttgtttaagggatgtatggatgagttattaaagacaggggcaaatatcagaaacctagccattttttagtaaattaaaatgatgctttattggctggcataactaaaatgtataggggagagcattgcttaaggtgtggctgaatccaggggcctaactaatgatacaagcatttgccttctttccgttctttggttctgccttcctctgtgatggctttattcccaggtaggttttcttcacttagggtctccaaatgctctagggttacagtatagagttcatgcaaccttaggataacgatagcttttcttttctaatgcttccaacagacattcaacaataagcttaggttgcatgccaatccctgagttggtctcttgggttagaatatatgtgttctgattgattaaacctgtgcctatgcccaaccatggagcagggactaggttagtcgtactaactaagtcatgtggacagagagtggattaagggatagtttcaagggaaaaccatgatattacaaggaagaggaggaaggcagaaataacagatgttcaccatggtgcatccaacgtgcaccatggtgcatctcaacggaagtgagaaagtaactagggataaaaggcaaggcatatggataagagaaaaatgagagaaagcccatgtataaattggctaagcccttctctgttaaatttgggatcttttgtagagaaggtgagacggtagctgagatgtgtatttgatatggatgagctatcgtcattcagtaactgagcctcagtttcctcttttttgaaactgtgataatatttctataatagttttgttgggaattatcaaaagagataattcaagggagagagattaaacaagtcaaaggtattatagtagttccttgcattcagaaacttgcaagcctctctattggttatgattttctctatacaataaggtagagatgataagaaaatatgttatccctcaagatctcagatcagagttatgttgataaccatgaactgtgagatgggtactgggcaagtgactaggcacattgtgtattttcactcagaaaatttctgtttcattccaggtttatgcctcagcaaaatgatgagcagaccagggtctgctcagggtcactgagagtcaaaatagaagttgctaaatttaaaaatatgtttcctctgcactaaaatggggcaataaaagaggacgcttgaaaaaacaaactgcttgttatattgcttgctataatttgctatattctgacttttcccaagaagataggtttatttgaggatctctctaaatgcccagacaagaatagaagagttttactaaagtaagctaatacatatatactgaaaagcaatcataatatactaattaacatttattaatgaatgtacactatgagtacaggttctctgtgcttaatatgcatcagcacatgcaatcttcacagtagttttatgaggtaagtgcaattattatccccaattaatgcaaaggaaaactgagtcaaacagagaagtaaattagccaaggttattcagcttggacgtaatgaatttaggattcaaactcagaaagcctgttctgctaactgcttcactgtgataacatcgtgcattttttaggcagatggacggggggtgggggtggggctgagggtgatgggtgttggactcccagcaggaccagtcaccactatcacaagtgatagcttgtgtttctccattgggaaaatgcgtgtcagaacggcacctacctctttgggttattttgaggaagaataaggtgatgctttcaaggtgtttcggtaggggccatttttggatgttttcaaaaaatatagttattcttgttaataataatgatgataattttcgcaaggtttaaaaaaagtatttgtccaggagcaactttgactcccatgggtcaatctttacaggtagagtgtgggagtctgcttttcccagccctgcatctctcccctttgatggattaaatgctcctattaagcagatggctgggtaaatgtccccattttgctggccttacttttcttgagtgatttcctattataggaagggagtatcccataataatgaaaaattggcagtagctattgattaaattctttcctaccctttttttccttgactttcccccattcgttaaatatgaacacctcaaagacagatgtaaaaaggtaaagggaggttagctgggatagggctgctttctttctctttaagaacaaaatagtattttgttttgttaaagtccaatcttcctaatagatcaaggaaagagaaaaagtttagattacccaattactggtaataaattattattttttctctgggacatatgaaatcttagggtggcaaataccatctgagaaatgttctttttattttggtagcacagcaactccagaaaataggttaattggttcagagacttgctcttactgttaatggcatttagcttgtgaaattgaacaactgtatctcaagacagaatgttcataaaatcgatattctggttgctaagtgtgtgtttttaagatatagtttgaattaatttattcaaagccagctggtgttgttcccagtataacctctaggaggaaacctcaacccatgttgtgtctaaaataatcgggttttcgttctctctttattcaactttcatattgtatctaagttagtacttttgatatttccaagttttttttaaacatttatgtagaacaccacataattgcagaaaagataatagtcacataccctagggcctactgtacacttatgttaaaagtacagcttttattggcaactaaagtaataacctttccatgtcaaattgctttaaattaaacttaaaaaaaaaaaaaaccattggctgatacccacacttagtaattgtcaaacattagcataatgtggaatactaaagctgcctgaatcttaggcttaaaaataattatttacttagataaattttgtatgcagtagcatattattagaaatcctttcttcctcctccttctaaaaatgcaggatcaatgtatatgttaatattatacttaggcttgacatgtaagtgggactgtaacttatgttagcctctgagaaaggggtcttatttaatctcagctcatccatccatcatagaccacatacaaatggggtgaatcgacactttggatggcttagcgtattgtactttgtgttgggtgacctaacacgtgacccaagggggaaaaatgcacaagtctatttttgattaggctgcaacatggcacagtctgcataatttccaaccatttcaaggcacttgggagatgaggatcctaaatgattgtgtatgtgaagccctcaggcatgggtcgcagccgcctttcacactaatgcatttgtatttcccagatctctcttggctcaaccatagagatttccactgaaacaagcttacaagggcttcaggttggtgggatttgtgtggttttcaggctctatcccaagactggggactatctgggcacatctgactgctgcagccaaaataatttttgtcaactttatggcacattgataattcgaagtaaaactttatcagtagggactgacttcctgttgttcactgattttataaaatcctgcttgtagtcaccttgagcaattcccttccaaatctgttgatgaggcatcttgaaagtaaccacttccaatatccaagaatgctgacgtatatggacagcctaataagcaagtctggcaacatcataagctgggagtgacaggcaaatatttggtgatgtctccagaaactagagactcataggacaggcacacaatagatgctggaggagccttcatttgtctaaactgtattcttctaaaagtcaagaggtatgcactcaaagatctctaatgatagtggacaggcagggttctcagaaggaataatattataatctcaaatattcagttgaactccatgtgcctacattttggaacccctgtctgccttctttcagttcatacacgaagtaaaggaaattaaggggttttttttgttttgttttgttttattttttaatttctcctcattgaacctgaaaccactaatatccaagaggcatctaggaataaggaagcgaagatctaggctctaggcctgggtttccactgtgctggttaactttgatttggaaatgaacctctctggtctcaatttgcctgtatgcgaagtgatacttgctttgaaattaagtcacgaaatgagagtggaattagatgaggttttcaaagattatgctcctgaagctatatatagttttagttttttttttaatttttaagttttgtgggcacatagtagatatatatgtattcatgggtatatgagaatatacatgatggacacttctgtttcctccaaacgtgccttactcattcccacctttgggtcatcagttgcatcatttttcacctggaataacttctacattccatttcatcatctttcttgatcaaactcatgctgttttttttttttataaagctttcgtctcattgttttctcatcattcgagaatcatatgacatgatcatctctcctacatcatctatcattttattatttcctgctttgtactgtttaatttaaaactgctattctttcctcccacccaaagaagaacctttcttctttgttcccaagctggggccctgcataaactcgttctgtattctgttcaacactcattacattgctcagcacacagtcggagcttaatagacactggatgcttaattttttaattacctgttcacttggtatctcatcttatcctgtcgtaaatgcaaatgtacttttgtgtatagatgtgaccattactccttttatttgtggaagaggtacctgagacagacaggtttagtgattcgcttgataaagttctgagggagggtctccggatgtgttgtctagtgtttttgtttttttttttttgttttttttttccaccagataaatattcttcaaattttcttctgcaaatcagttccagagatcctcagggggctctcctgggatgggaacagtgagaaccatgggatgagaaagagagtggagtgatctgaggcacggctgggtatctttgctgatcctcatatttcaaacccttgcttgtttcatgtctcttccacaacaatgtgagcttccatagctaaagggctgtcttttctctgccttcaatgttcttgccttcttctctgaatagcatgggacagggcataatcagaataatgcgcactgacagagagcacactcaatgtcaggcagtgagtcaaacatctttcatggataacttcacttaattcccacagcaggtttatgggcaactgtgcccattttgtagataagaaaattgaggctaccaaaaactaaacaagagctgcagaaatgatctggaccagctgttaagactcttgaggatgatactatcttagattgtcaatggcttggattgtagatctttctgcctcaagaaaaggcaacttggttgtttgtagatgactaaatgacttgctctgtgttagacctctgccacaaccgtcttctgaattaaagaaactgtctttaagataatttcttatttacatggtgcacacaggtctcctctttgggtgacatttagtaatgtccttccagctggatacaagggtggggtttgggtatggtgcacagagatccctgaatagctatgcaaagaaggagtcaagattgtgaaattccatgtatcccatgtggcacggtggagtgggcagatctctttggttctttagtttagagatgcaaactgagactcagaaatacttctgaagaaagtgtttgaaatgacgcctggagcaaaaccatattggcccattcatttaaaaaaatctgttttctaaaaccaaagctttttgattcttaaatgggtgattgaagtcctcagtcaaagcccttaggtgcctttgagggacgttttgcaacccctaaccttctgtagtaaattttcaatgttttattttgtgatatatggggaaccaaaaacctgactctgggggccaacattcctgaggctctgcctttgactttggaaaacgggaaccatcagcctgaaattggtgcaaattatataaaattcagattgtgcacggctgaaacctttgaatcctccttgatctctcctctcaccttcccttgcccaatcactgttttcatctccaaaatatctcttgatcatgcctgctgctctccatccctatcggctccactgtataggccaccaccaggatctcatctaatagcctcatgacatctgttctgaactcatctaatagcctcagacatctattattgactccttccagtgtattctactccagagttcagagtaatgttctcaaaatgcaaatatgattacgtgagcctcccacttccccatccccactaaatacctttgatgacgttccactccattgctcttaagataaagacaaaattacttaatatgctctaaaattctctgcactgtctggctcttctgagctctctcacctctccccaatgtctcagtcccaccctgaatggccttttttcatcctgtctgatttaaattgtcccttcctgccacagggcctttgtgtttgctattctcacagcctggaatgcctgtctctctttaataaagttttacttaaatttcatatttcagcttaagtggcccttactccctggttggctaaatgttacgaactgaaggtgggtccacctatcctgtgcagcaaagccaaacactgacattgagatggcagcgagagaaagagtgaggcatttgttgcagggtgccaaccaaggagaatcaggcagctgatgctgaactcttgaacttcttgacaggttacaggtaagggtttttaaaggtggggagggagaggttacaggcaaagtcataaatcaatacatagaggctgtacattgatttcacctaaaaaggcagggcatctcaaagcaggatcccacaggagtcacaggtagattcaaagattttctaatttgcaattgcttaaggaggtgaaactttgtctaaaaatttggggtcagcatgaaacaatgttagctttggctagtaagcgtcatcacctccaggcccctcaggaagaaatttagagcaaagaatggaggtcagggttcagtcctcagttttcccttatcttaggtctacgtgccagtagatccatttggtggaggtccaggtttctgaaaaaccacaggaggacatatgttaagaggttatctttagttcccttagggaacaaaccatcttttgactctaacttccatggctgtgtttttaagctacttttaccttcttgcttattaagttgctcatttgcttctcagggctagctaggtgcctggaatttcccttaaataaactcaagattttcctttatttccatgcttgatgggagagggaggtgcctgacaggctcctaagagaggtccctgctccatctcaaatcctttatgagagactgttgtgcaatcacatacttttctttgtaggactcgtcgtgttatatatttcacatttgttagcatgattttagcattatgtttaaaaagtaggctcaacacccagctctgccaattgccaggaaggggaacctgagcactcaatttctgttggcctcagtttcctcacctataaaatatagacagtaatggttcttaggagttgttttgagggttaaataagaaaatatatagaaagaacttaggctatttatgtgccacaaataagtgctatctaagtgttaactataatattcttgttaactataatatgtcagtgcttatctaccccacttcactagaagttctgtggggtccaagaaaataactaatttgacgtatggttgcatctcaatgcatatcactgacacatataagattattgccacattaccacaaacttagagtctgaatctaacacatgtttatttttccacagtttctgtggtcatgagtccagcatgactgagctgagctttctgcctcagggtctctcacaagtcaacgttcaaggtattgggcaaggataaggtctcatttgaaggttttactggggaaggctcttcctctaacctcacatggttattggcaggatttagttccctgtgggtcattgaactgagagcctcagtttcctgctggctgctggacagaggctgtcaccagtttcttgccaggtgggcctcttctacttggtcacttgcttcatctaagctagcaagttagacagtcttggctggtgcagtggctcatgccagtaatcccagcactttgggaggccaaggtggaaggatagcttgaggccaggagtttgagaccagcctgggcaacatactgggacctcgtctctacaaaaattacaaaaattagcttggtgcggtggcgcatacctgtagttccagctactcaggagactgagaagagaggattgcttgagcccaggaagttgaagctgcagtgagctatgattgcaccactgcgctccagcctaggccacagagtgagcccttctctcaaagagagagagtctgctaacaagacaaaagtcacatctatgactaatcctgaaagtgacattctgtgaccttttgttcacaagtaggttacaggtcctatttatactcaaaggaaggatactacacaaggccataaataccaagagatgagggccactggggggtcatcttagaagctgcctacagaattaattagttaattaacagcaacatgttgttattgtccatgtagctcctcattctgttaacaaggtcacagaatgtatgtctagaatagcgttgatcaaaccctgttctgtgtaaccctaaagaactatgaggtgttgagagatgtctatggcctggtgagtttgagaaacactggattgaaccatgtaaaactagcttgtgacattttctgaattgaaaatacaaatacgacctgtgatcttcctggaagaagacatgatcatatggctaaagaatcataaaagttgtttttctccccttgcagatcacatataagcctcttatagcacaatctgggaaatgctgacccatatgtgaatgaatattgggtgccaccccaaacactggttttaacacagctggtaaaagagaactgtgaaaagccatacctctggtagatgattgtgggatgaatgaatgaatttggagtttacacaaagcagtcagaattgttgttcaaacagagaaaaaacaaagccaaggtcaggagagatgtgggccctagatggcactcatgattctgtttcttcaccatgaggcctactgttctttgaaagcaggacagtcttattccaagtattggttctttctccaaaggaggctaggcacaaaattgtggatgaaccggtataaaccattacctgctattaggaaaactacttgaataaacttcttttgctatttttataaagcatctagtctatatatttccattaaattttataacttgatttgttgccttcagcccaaaccctagtttattcctaacaggccccaaatcaggatgaatcgtattggcagatgttgggtgccaagactgaagtcacttattcgaaagggctcagaattattacggcaaattgaaactccaaatacaatttgtatcattaacctcttagggattatatttttgactttctcctatgtgacatatatctggtcacatattcattgtgaaccagtgcttaaaatgcataatcctcaaaggttactcgcaatcatttaaaagaccctatattcatctcaaaacccagaaccgggagataaggtttgagaaatggctgaatgggatactggaataaacaaaccatttcatagttcttaaaataaagcacttatggagcacatttttatctacaaagcttgagaaatgaatgtattaatcctcacaacattcttcatattattctcaccacataataaatagggagcaaggggttgaaaggttaaattagctttttctcccctccttggggaacttgatattacttttgaattagaattaagtcatttgtgttctccagctttaagtttgtgctgcttttgccaaatttacccacttgtggatttttgggggatagagaaattattgcagggcaattttgcctctagagtccaggttttttgagactagagtccagataaagtcagcatcttgtccaaaccttcttgggaaatgtagggtttgtgtgtcgtttcatcaatggcaggaatccctgcaaactgaaagcggtctcacacatcttgcctctctcccttccctcctatcctgttccgttctccctactgccacctgagtgagctctctttttcttttttctttctttttttttgagacggaatctcgctctctctcccaggctggagtgcagtagcacagtctcggctcactgcaacttccacctccctggttcaagcaattctcctgcttcagcctcccgagtagttgggagtataggtgcctgccactacgcctggctaatttatgtattttttagtagaaacggggtttcaccatcttggccaggttggtcttaaactcctgacattgtgatccacccgcctcggcctcccaaagtgctgggattacaggtgtgagccaccacgcccggcctctttttcatttctaaaattttactttgaagtataaagtgtacaaaaaggtacaaaggatagtacaatgtattcctatgtccctatcaccctgcttaagaaaaaatattatcagaataaggagaaactcccaggggttttgtgcccctgtagtaaaaaacccttctcttaaagtgtggcgattattgttttcatttaccttgcttttctttacattttactatatctatgtgtgtcttgaagcaatatagattattacaccgcatgttttcagactttatatatatgactggcatgataaggcttatatctttctgcaactagttttttctctatgtcacttaattttaaatttaagagattcacctttgatatgtaaggctctagttcatttttaatgcaatttaatgtttcactgtatgaatagatcacacttttgtgctatttccttttgtcagacatttaagtttttatatatatttcaaatattgacactacttctattaagattcttgcacatgtatatttacacacaaatattatatttatttctaaggtctattacaaaaaggtgaattgttggatcaaaggtattggcgttttaaacttttattgaccattgccacatagttctcttgagtgattataccaatttactctcccattaacagtgtataaaagttctgcttgttccacattttgattgcactcggtattgtcagatttgtgtatctgatgggttttaaatgacacttcattgtgttttgacttccatttttcccattcctaccacagctaaatatcttctaaaatgtttctatggtcatttagggtttgtgttctggaaatttgtctaaaatttttatcagtttttcaactggatggtctttttattgatttataattgttctttatatattctggatatcaattgtttgtcaattatatgttttgccaaaattattaatattttcttcaagcttgttctttgttgccttcagtttggccttgattactcctgcagtcttgtttctaaacattctccatctcctacttaagttttggcaaatacgtctcattcttccaagttcttgctcacgtggtcccctctgcagttacctgctctttggctggttaacatttattactttttcataacccaatattctggggagtttttgctaccctgcaccgtccctctctgtgtacttgcatgttccctgtgcagacctgtgaagacctgtcagcttatctcctctcagaagtaactgtcctgaggaagaacatagtgccacatgagttttgccaacttcacatatggctttggtgaagccttcctgaatggcctaccagaaatggctggtgaaatggccttccgaggaaatgttcagccaaggctcagctacagagtccaggtcctatatcaacactctgattaatttagttttggcagtattttcattgggggtgcatattttcatactctttttttttaatttgagacagggtgttgctctatcactcaggctggagtgcagtggcaccatcacagctcactgcagcctcaacctcccaggctcaagcaatcctgccacctcagccctctgagtaactagaactacagatacgagccataacatccggctaatttttgtatttttttgtagagacgaggtttcactgtgttgctcaggctggtctcgaactcttgagctcaagcaatctgtttaccttggcctcccaaagtgctgggattgcaggcatgagccaccatacccggcccatcatagtctttcaaaccagcagcatttttatccagttttcaaaggcagttatccacttgaaagagtggggggggggggggggggaagcaccaaatgtagttttctgaagtctagaaaaaaactcatagaaatttttccctaattctttcccaagaatcttttccaaatggaactcatcgaagaacttccaatttcctgcctaaagtgaacgtgaatctgaacgatatgttaatttactctgttctcttgtgtgagtgacaaggacatgcattgggacatctattattttgaagctgggatctagcccaactaaggggggaaaaaatcaacataccaaactgtgtattatttacacatttcaatatttaatttcctgtctccattacacatattttagtatgcagattatttgcccaacataatttatcagttccttgttagataatattctcctcagggtacatattgttcatatttagaaattcttattaatcttgagaatcacattgtttatccaacaaaattattacagctttgatgaagcttttaaagtgtaacatgtaaatcactattttctcactttcataagcagctgaatttttgatctggtggattattatggtttagaagatatttagtcttagggaaaatgcacaagatggtgcagtaatgtgtagatgaggctatataattacaactgctgttaatgacaaattgctatcactgtagctaccccctcctccaaattgcctttgttcaatagataaatgagtagtgctatccagtgttgttataaatcagatgggtccaatatttaaaaccatacatattataataacaaatgacaggatggaagaagtaaacacatatttaggtacttataattacttattttctaaattttatattgattactttgcctgggaaaatattggggacattttttatgaaaaaaaaacgtacaagaattgcattataagaggcataattattatttgataatttacctcgttgtttacatataggtttattttgatgctggatgaggccatcccaagtgcattaattgtatagattaaagagtgagaaaataaatatgtcttttaattttttagtgtttttgagaaaaaagtaccttccttctttgtgaattatggttttacatgagacaataagcgttatttacactacatgctaatgtatttaaaataccttacatctggagagccttttacctcttgcaagcatatttatatccgtggttgcattttgtccctccagtatccctggaattatagaattcctcatttgactcgtaaggaaacagaccaaaaaggttaagtggcttaaataaagctgaaaaatcaattaataacgaaactaaaattataatttcctgacttcacagataatggctttttgaaaacatagacaaaatgtagaaggttgaacaatgattaaaagttatgaggttttgtaatacaagttatgaaggtttggtagtgttccaatattggaaacaaatgatcagttccctagttatatccactagtttctgtctttaatatattttcaacatttcctttgtgttcttgacttaggtcttttccttcatagttaacatatagctaaagtccagtgagcattcaacggaggaaacatgcttgccattttcaggatgtttagagattccatcttagtcttatctgaattaagttgataagctctacacattttgtttttactaaaatcagcaatttcatctttttctcctcttctctattcttagcaataataatataactttcaaacaaattcccataagctgctacccagatgaaatataacaaagccatcatgaaactgtgaggaatatctgttcatcagctgatgtaaaaatacttcaatttggcatcaaaaaactgttttaactgtgaacatataacatactgaagtatgattcttatcaaatttgaagaccatctgtagtaatttttctagggacgtctgggatctttctgagaatcccacttcgtagttgaatggaaagaccattggaggagcatctctagtctccagttcaggccacttctttcccagatttttcattcctctttcaccaatgagctgggtggcaggggtgatatcatgtctattctgtaaggtaaactgggtaaaggagggagaattcatcactgatcttgtacgaacagctccaagttcaagctcacagtcaatgagcttagagagtcagctcctggttcaaaggattgcatcttgaccctggtctctaaatgcgtgcaaactgggtctctgtagtcatcaggagagaatggacatagagagcgaaagttaatggatgtatttggttgttccttcggctttgattgctctgctctgctctttgctttggcccagccttattcccctttccctctcttatgtacagtgcctctctgttgagaatggtgtgattaaagggaagcagaccagcccctttgatagccaatttggaaaactttctactaaaaaccatttttctacttcagggattgcaaactcaaatgcacagtgaaatgggtcatataaatatgtaaagcaggccaaggttggcacttgagtgatgtggactctggcaaactggaatgccccacctaaaggagtggcttccactaagcttcaacaaattggtaccgtgctggaatgcaggcccacggttacctgagtatctcaggtttttcaacaaaacccccaaatctggatttttgtatgaaatctcttgatttaacaaattaaaaaacaaagcaaaccatcatgtaggccaaacaaaatatgccagattgcaatcagtatttccatgtgaatgtggagaccagattgagggagagggaagaaacgaaggctatggcaatgtttcccagtttacataagttacctgcatctagatgtatgaggttaatcccaagccaaatggtttcctgccatatagaaatggcagagcaaacttcttatcccagtgtatgcaaaatttgcacatctatacatttttatggtgaaaatgtcaatggcttttattagattctcaaaaagtctgtcaccctaaaagattgtgaatctcttcggttacatccttgacaagttgtcatctagtttctacttgaattctcctgggagcaggaaacttactactgcacaagatagcccactcctaatttagacagctctgaaggtagaaaacttcttattggcgaaaattcttactcaactcttttgttattggaggctaaaaaaggcatctaatctttaactaggaaaatgcacttgaaacaatcatcttagaaattaagaggttgctataatttcctgtaactatcacacattcttgcaaaaaatgagcgttattaaattgtgatagttactaatggaatttctaattcttttacaattaaggtcattgaatctttacgtcttgcccttcatcctgagactatttgcatgaaaataaagtctccaagtttcagcatgttctattgattcatttaagcttttttttttttttttcctatcatagatttctagaaacgtagaattggaaatgacctaagcttctgtggtagaacggaaaacccaatggtgttcaagtcagaagatcctggattgatttttctgctttttattaattgtatgatgttaagctgggagtcttggtttcctcttctgaatgtgagagtccaataaagtcttcacaggacttttatatttgttaaaagcaaatacgaataggcagtttagtgtagcaatcagcaaaacctcgtgtttttttttttcctacgctgcgatactgtgcgctagttatttaacttctccaagtctcaatttccatatctgtaacatggagctaccagttcctacctctaggagtattttaaccagtgagtgaaatcatgcatgcaagggattctcagggcgcctgacaagcagtagatattcaattaatgtttgccatttgatgatgctgatagaagtaaaagccctaggtaatatgtaaagtttaaaacgattatgatcactggaacccttaattctgaacatggagaggaggatgcgaacacccccaagggaaaaggagctgggtcaaggtgtaccccaaaccgtgtcggacctttacagagtgccaggagcttaaaactattttaaaacatctttcaaatgaaaatgcaaaactgtcataagtttttagaacacctcaagagattccacagaaacttgcttttgtggcagtccatataaactgggtgtcaaggcctggggtgtgtatctctatgtgtgggtatgttggaaatttagaagctcaattacctccaggccttcgtttttcacatatggatctcccatgggaagtaatctggcaaattttaggattctgttcccttcaatgtgaacttctgaacagaaagactccttctaatgtaggttctcagtagcctcaactattctatttaaagtagtaattatgtgtgaatttggggggaaagcagtaaaaaaaatcaacattgggaaaggaaacagaaatatgcctaagccaagcaccctttctcaaggattgccatcatatatagaaccttactcagggagagattttttttttctcctttcatagtctccagacagaatcaagggaaatgtaaccccaattttaaaagataggctgaaattataggaaagtaatctttccattgactaattcactttgctttcctattgttgaagaaaaagttgttggttttatactttgctaaaagcaaaagagacgtaaaatagcaattatttttcaccattagtctgcctttctttgtgttgggggcataccaccacacaataactgtctgtgattcagaaataatgagtggggagaagctggagctggagtttatatatcagtacttttacagtgagtacatagaacggttttatttgggaattgaatatttgagggctaggggcccctccctctgaaagtgcaaagaccctgaagcgtgactgctccctccgtttcagtatttgagtggcatgtcgagatctttccagcacgaggtgcataatgtattgtgcaggctgactcccatgtggaagagagcacaaaacttccttatgcatgaggcatttttagcaaattggaccccatttcaatcttgatgaaacttgatgacatttccaacttgcaagtgcacaaaatgaaaaagcaaatttttagctatttatgtgtcagaacatcaaaagctcaaaagccataattaagggtgtcagcgtggcagggagactatatttctcctcttctcaggggtcttttgggtctctccttagaggtgagagagaagctctgtttctccttgaacactcgaatcaaacaatttggatttcatgagccccacctgggaaaccccctcttcattccaactctgtcatgttgatatttagtgtttttcatttccttcatggaaagagaaatttcaggaacaacgatatagttggtgctccctactccttaacactttctcttggctgctttctggaagtctgagggcaaaatgcaagaaacagtgatttgagatggtattttaattccttttaattcttgttttcatattatgtgcaattaacttcttgactttaaattctactaaatatactgaacaagctcttctgatatatccactgaataaaatatatgggcataatatatttgggcctaaatatatgtccaaataaatggacaccaaaattttaataaatttccatttaaacatttaaaccagagcttctaaattttgtgtgtatttgttaaaatgcaggcctaatcccataggtctggagggcagcctgagaatctgctttttttttttttttaagagacagggtctagctctgtttcccaggctggagtgcagtggcatgatcatagcacattgtagtttcaaacttatgggctcaagcaatcctcacaccccagcctcctgagtagctgggaccacaggcacatgccaccatgcctggctattttttttttttttctagagatagagtcttggtatgttacccaggctggtctcgaactcctggcctcaacctatcctcccacctcagcctcccaaagtgttggaattacaagtgtgggccacagcgcctagccagattttgcatttgtaacaagctcccaggtggacccatgctgacggtctctggaccacacatggggaggcaaggctttacaaagcttttaaactaaggggcgactcttaaaattcagctatggtcattgcgatcatcaacaggtacacttgtctgggatatacatgtgttggttaagatagcctttgaattttataacagaaatattattaaaattaatccccagtactgctgctgcctgttaatgattcataaaagcccctgcctaataagagctattttctgaacagctcacgttgaattgcaaatactacttccaatctgagtgacatccacaactcacattgctggagctggggacagagcagcttctgcaaatattggacacccagtgtatgtaatgcattgtcttgagagctatgtggaaatagaatgttgaataaggcataaatatgccatcaagaaatttaaactacgtagagggggaccgggtaaaatggagactaaagtgataaaagacacacccaaattaaatgttatttggattcaaaagaaacggagggaaagctcatttgatggcagagcccaaagagagtcctaacagagaagatagcatttgaattaggccttgaattagttaccaggattgggcatgtagaaatgaggctgtaggatatggaacaaggtaagaaaatataaaagggagggaaggtttgagaaaatatatgaagtaggaaaactagcttatgtgtcataaattgggagtggtctcggtttggctgaaatgaagatttcatgcagggcaatggttgccaataaccctagaaaggaaagttgggattataacaggaatgacctcaagagctggggaaaggtgtttggacttaatttagtagagagcagggagctgttctttacccaaccctcttgttctcagttctactttccgaatttcttccttagttttttttttttttttaatttgaattatttgtgtgtgaactgacattttaatccttctcaaatttcttttggtagtctataaaagagatcataaaaggaaaatagatttgtcatacgaattaataggatatagagaatgagggggaaagaggattctacgtaccaacctctgaaaggtgattctgtcttacaaattgcaatgaagggacccagatacatggagaattttacctaccatgtatttggattcttgcttcttaaattgaagacatcctgcaatgtgttaggtgagatgggaaggatacacctggtacatcttcctggatcatcagtttcattcaatcacagtttcactctatggtatataatttaaagactttaaaaatataattagaaacaattatatttaatcttcaagttaatttacacagtaattaataataatctaaagtcagtcacaggtaccattttggatttagatgtgttttcctcttgttctttaaacatgaatatttaaccaatgctgattgtgttagactggtttcttgaaaagctctttctcattttttttaagagctgtaatgaaatttaaaaatcatctctctgttaatgtgaaggccagctgctcaagccacatggctctaatagcaacaaggcgccctggtggcttcccctggaattgcaggtataagaacgtggggaaagggatgaattgcagaaggctaggtttacgcaggcaatataagtgctacaaataaggtcagccgtcagcaagccccgcatagcttatccatgttagtgtttctcaactcttgcggttccttttttttttttttttttatcataactcacctaaggagctgagttagacttgtttttccctaattgctacttctcacctattatattttaaagccacatcgcacaggctgaatgtttgtgttcccctccaccacccaaattcatatactgaaactccaatgtaatgagagttggagatggggcctttgggatataactggagttagatgaggtcttgagggtggggcttttatgatgagattagtgcttttgtaagaggcgacaccggagagcttgctcactccctccccgcatgcacacaaagaagtcctgtgagcacacagtgagacaatggctgcctacaagccaagagaagatgctccagaatgaaaccaaccttgctggcattttgatcttgaacttttcagtttccagaccaatgaaaagcaattttttgctgtttaaaccatcctggctatgggtgtttgttatggcagcctgaactgaataatataccacagatgtatctgcttatgttctgtggccaactggatggctaaaaatcattatagtatctaagattttaaacccttaaggaacaatttttgtccccttggagtgatgttggccccattgatgatgcgtgaacaagagttttgcagcctccctttctcttaggttatgatcttattctcatacccctgtagcagctctaaactgaatcctctggaaccacccttctatcaaccagagatttatcagagtcacttattgagacatctgctattgaaatcagatgttcctttactgcccactcacataaacacaagtctacctgtgtcaccaaaataacttgtcccggtaattgattgaccatttagtcactctcctagactggactcctaccattcccggagctctcctcttctctcagtcatttcccctaagcccccaattgtgtggagcccacttccatcccggctacaattcctccggctacaattccttgagttctgcatgctaaagttggcaaatagcacatacagaggtgcttaaagctgcactcttaatcccaccagccaacttaaaaatggtgtagagagaacatgcaggggaagagcttggcctctgaggttctgcagtttcatcctattttctttccctgaaagccagactctacctcgtatgagtatgtgtgtcctttcggatactctcctgcgcatcatattcacaatagctctgtgagatactgatcaagagcatctccacgtttcagatgaagaaaagattgtgtggctaatacacgtgggatccactctgtgatttcaggcatctctggctccaaaatcagtgctcttatcttgtacattatactgcctccttaaaagatcctctaaggacttcccagataaaattaattacttattctttcttctgtcctatttgtgtagaggtaccttcatttgtttttacaggtggtcatttgtttagcaaatatttattgtgcaactgctatttcatagaaactttgcaatttatttgggatactatggtgaaaagcaccatttctgtttccaaagagctcacagtttacaaaagaggtgggccagtgaatagataacttatacagtgtttgatacattagtgatcgtgataaccacagggtgctgtaggagaggcacccaacctagtctggctagtggtgtggaagtggagatacacagaaaactttctttgaggtggtgaattattttgtattgcatcatatgttcgtgtgtctttctctctactcttactctgtaagatactccagggctggagctgtctttttcgtatttgatttttcagcaccagctattgtttggcacattgtcagtgctggacaaatgctgattgtcctagagctcagagtatttcccctgctatctgccacagactctatttgtatccccagggttaatgtcttaggatttttctggttgcaagacatggcagccaattccatctaactcaagtgaagaggggtgatttactataaggatgtaggggggtagtgtggaaatcagtgtagaaataatgcagctggtcctcaggagaaaactagaatcagaaactggtccaatgtcagaattctctttcatccctatttctctttcagagctgctatatccttatctctctccatggtgtggaatccagtcaccttatacctctcaggtttagatactgtaggtccagccacaactcgaattctatctgtctcaattctaaataccctgaagggaaaatgagattggcccagctcaggttagtgaaaatatggctatgggtgacccattgttgtggagatgagggcggtggtgaaaagcagtttccagagaaagggtaaattattgtgaagtgagtagacacctgaacgtacgccacctacttgaaaagttgagaagacagtccttaggatgatcttaagtgtggcaagacacttctcccaggacacaagaaattagtaaccagggagaaatgtttctctgatcaaatttaagaccctctgtctaaagccatttactcacgatgctcctggcttgcctgggggcctctcttcctcattaggtcaattattagccaaatgatgggaaggccaagttatcaataaaggcatgtctcttggtccattgaaaaatgatgtccaaatccattggtaaatgatgattcttccctaagactagtgtgttatattgtttttaaacctttacataatgacatggtgttgggatgtctaggtcttgcaatacaacagttagtgaaggtgctttctgaccctgcataagaacacatgatagactagataagaaagaaacaaatgaaacactttttaaaaccaattcgttgttgggttcaaaggaaataaaaataaatactcaagtgatttataaatactgggaatcatccagaataatgatcaggatagcagacgtatgcatagtttttaaagacaaaagactgaattcttaacactaacgtggaaacttaagacacaggacagatcacctatcagaccacataaaaaactgtaaaacagaattgtttccataattcataatgcataggactcccatatgaaaaaataacctcagctgatgatgtgtccacaatataaaaattacaaagcacatgaggaagtgattcactactagggagaatcaactaagtttacaaataagaggactgatactgaaatgaacttgagcttataaagaggatattacataagtaggtttaaatttcctgaaggcttcataaatgaggaaagagagtataaataacagaactggcaattttggttccaaaatcaggagttccagaaacaaaaaaatgttgtaatataaacctcaatggataggtcaaatagcagattagctatatagaggagagaggggaaagggagagacagagaacgagaaagaaagacagatctaaacaaataatatctattgctgcccagagtcatagagaattggaaaacaagaaagggacattaaaagtcttgaaaggtagaatgagaaggtccaaataatttgctagatttttcctgaaggaaagaatagaatgaatgagagaaaagctacattatagttgataatgtgaactattaatgaaagatacgaatcttcagattgaagaattacattgactccgaagcagggtaagcaaaaataattaaacaactagaaataccacaaataaactgtagaacaccaaagtgaaaacgttaaagacagctagagaaaaaagacagattacatataaaggagcagtaattcctccaagagtagaattctcattaataataacaggtgtcagaagacaatggaatatctgcacaatgctgggagaaagaactatcaatgtacaattacgtaccctacaaatctactatgcagcagtaaggggtgaagccagagagcatgtttctctcataaaaccctgctaaaatagtcactaaaggaggggcttcggggaaagagaaaaatggaaacattggaaggaaagaaagagtgggacagaagaagcaattgtgagtcaggaaattggaaattatatgagttagcctgaaaggatattgatatgggagaaaagactaatatggcagagggtagaaaataggatagaagaacaatagttcaccctaatgccacggatgtataggatgcaagtgctcttgggtacatctagaatttttctttacattgttgagaaagcatggtaaaaatcaattaataaatgcaaaataaattgaaatatttaaataatcacagtaaatatgaatgaataaacttgccacttagaagtctgatatttaaattcgttttcaaaaatccaattacatactctttcaaaagatggattttaaatacaaagacacttgctgatatagcagacttggttttctttttatctcttgagaacccagagtgcttcgaatgaggtcactaaaactccattctcacaatagatgccaaaactcacaggaacatattttggagtattgagtgctttctatgaacaagatataatagcagttgaacatgtctggatctaggattccaagtattttaacgctttataacatcaaattgaagaactgctgatccatgtttgccacaggattagttttcacagatggctgagaataaaacatatgaaaggacatatatatatctcctttcagaataaaatggacacatataacagcatatggtatagttattttaattatgaagttttatcacaccataattaatgataaaatagaaatttaaaagacatgaaagcattaatttgtgttgtaatgctatgatataaatctctttctctcttactttccccaaatcaatttttccatgttattaggccattcatattttgatcatgcacatagtttttaaaagccagagtaaataatgggctgggtcatattcatgtgactgcacataaaccaatgttacaaataattatatacaagcagtctatttacaaaggcaaaattagatggctttaaaaattttagataattaaatctcactacgtatttgtctgaagacactattatttttattttatttgaccactgatttaaatagtgaaggcagagcttgccttaagggacttagtccagcacactcataaatgtaaagggatgtgtacaagtttatctcctgctatgagttttggaagtcatatttggtacactgacatgtcgaaacaaatgttatgggctgtatttttatgtccccttgaccaccgccccaaactcatgtagtgaggccttaccctcagttgatggcatttggaggtgggacctttgggaaataattaggtttagatgaggtcttgcgggtgggacccccatgatgggattcctgtcattttgagaagaggatgagaccaggactgtctctctctctcagccatgtgagtgcacagtgagaaggcagctgtctgcaagcaggaagagggccctcattaggaagcaaagcaaatggcaccttgatcttggacttccagcctccagaactgtgagatataaatatctgttgtttaagccatccaatctgtggtattttgttataggagcctgagctgactaatgcaatagggttccctgacgaggtcggaattgacaagtgggtcaaattggaggcaccgattcattcatctcagttttgtgccctccagaggagcgggtcagaaggaagtttgaccttgagtagcctctgattcacatgagcctaaatctctggtgtgtgccagtttccttatgtgtgtttataatgagaatgtttgaaaccaaatcttactctatgttttgtggagcattgcaatgagtagattaccccgtgtgtacaagggtctagatcttgtactcttgccagatgtttcttttgacttccggtagaaaatatttgataagtttcttcctcaacgaaatctctttgtcgacagagtaaaatataaatcaacattgaaagtgaagtagacacacataagttgtttatgcaaacaggcaataaaacacaccactcaaaggcatttttagtaagttttctatttacagtatttgtcaggagactcatttatgctaaagtagggtagaaatcatttagttttacacaacagtgcttatattttactgcaccttcgtgcctctgtttagtccattctcatgatctcttgaccaaaaaatgaaaggatagaaaagtggaatttttgagaaatgaagacactggggaaagattttaaagaaaacatcttcaacaaaggccaagtagagatgatacacagtgaatctatgtgagaaaaatatcccatgatggttcaattataatataggattcaaagcattactatatatgaagatatcaattctttaagtgagatttctaaacaaattcaagctttatttaagatatagcttcctttgggacattcttttagcattgcaggaagtactttattttcattttcttttgctgagcattttatagtcacttggggaaattgtagaatcaagtatatgatgctggatttgaaagggaccaaatcttacatcagaccacagtttatcttgacttacgtaaactttgataacattgcagaatatgccttattacttcagattattcattagaataattcactagtcatcagcacatattcattaagtgcctggtctgaaaattttgatgtttatttcctttggccatctcaataatccatgaggtagctattattattatctctattttccaaaaaaaaaaaaaaaagaaagaaagaaaaaaagcagaagactagagaggttaagttaaagctttctagtaattggctgagtcagaatttgaacccatgcctcttagatcttaaggactatgtgtgttcactatattagggctactttaattttctcagtaaagagattttcaaaaaggattctaaaacaaaagttacctcttcaaagatgtttcatgagtattttcacggaaaagatcatttccccaatattcatgtcttagacatacttacgtatctagtttaaattaagctaattaggatacaagcatccacatcttgtttagagagtcagagatactgattaagggccaacgtggattctctttcttttgttttgtcattaaaatctttgtcattgtaataaactcaaagtactttgtaaagtggaatgagggacatcagtagatgaaggcatttgtaagaattttcttctcccctctattctatgagtctacagacataggaatttattcccttattcttgtcccaacctagtttctcattgaaatgaataaacaaatgctttcttaaacaacatttgaaaaaacaaacaaaaagacacattgactctaaaataatattcaaaagaaatcactgaatttgacccctcagggtgctaagttgcccagtgttgacatctcaaccatgtcagtttggatttgtgagttaagttggtgatatttattggatgagaacttccaatttatctgttattgaactcaggaacacatcccgtaggtcttgtgtaagtttggaatatgtaccagaattctacatgtaaagtcttccagtcaaaagtttcattgcaaaagttttgcacaaatctaatcactaggttaaatttctgacaccctcttcaattttaaggttggaagatttaacgaaagtaactaaattcatggcaagagaaaagagagcagggagatataaagaatctagcatttatctgagcacagatattggaaattattgcaaaggggatatagaaaatgactaagttaatgacttgttttcaagttttaggagaagggcgatgctttcttttttttttttttttttaaagaaaatagtctgcattgccctttttcattttgtcatattttattttgatttaaaatatttttctgggattctttagttttgctgtattctgtgcactttccagtaaatgatctatttatttacatgaaaggcaagattccgcaatgcaaaggcaacacgagagactttttcctaccaattttctaatgaaagccagtgacagtttttttttatttggttctaagtttcatttgcttaaaatgaaaatgtattcttaaaactaaataaaaaaatatcatattatcagtatttctggctgcaagtgaatgaatacttattctgaaaagacccgtctgaatggccactctataactaccgtgttttgttagaaaagtatattaaaaagtagaaacagcatcatgaatgaagaaaagggatagaaacaaagtataaaatatgtaatcttttaaaaggaccttatcaaggagaatcttagtgaaactttaaatgggagattcatacaatcccaaagctttcttatttcctattcaatgaataatttactttttagatgagattcactaacattattgcagaataactgtaattgaaaattattaaagctctatctttattgcattttaaaactcgtgcatttggtgtttgaccaggtctgcctcatcattaagagttttgaagaaacgcaaaatctctgtctcccaaagaataaagagcaaaaaccttaattgctttcttgtttcccacaaagatgctaatatgatgaactgaatgtcaggaataataagataaaatgatggtgtacaccctgggaagagaaaataaaacatctttttatgtaaactgtcaccagaacctcaaggaaactctttgctctttctctgccctgattttgaactgcttcattaaaagtaattttgtttttcagaaggataacacccacattattctattaaaaattttaagagaaatcttcaattaagaggttattgttgtctgaaagatttttccatagttggttggtagctgaaaatgtgatcttcccaaatttgaatggaaatatgacattcatcatagtttaaaatagataaatgtcttgtctgtttgaaatgccaatgaacttgatattatttatcagatcctttgaaaatgttgtaattttcagagaaagaattttaaaaaggagagaaatgaatcatcaattcttcttgccttcaattgattgaaaagttaaattatacagagatatttatagagcccttgttccatgcagtattttgtcttttaagagttgaaaataaacaagggatcatgggcctcagtataaccccctgataatcttcctttgcgttggtctggtgagaaagaccataaaacccacatcattggccaccaatatcttacccagggcttgtcctgatctcaatttagatacctgcttggtccacagtgcaacttgataattgtttagatacataaatacatttaaagcacttataaggaaatctaatttaaaccattaacaaattctttctatgaaaaatatttctagctatttatttacctaataaatttgtcctctggataatttttttaatttaattttatttatttatttattttttgagacggagtctcgctctgttgcccaggctggagtgcagtggcgccatctcggctcactgcaacctccacctcccgggttcacaccactctcctgcctcagcctcgcaagtagctgggattacaggcaccccaccaccacgcccggctaattttgttttttatttttagtagagacggggtttttaccatgttagccaggatggtctcgatctcctgaccttgtgatccggctgcctcagcctcccaaagtgctgggattacaggcgtgagccactgtgcctggccagataatctttttcttaatatgcacggacaaatacacttggttgccaatttagaccatgagaagcactttgcaactgaggcagtagtgacctgaattaccagatagtttctccattgttgttacattgtctttatgccagcaagttcaaatgtaccattaaaaagtttatgttgacctgagatgtctgttagaatcttttttcccccaaccttttattttgcacccaaaatgtgttctgagaaacgttaatccccagaaacactcatcataaaaggatttcaggtcaaataattctgtggaaatctgaatactgaattatattttgattaaaaggagcatgggaaaggctctgagaagccctgcattctgttctgtaaaacagaaatctgttctgcattgttcaatgtcccacctctcaaactgatttaaccatggcaccccgagcccttttttagcatccaacatctacttgcttcctttcaaactaatgttgtggggaccctgctgtggtaaatatgtctcagttaaacaacctttgtgaggtagctgttacccctattttacaggtgaagaaactgaggctcagaagttaagtaacctgcccaaagacatactactcttaagtgatatagctaagatgtgaagcctcaagtctgaagcctatcctataatctggcaatgtgaccagaaaatatgaggagatagatttgtttgaatatatggaccatttccagctacacttagcaactttatctgttctgcttttctgtgcactctttcctagatttcttttctcctcgtgttcatgtcattggggttttgtaagaaaactactcttatttatttattattattttttttgagacggagtttcgctcttgttacccaagctggagtgccatggcgtgatgtcggctcactgcaacgtccacctcttgggttcaagcaattctcctacctcagcctcctgagtagctgggattacaggcgcccgccaccacacctggctaatttttatatttttagtagagacagggtttcaccatgctagccaggctgctctcgaactcctgacctcaggtgatccacctgccttggtctcccaaagtgctgggattacaggcgtgagccactgccccctgaccgctactcttattacatacagtatatttacttagaaaacggtaattgaattccatgtaatacagtaattaggactgggctgaaatagcacatagaacagaaaattttataataaatatataatggcacagaggaaagaaaaacatgtacattacctcaaagctgggaatgacattcaggaaaatattgtgagtccattgagcaacatgaaatgcaggaatccactttcctggacagaccatttaagcaaatttcagaaatattcaaaagcttcaattttatatgtaatattaaaataaaggttatatcaagaaaaatgtttaaatacattaaaagattcctcatagtgagaaaaaatgtttttaatttgtgtgtaaacacattatctatgtatatatctttattctctatatatacatgtgcatttttgtggtaagaaagcatgcacatgaatatacaaatatgcatatatatgtaactaatacaaacaaccttgtatttgaattgttaaaatatccattttggttattttaaatgtaatagaattttagattcctttaataaatgcccagtggatagatttattattattattatttttaatttcctgcatcagatctaggtctttgataaataccacagacaaccccagaactgtaggatgggcttgacagttcttcaataaagggctgtgtggttttttttgtcagtgtcttccttccagtgacagctgctttgttcttttctagtcagattttctagttaacacatcaaaagtgtatctgtgtacatgaagtacgaagaaaacagttcaaagaggtaagagattcacttttaactcttcaccacattttccccacacttgtcacgagagacacttcatatgggggctttggaataaggtgaggagttcagaatggaacccagggatgtatggcatttggtgattagcattttagaaggcgagtcggtcagccagtgctctgagagaaccccaaattagcgagagctaatctaggatgaagaatttgatttttttcaggacagtcaagcccatgcatttgattggatgcaggtttttacattcaattcacgtcaaagtttggtttcttctcgccataccatgatggcccgccatgatgacagaagctgcctgcttcacgcatgtactctggagtgttgctctcacctctgccagcaggaggagctcttgcactcatgtgagaactgaagtcagccatgcctccatgctcaagcaaatgtccttggaggtgacactccaagattgtttttgactgaggcgactaaacctgaattggcagtgaaatattaaaaacgcaggagagtatcctctagcacctagtcttctcttgaagctctctcaagtgtctgctgagtcagggatgcactgaagcaatgatcatatagagcagtgatccccaacctttctggcaccagggactagttttatgaaagacaatttttccacggactggaggtgtggggggatggtttcgggatgattcaagcgcattacatttattgtgcaattcatttctattattacatcgtaatacataatgaaataattatgcaactcaccattatgtagaatcagagggtactctgagcttgttttcctgcaactaaatggtaagccgtatctgggggtcatgagagacagtgacagatcatcaggcattagattctcacaaggagcacgcaatctagattccttgcatgtgcagttcacaatagggttcgcgctcctataagaatctaacgccactgctgatccgacaggaggcggagctcaggtggtgatgtgagccatggggagcagctgtaaacacagatgaagctccacttgccagctcacctcctgctgtgcagccctgttcctaacaggccacagatcagtactggtccctggcccgagggttggggacccctgctgtagaatgcagcctttcatctcctcctctcagtcatacctagcataagccctgagtaggaggatgtctagaaagaactctccatcagttgaaatgggcccatactgtactgtatcgtgtgtatgtttgtagtgtaccaagcaaggcaaaaaaaaatacacatttactttaaagaatttttacatttgatcttttaacaaagcatcagaagagtcatcatgagaaaaataaagactttcttggactttcttcagcttcctttatagtcgagcatggttttaaaatttgaattatgtaagcttttcagtaacttggggctttgaaagtcttaagccggcccaagcaaaagccaatacacacagcaaacaaacaaaatagtgctgaatttcctgagcgtccactgtgtttctggtgctggtgctgccttaggcgtgaaggagacaggacagtgacagggcagggacaaagactggtggccgactgcctggagtcagccgagtcagctacgtagcttaactactttaagcttgcattctcccatttgaaagtgtggattctaaggatcccccctgcacaatgttgttgtgtttgaagcggggtgttacttggcacagtccaggcacttggtatgaatctcgtaagagactcagagggacaccaccattgaccagggtctcgacagacctgggatataataacaagtatcgatttggtgccaaaaattatcctattatactgtttgtgtgggacatttactttggaattaataataagaggtaaaaagtattagtcattgaggattttattttcactaatactatgcagtctataatcaggaatgtgatggtctttataattttatctctttcctattaattttccttttttgtaagacaaaatttctctctgtcacccaggccggagtgtagtggtgtgagcctggctcactgcagcctttacctcctgggctcaagcaatcctcctacctcagcctcttgagtagctgggactacaggcgtgtccactaagcccagctaattattatatattttctttgtgtgtgtggagacggggtttggggttttaccatgttgcccaggctggtctcaaactcctgggctccagcaatccacctgctcgccctcccaaattgttaggattacaggcctatgccattgcactcagcccaattttcaattattaaagaacataaagaatatagatatgcttattaacaaatgtaaaataacattatgaacgtttaaaacagtaataatttaacattaactgtcaataagaaaacaaatagtgaaaaaaacatgttttttattcaagatgaaaagctgtgaaacagaagatttttctctatttcaggcatgtattccttaaattgtttctagaatagataacttttgaaagattagttttctaggtctcaaaataggattgttttgcaaaataagttttttatcctatagcataacttttgcatgtactgtaattaatagcaatgcttttcaatttttaaattgtctgccaaatttttccaaccttactgttctcgaatgtcttctccaatattttcttttgtatagcattcacctcaccgtcctagggcattccaaagtgtgttttttgcagtgaggaatgctctccttgtggttcccaactctctggacttctaaattacctgaaatacttaaaaatagtccctagcccttacctgataactcctagataaatagttacagcctcagaaccattcagagggcttgttagagcacagatgatggggctacccacagacttctcattcagtggggctggggaaggggcccaagactctgcatttctaccaagttcaaagattctactgatgctgctggactggggacatactttggtaacctctatattagatcatgccttgctggtaagctagtttgttttgttttgtgttttttgagatgaagtctcgctctgttgcctaggctggagtacagtggtgtgatcttggctcactgcaacctctgcctcccgagctcaggcaattgattcttgtgcctcagtctccagagtagcaaggattacagatgcctgccaccacgcctagctaatttttgtatttttgtaaagacaaggttttgccatgttgaccaggctggtctcgaactcctgagctgaagcgatccacttgcctcagcttcccaaagtgctgggattacaggcatgagccaccatgcccagccgggtaagctagttttaaagcacactccctcactccccagcccctgaccaggtgattatggcgttcagccatgcttggaaaccagtgttctgggaatagtttacatggctttgtcactgctcacatgtcacctgggcagggaactgagccagggagtagaaagcctttaaggtgccttcaagtttgtagggaggagcagatcccctctcagagatgtgcagatgtgttgggggcagggagagtgcaggaaggtaaagccttcaggcttttggagggcctctgaggattccctttccagaatcattttaaggtatcagaatgaaatggagccagcatgtgtgaggataaatgagcacccagcacaggaagtagcatagcaggaatgcagggagtgagagccattttcaatgttgttgcctctgaacagattgggcggatgcccggaagacagattctaggtccagcttcctcgctgactaactgggtaccctggggaagtcacaatctctcctggccttggtttcctgaacattctctcacctcttgaatcggtcactgtgattatttgattgtctgtctcctgggttgtactttgtcttatcccctaccatatctctagcacacagcagagagcctacctcacagaacttattagatgaatgagtgaagttaatgactatgtttctcttcaatgttctatgggagtacttggctcagagtaggtattctataaataactactgaatgaactaatgaataaacttacaagttacaggtgtgactaatcacaggctttttatcatttgcgggagaaatgcgtatttttaaaaagcttgttcggtaattaggtactagggaatcacatatacaaaaaatttccaagtgttataatgttagttgataacatttttacctgacatgtaagcattcttttattattagacttaaaatactgtacctgtggccgagtaccgtggctcacgcctgtaatcccagcactttgggaggctgaggcgggtggatcacaaggtcaggagatcaagaccattctggctaacacagtgaaatcccgtctctactaaaaatacagaaaaaaattagctgggtgtggtggcgggcgcctgtagtcccagctacttgggaggctgaggcaggagaatggcgtgaacccgggaggcagagcttgcagtgagtcaagatcgtgccagtgcactccagcccaggcaacagagcgagactccatctcaaaaaaaaaaaaaaaaaaaaaaaaagaaagaaagaaagaaaaagaaaataatttattatatttgaggaaggtcattaaaatacatataatatagttccaatacactgatttaaaggcatatgtatttaatttttaaatatactttcaaagctgttatgcacagttccatagtccaggtggtcaatttcttcctgtccaagttggaaagcccttgaaagatacaggattcaaaagaaacctttattaatttttaacactttctttttccttccttaggatctggtttttgtctagcagatcgagcaaattgaaccaccatgggttttccaaaaagcacatatccattagcttcctttaaggcttttgctgctgctttttcattaggaagtccaatggaagcttgtcctttcatacgaccttctttcatcaaacgtatatcaaacatgatctactgtgtttctgatgaaaagtcaacatatcttccaaaaatatatttaaggtccttttcttgaacatgtttagctaaattctttacataaattctacagtttggttcaccaggttcataacttctgaaaactgaaagtgtttccatttcttctctagaaattctgtccttttccaattcccttctagaaatacattccgatggcatttcatcagagtcttttttaatctcttctgtgatgttcaaattaggtttgggaaagatttttccaaatcctatactggatgcatcagcttcagtaacaggtagatcattatttttttctcacaattttgtttcttctctaaatctttcttaaatgcagctggcatgtcggtagatatatggaattcaattcttttattacctacaggttgtggttggtcaaatacatccgaaggtaacagcactagatgtaaactgttttgtgaaggacacgaaagtatgttcaacatatcctttatttttctcttttttctcacatggcgctgccttattgttttgggtctttggggctgaagatttgctagttccattagtttgttcattttctgttggtcctcatcatcactgctgtcatcttctaattcttcactagataattcctcatcgtcttctggccaaggaggttcctcaggtggctgaggagatgtgggtggaagaggtggatgcaatggcatatggtcttcatagatgggaggctgcgcagtaattgatctaaaagctgtgggcaaattcattttattcataagatgaaggacctgtacatagaacttaggcacgcttgccaaagcatttactctgtttgttaggattgtgctggaaggtggtgggtacatatacttgaggcatgaattaagaaaagtcagcccatggtttggtgtaattacattttctactgttaaataaccaattctttcttttctttatcgtcttcaacagggtcatcagacctttttttttttttttcagagactggagtgggacatggggagtgaacttgatcttgctcttttgcaaattcaaagactaaagtatgacctaaaagtttcagctgatggagtcttgtcaatgcctttatagctgctttttagggaatgtggcaaaagctgtatgtttcagctgccccttatctgacaggtcatgcaccaaccgtgccttgaagtacttcagcaagtcctctttctcctcagcggtcagctcagctggcaggtgcctcaccagaagagttcggtcggccgaggcagggaaagtggggaggagcttgtgcatccccttgatattgcaaatggctgatagagagctggcattttcaagcaaaaattggcccagagacatgtgggactcactgtcaagattaattgtgaaaagctgggcaaggctaagaagttaggttttgtttttgtttttgtttttgttttttgttttttttgagatggaatcttgctctgttgcctaggctggagtgcagtggcacagtctctacacactgcaacctctgcctcctgggttcaagcgatcctcccacctcagcctcccaagtagctgggattacaagcatgtgccactatgctgggtaatttttgtatttttagtagagacggggtttcaccatgttggccaggctggtcttgaactcctgacttcacctgatctgcctgtcttggccttccaaagtactgggattataggagttggccactgtgcctggccaaaattaggcttttaatcaaataaaattaagtggaacattttgaactgtccaagatgggtagcatatattatacttatgtgaacgaatgttttaaattatgacaaaggctgtaccacttaagagtgtgggcttctatgtttcagagaaattggtatctaaagcaaagcttcccaaataatgatataagatgtcatttatttttattctaaaggaaagaataaaatgtttacatccatactttatcatcactattattattttcaactttcaggatcctcttactacattcttccttctagggaagacagtggtacaatacccagcaaacagcagcccatgggtgtttatcagggtcaggatcataaattatcagaacttaatgagtccctggtgctggatggcagacaagaggccatatgttttcattctccacacctaaactctaggcagaccagggaagttgataatggctgcatttcctatcctactaccaatgagatataggatctcatgtcttcgaaaaatttatttttattaacaaatataaatggaagctactaggattgatcagcatctgcaagtggaatgactcctatttgccataactaaattagtccatgccccacattttgttctatttttttgagacaaaatcttgctctgtcacccaggctggagcacagtggtgcaatctcggctcacttcatcttctgcctcccagtttaaagctattcttgtgcctcagcctctcaagtagctgggactacaggtacgtgctggcatgcttagctgatttttgtatatttagtagagatgaagtttcaccatgttggccaggctggtcgctaactcctgacctaaagtagtccgcctgccttggcctcccaaagtgctgggattactgcatgagacactgtgcccaaccatgccccacattttatagatgatagttcatactctggagtacaaggattagtaaggaccagaatggataacgttcctgggtcaggcatcattttcagttcacatgttgagtgaatggaatagcccgcagaagtatgtaggatcaaaggaaatactgtaaagtgatttaaatgtgtctgggggagcatccctcttcctgttcccagtttctaggcattcttgccttccggctgatcctgacatttggagtcctgcagtaagtcactccatctaagactgtctacacaagaagtgcctcaattccccttattcctctcccgaaccaaaactaccatttctccatctgaatagctgccaagaatgtgtatattactgataagttcaccttgacggtccctgaatgttccaataaatactagtccagcaagaaaaataaaaatgagttttgaggttaaatatatacttcacagaccctgcttggagattcccaacaaatattagctccaaaaagtcccaggtcaggaatccagtttaatattttaaaccatttcatattttaaaaggtagcctgataattcaaaagacaatgattgaaatacggactctcatgattggaataaagacatcatatgattatgggagatttccctatctatcctctttcagaaatgttttcctcttattttagaaattcttatttgaaaggttgccctttcctattcatctttcgattgtctgactctttaagaaagggaaccaatccttggctatgttttgggggtgacatgaacctgagaggtccagacaaggaattcttttcaattaggagcaagataagaagcatttggggcatgaaattaacattgtggtttattactaatgatgtctattaataaccctcagtatctctcttaaacatttttgcctggtatatctggtagtgcaggaaagtgaaaagtatgaaaaatttagagaatttgtagcagtgtagaaagtaatatttcacggagtaggtaaatatagtaattttcaatttaaaaactgccttataaggtttatgtaagcatcaaatgcatataaatctttaacacccggtctggcaccaataaatattttctattaaaaataacagaaaagagcaatttcctttcacatttattggatactgggattatatgtatctggcctgtgtctctatcttctgatttaacattttgataaaagtaacctcttttgtaactgataagctttccaagtggtcaaactagtgtggttgtcaaatgtgatgcaattttctgttaaataacggaaaacatttattaagtacttactgtgttccaggttttactttaagctttttgacatatatcatttcatttccataacaaccttaaaagataaacatttttatgattgcactcatttcccagatgaggatactgatgtttaagcaaaattaagtaaacatcagataaacagcaattggtggaaaacattcgagtatcttttaaaataaatgtgtgatagtatatgtttgacatggaaacaatgttagggatggcctatttttaatatatctttcataaataagagtaatgaggcctacaaagggattgaatcttattcttgatgacccagctggtagtcagactcagatcttttatccagcaagttcattttattcaatgatcctgggactgcttatagattatagtctatagatatgaaactaaccctaattaaacatatctctgagctagttgcagcagattgtattttccataatgaatgaatgtatagctatagctatatattccatcccacattctctttttaaaatatgatatggacactgttccatcaagagatggggactttgttctgccactttgaaaacagttagactttattttattttactttaaaacattatttatttaatgttatatatttaagctgtacaacatgatgttttgatatactttatacatagtgaaatggttactatactcgagcaaattaacacatctattatgtcacagggaagtaaccctttgtgtgtatgtggtaagagcccctctaatcaatggaatggcaatatacacctgtttgaattttagaactgtggtgaaacagtgatgacagtctcccatgccccctctttatgaatagggctgttcttagcagggagtctacagctgtcccaccattgaatgttgaatgtttctggaatagataaattgtctcattgattaacagtcttaagatggagacgaatatagttgagcagctgtaagtcaaagaattgcatctgaggagccacgtctgtctgtacacggacctgaggtgattgtggcgacaagatcatggactttgagttgatgctgcaataagacttgagggtttcaagagaggaatggtatattttgcatgtgctagggttgtgaattattgtggccagaagcaaactgtggcagatggcatttccaaagttggccatacaaatatacatcccatgctgtatgctattcttacaacgtgataatgacatttctttgttccctctgcttgaaactggatgtaacttggtaactgtcctgagctatagaatgcaatggaggtggcactgggtgacttctgaagttagcacatcaaaggtgatgtggcttctgcttggccctcactccctcttgggatgcacacctgtggaaccgaactcagttattatgttttgaggaagcccaggccacatggagaagccaggtgaacatgttctagccaacaccttcaactaggttctcagccaatagctaacaaaaccatgtgagtgaatgaacttttagatgatcaagacctcaatcttcaaggactctaaagacttcaaagatttttaggcctccatctcaggcctcaggtatcatggagcatagacatgctattctctctgtgctctgtccaagttcctgacctgcagaatctatgagtacaataactggttgttttatgccactaggttttgggatagtttattattcaactatattaaatgaaactctggtcagttaagaataatattgaatgcccaaataagtatataaccattgtttggttaccactggtataaaatagggtactttttgactgcaagtaacagaaacttaactcaagccagttttaaaaatagaagatatatcatctcacttaacagagcccagaagtcagacgagctttaagtctggtattctgagtggctcagcgatatcattgaggaactcagactctttgaattcatagagcattctcaggatagcattattttagtctaaaagcaggatgcttttgaaagttgcaagtttcctctacagtcaaaattatgtccagaagaaagagacttctgtggttctctcttaggagtaggaaatttgcttagaagcaatccccaaccccatgaggttttccctgctatctcattgtaagctgaaaattcttatttactagactatgaaatgaacatgattggctcagccagttgtctggggcagggtgaatactgggaagttgccttcatgtccattattttcttctcttatttatcttactccaatcatgaacaggaagaacagggtttagttaatgcaaggcaatataatttgcaattaaaaaaaaatagagggtttcgctttgctgctggagcccagtggcatgatcatggctcattgcagcctcaacctcctaaactcaaacgattctctcacctcggcctcctgaggaactgggactataagcataccccaccacacccagctagtttttttgattttttaagtagaggtagggtctcactaaattgctcgtctagaactcctgatcccaattgatccacccacctcagcctcccaaagtgttgggattacaggcgtgagacactatgcgtggtcaggatttgcaattctcgatcatgcttacaagtagcctacctatagtcagatctagagaataaataggagatgatattgagaaataaaaataaaattccaagcttcccaaatgactgaaaggaccccctcttggccaaggggaccctagagaaaccttaaaaactgagttcttagccatggcagggtaggaagtcagacacacctcattatatcccctccctcactaaacaccgttaggctttcttccctaagggttaaacaaaaccagtccttttgaaagactgggtcctccactgatatcaaccaactgcctgatgctgcccctcctttttgtgacttcaatacagcagccaaccagcatttcttcctgataaaagaccgttgaccatgggatggttctggacagtctttgaaggctatgcacagagggcctttttgtcctctgcttcacatttggctgtataggccctaattgtaatacatttaaatgttaagtctccaccccaaagtgaacatgaggtacatgctgtgtacatgttagcctactacacatgcccatgcctccccttcacaaatgttcacagctcctcctataatctgtgggatatgtgtagttggcaacccctatcaacatatatccttgtcttattcttcccagcctcaaggtgcctgtttttggcttctggcaggaagctacattttccagcctgtcagaatggccatcttgcaggctgcaacctttatgagaaataaaactctcctttccaaatttcggaaccttgggttgggtgtggtggctcatgcctataatcccagcactttcggaggccaaggcaggtggatcccttgagctcaggagttcgagatcagcctgggcaacacgatgagaccctaaaaaaaaaaaaaagaaaagaaaaaaaaaacaatttatgaaccttgtcattcttcagttgacaatcaatgtgcaatgtttgaagtttctttaaagatgagctttgtaaggcagatcttataaaggcaaatgtacattcccatcgctgacttagacatgagtgtttgctaccaggtgaatggtgtctgttaatggtctcacctgtgaataaatgagagaaacaagtatatagggcactgtgatattgtgattataatactatattataagaaatatatccttccaacccccattttctagcacgcagcttctacaacctctggaatctctgaagtgatatatctttttacatgctgatgagatgactaatggctggtggcccctagatagctgcagggtgggggctggtttctaggggaaccagtcatgtgattagagagttgtaactttcagccccacttcgtgactgaaggttgagttgattaccaatggctgatgatttaatcaatcaggcccgcataaggaagccttcataaaaacgcaaaaggacagggttcagagagcttccgagctgctgaacacatgcaggatgacctgctggagaaggcatggacactctgcccctgtcccccatgtcttgccctaagcatctcttctgtttggctgtttctgagttgcatccttttataatagatcataaatgtaagtaacatgttttctggaattcaatgagctattctgacaaatgattgagcccaaagggaggttatgggagtccttcaatttatagctggtgagttagaagcacaggtcacagtctggggcttgtgactggtatctgaagtgtgggtagtcttgtgggaatgagctcttaacctgtggggtctgacactgtctccacatagatagtctcaaaattaacctaagttgtagggcacagttgagttaaattttaggcagttggtgtctgtcaaagaattgatgtgtactgagggagtgtgagtaaagagaggtaaaacagttgttttttccttactcagtcataaatatatgatccacatgttaattaattttctgaggtatagcaggtaagaatccaggctttgggttcagactgatgtgagtttcctcatctgtaaagtgaagataatattttctaccttgctaggtggttgtaaaattaaacaaaatgggccaggtgcggtggcttacgcctgtaatcccagcactttgggaggccaaggcaggcagatcacgaggccaggagttcgagacctgtctggccaacatggtgaaaccccgtctctactgaaaatacaaaaaaaaaaaaaaaaaaaaaaattagctgggcatggtggcaggtgcctgtaatcccagctacttgggaggctgaggcaagagaattgtttgaatccgggagacggaggttgcagtgagccgagattgtgccactgcactccagtctaggtgacaggacgagattccatctcaaaaaaaaaaaaatattaaatgaaatgatgtatgtgaagaagtttgtgcccagtagtgttcctgatacatagaaagtattcaataaatgatttttttaacttttttttttttttaataaaaagtactcagtctgacctatgaaaaagtgttaagtactacttggaggtatccctgcatttcaagtgtttttgttgactacagttgcaatgatacaatatttgccagccaaataaaatatttcccaatggatatatactgaaagtagcaaacaaataaagtgtaaacatatgacttaacttgcatgctttacatagaagcatagttatatttagcttaagacacaactaaggtatttcattctttaaatgtatatattacagtatataatttaatctcagtaaaatagaaaaacatttttatgacatatttctaattcattgttattttattacttatacatatgatacatatttatttctaaaacaaatatatgtctttggccacctattttattttcttgggatacaggcggtacattactcatgaatggcagtgtgtgtcagttatttatctttccaaagtatctaaaagtgaatgaagcttgaattgggcaaggaagtatcataaattaaaaagtgaatctctaagaaaagctggaaaaaggtttgaataaaattaaagtacattttgccataaaatgtaactgtcaaagtggcatgaacccaaatatgaattagaattgaattgaatttgtatttttatctgcactaaagaatcattttgaaatcattgatcttggccagcttaaatctttatttttctgataacatgtcaatcaggtataaaggtggtgagagacaatttaaacctgtgcatttatttgtcaataaaacctatggtcttattggttttttctcagttgcattgttttatcatgtcaatatttcataagattatatgactgactaatgggaatagctattaccactgttgatgtactttgaaaatagcaatctatattttatggaccagaaagaaacaaaatatgtacctttgaccttattgagcataaaagtaagttaatgtaaatgaaatttatctattatttcacctattcacaattagcttcttatagcctcaggaataaacattagaatgggtaatttaccctttttgggtttgtaagaatgacttatgaatctcaaaattcttcaaaaggcaacttagagagcagaaataccttaatgcaagccggaaaaaaacagacaatgggcatttttgcataagtctttttctcattaaagtgattgatgcatattttctgtggacataaaagataaaaacacataagccaaaggaaagcaatcctgttcaatctaatatccagagacacccacggttaatatcagtgcatatccttctagtcttttttccatacataaaattccttttccaaaaatatattctatatgttatgtaataacctgatattttaccaaatgaaattctgtactttctatgttatgtatatactttgtcaagaaactaataagctgaagcagttcatttttactataccatttttctccatctaattccttgcttcttgtgtttaatcacttgagcatgtggcttatgcagctagataatttgcttttataaaataccctgtgttctctaagtgtttttttttttgcactgatttgtcggttgttatagttaagttgtagtttaaatatactttcaatataatgtaaaggtttttccctgcaatacatctccacacaaaattggaatattttaatcagatttttatttgtaaaacatggttaattgttagatttaaggccatgcccatagctattttggtgaatatgtctggggaacgtgtgtagttgccagcttccaagatggtgcccaatgattgttgcttcctggtattcacaccgttgtgtagtcccctcccacgctgaatagaactgagctgttcaccaaaaagttattgtggttgtgtgactcccaagtctagactatgaaaggcattatagctttcttctaccttcctctcttttgtaccctcatcctgggggaagccagctgctatgacatgagtacattgagtggatctatggaggggttcatgtgtcaaggaactgaggcctttgccaatagccatctgagtgaactacttggaaatgaatcctctggccccagtcaagccttcaaatgattgcagccctggctgacagcttgtctgtgcctcttgagagactgtgagccagaaccaacagctgaacggttcttgaatgcttgacgtacagaaactgtgtgagatagtaaatgtttactttttgcttcagacctttaaattttgggggagtaatttgccatgcagtaatagatagctggtataaactgaaagtagagacatgtattaagtattttctgaaataaaaatagcttaggagaatactgtattttatcaagagctcagataaggtttaactatacttactaatgcaaagtgtagaatttgaagggcaacaatatctttaacttaagacattttatgtcattgaagttttgatctaagtttttctccttagtttttatagttatgatcaacagaaaacatattcaaaggaaataaacaataatatcaacatttcaataagagtctttatgtgtatatgataaaactttttttgaaatttatgtaccttttattttatcacaatattatgagtcatacataattgctgtgatccaggaaacccatagacacaaaaccaaaagctacacatttttcttttttgtctcccatcttacgtccaatggtaacaagttagataaacagtttggtgtgtatccttctatagtcctttggtcatatagaattaggtaaacatataaatatagtaattttgccttttttacaaatgtaaaatcatgctctacatactactttgcaatatattgtttagagaaagtatgtatagtacagataggtctaatttattttaaaaaaactcctcgatagtttatagaagaggttagcaaactatgacttatgggccaaatttgtcctgttgcctatttttatatggtttatgagctaagaatggcgtttacatttttgaatgattgggggaaaattagaagaatagtatttcttgatgtgaaaattacatgaaattgaaatcacagtgtccatacaaaaagtcttattgggacacaatcatgctcattttttttacatattgtctcaactcactcgagtagttgcaacaggaatattgcaaaacctaaaatatttcctttctggctctttacagaaaacatttgccagttcccagtctacacttacactgtccaatggaaatacaatgcaaaccagaagtgtaattgtaagttttctaatggccacagtttttaaaataagaataattaattttaacattttatgttttagttaactagaacattatcatttcagcatgtacttaatataaaacattattgaaattttttacacacttattttttaccataagtctctaatatccagtatagattttacacttctagcacatcttggatagccacatttcacatgtgactagtgactactgtattgggcagtgtagttctgtactgcagatatatcacagtttttaagtatatagcttgctaatatacattcatgttgttctgagttgctattgtcattataagcattggtatccttataaatatttatttctaagaaatatagagtcccagaagaggaattgctgaataaaagacgtgcactattaattttaatagatacaagaaatttgttttgggaatgagattcaaatgtaaaagcatgctgattgtagtttgtcacaaaaagttttttgtgttctttatagaagaaataacattttcattggcactttaaaatctgtattaaataaaatccccattttttgtttgtttgtgtggtaactggcttagtctgtgccagctgctataacaaagatatcataaaactggataatgtataaacaacagaaattggtttctcatagttctggaggctgggaagtccaagatcaagggactggcagattcagagacccacttcctaggtggctgttttttccctgtaacctcacgtggcagaaggggtgagagatgtctctagaggctttttttgtaatcccattcatgagggctttgctcttatgtcctaatcacttagcaaaggccctacattttaatactatcacctaggtggctagaattttaatatatgaaatcatggggggacataaacatttagtccattgcattctgcttttgttctccccaaatcatgtctttctcacacacaagatacattcagttcatatcaatagcccccaaagtcttatctcattctatcatcaacttaaatgtttaaagtccaaagtcctatctaaatatcatctaaattaggtatgagtgagactcaaggtatgattcattctgaatcatgttgctctttggctgtgaatccgtgaaatcaaacatataatgtgcttccaaaatataatggtgggagagcaaacaacattaaaccttgagtctttttaagtaaaaaagctttttagagacagagtctcacactgtcacccaggcaggagtgaagtggtgcaatcatagctcactgtaacctcaaattcctaggctcaagtgaccctcctgccttatttgaaattgtgtaaattaatacattttgatatatcttcattacagagctacactcttcaatacagtaatcactaaccacacttgaaatgtgctattccagatgtgctataagtatcaaatctatactggatattagagacttagtatgaaaaataaaatctgagtagctaggactacagacacatgacaccacacccagataacttttaaattttttgtagagatggggtcttgctatattgtccaggctggtcttgaactcctggcctcaagttatcctcccaccttggcctcctaaggtgctgggattataggtatgagctaccacacccaaccaaaccttaagtcttgagaataattttctttggcttatccagacccactgggacagtggtcctgtcttcaggacccactgtggttgcagccccatacccatgactctgggtagccctaccccatggccttgctgggcattgtccttgttggggctccttgcaatggcttttccccacaggcagccctctgtctgggtcctgtggcataatttaaaatctaggtggaggcagccatgcctctacagctttgctgggtgcagcacatgggactcatacctggagtgattgaggagtacggttatggagtttggggtaaggaagcccatgacgtgatgtgctgaacagtagtggcccctcatttgaaattgctcggccccctgggtgtttgaattcttggcctgtgattttaagtatagccttgatgttctccaaaatgtctttggggtcattcttccattgtattggacaatagagtgtgcaatacatcttatttggacttctatttagatggctgactaatctccccattgtcctgatgaatagcacctggctccattgagatagctgatccatgctactttccttatcaaatttggtcacacccttcatgttctcttccatacaggctttctcattttttttctaacatgaataggctgtgaattgtctaaatctttaagttctgcttcccttttcattaataattattttgtaagtcatttctctcttctcacactttgcaagaagcagtcaagagaagccaactgtactttcaacactgcttaaaactttcctcagctgataagtccttcttgattctgaggtggattaggtgccgctgttgctgcttgagtgtgttgaattcagaaccatagccagacatgggactggaagatgagtgaaagatactgaccaggtccgaagatctcatggaggaggaagagcaagaggaggaattactggatcccccaacaacagaaagagagcaatgcaagcagctggagaaatgtgtaaaggccaggagtggctagagctctgtgatgagtgtatatccttccagtcacaaagaagagaatgccatggaggagctttggactttttgcatgcaagggaccactgagtgacccacaaactctttaacagcttgaaataaatgtgcagacatatttacttcagccttcatcaccttggcataaggatctttccttatggttttgaatatgccatttgcttctaatttgtgtaactgtaagtttatattaacctcgtggattttggcttcgacaagtagcttctaggtaattagcagtgattctatcttaatgaagttctgtgatctacaaaaacaaggtttcctcagccaaatatccaatttctttgctcacaaattctaccttccacaaaacactagaacatgaacacaattcaaccaagttctcttccagtttataatgagaattgcctttcttccattgcccaataacatgttcctcttcctcatttccatctgagtcttcatcagaatagcctttattgtccatatttctaccaacgttctgttcgtgaccactttggaattctgtaagaagattgaggttttctctacagcaaactttcctcctttctctctgggacttcatcagaattgcccttcgtgggacattcatggcaatgtaggtttttttttgtttttgtttttattttctttttctagcatgaaccttgaaactcttccagcctcaacgcattacccaattccaaagctgcttccacatttctaggcatttgttacagcaacatgcccacttcttgacacaaaaatctgtattaagattctccagagaaaaagaactaataagatctatgtacatataaatatttattatgaaaattggctcacacaatcatgaggctgagaagtcccatgacctgccgtctgcaagctgcaggcccaaggaagtcaatggtgtaagtcccagtttgagcctgagggtctgagaaccaggagtaccaatgcccaagggcagaagaagatggatgtcccagctctaagaaagacagcaaagttgccttttccccagctttgtgttctatttgggccctcaacagattggatgatacccacccatgttgatgagagtgatctttactcattccactgattcaaatgctaatctcttctggaaacactctcataaatacccccagaaataatatttacctgccaccattcatcccttattagttcagtcaagttgacacacaaacttaaccatcacagtaaccaacttcggtagtaaaaatagtgtatgtttttaaatgtcttacatttcccaaacagtttcaaacatattatttcccatgatcctttggcaaccttgtgtaggattgttttctgtttttttcttcttatttcacagctgaagacactgaaactcagagatgttaagtgacctccctgaagacaatacacagctaaaagaatagagccaggacacaggataagttctgcattagagtaagatgtccttcctagtgctatgttgcctgtctagttcatttgttaatctattaaaaaagtaaacatacaaaaatttctcagcatcactaatgatcagggaaatgcaaatcaaaaccacaaagtgataccaccttactcctgcaagaatggccataataaaaaaatgaaaaaataatagatgttggtgtgaatgcagtgaatagggaacacttctacactgctggtgggaatgtaaaccagtacaaccactatggaaaacagcatggaggttccctaaaatctaaaagtagaactaccatttgattcagctatcccactgctgggtatctacccagaggaaaagaagtcattatacgaaaaagatacttgcatatgcatatttatagcagcacaattcacaattgcgaaaacatggaaccaacccaagtggccatcaatcaacaagtggataaagaaactgtggtatatatatatgtatatgatggaatactactcagccataaaaaggaatgaatgaatggcatttgcaatgacctggatgagattggagactatcattctaagtgaagtaactcaggaatggaaaaccaaacatcatatgttctcactcataagtgggagctaggctatgaggatgcaaaggcataagaatgacacaatggactttggggacttagggggaaagggtgggaaaggggtgagtgataaaagactacaaattgggtgcagtgtatactgctcgggtgatgggtgcacgaaaatctcacaaatcaccaccaaagaacttactcatgtaaccaaacaccaccagttccccaataacctatggaaaaaaatctgacaaaaaataaaaaataaaatttattaattttgtcagtcaaaaaaatatcttcttggtatctgttgtgtgggaagcactatgctcattcttaaggtttcagtagtggataagaccagtgagctcctgccccagccaaatcctgagggatataaaaggtggcaaatcagtgaagcacctgtacaaaagaaacataattcaattgctttaagcatacttgagtccctatttcacatggaagaagcccttcatctcattagagggattgtgatcaagtgatgataaaaaaagacaaggacacagaatgatctcagtttgcctcctgaatgaaccacttaaagcctcaagcactttaaatcattgagacatttaactactttcagggatgcatgagaattttagacttgttacttgaccatttgctttcccaactccaagcccagtcagttaatataatggtcaaatgcaagtatagttcttgtaactatatttgttagaaagtaacataatttatccatgtgatgaaacatctgggcttggaattctaatgtacaacatcagtctttcaactggcactaggagaatcaaaggcttgaattttagtaaaaaaaaaaaaaaatacacgagacttataactattttctccataagaagaatcagggtatatgtgtgaatgtgtgtgtgtgtgtgtataatggccagtggaggtggaattatttcaattatgaaatgcccaataagaattttgtttttcgtgtacccattctcaatgctttcagttgtctggccatccctcaccctgccaatctactctctattcttctctaccctgttcctggctccaggaggttcacctttgtgggtcaatccattgcatcctattgggtttggccaatgggggtttccagcagagagtaagagggtggaaggagagtgaagtaacactccagcagtttgctgggtgagagtagagggtgttcttcacagttactttggaaatcactccttccttgtagtccttcaagtcaaagagtgagctccctgcagttgctagcattggtgtgtttcaccattctttgttgatttccctgaaccctgaccacatctttgtaaataatttcttttcaactcctctcaacattcctttgatgtagcaactgttttctgctgtcctgccaggacagcatatgataaacttcttattttgtgagaagttattgtttattattatttgtagacctttataagtacataagtggcagaccatcattttgacttttggtaaacatttttgaagacaactttggattcctatcaaagtacacttagatattcttaagttgctggagtatgcattgtatgctaactatgcatttaaaaacaactttccttggtagaagaactcatcaaaaaatatttggaaagggcaatgaccttttgtaaagacatcccatttaaatgttttatatttttaccttgactttttttcattaaacaatatgcattatttattaataaggccattcacagggacaggcagcaaattggcaaattggcctttccattaaacttttaatgctaactttataatgagtatgctgaactgctatatataaaataattctctctcccctctttacccatacagagaaaaactatagtaggtcccagtgctggtgtgtatatacaaggtctatttctttctgaatgcttttctgatctaaattaataaaattcaccccttccaatgctgctgtcatcagattcccaagtccattcattagaattatgtatgcatgtatttcaagttcatatctccccctgtggaatcctgaactttatctaaaatgtcctccgaaatatacttaagaaataaaaatctgattatgttactgatatggtttggctctgtgtccccacccaaatctcatcttgtagctcccataattcccatatgttgtgggagggacccagtgggagatgattgaatcatgggcacaggtctttcccatgctgttcctgtgataatgaatgggtctcacaagatctaaatggtttttaaaatgggagtttccatgcacaagctctctctttgcctgctgccatccatgtaagatgtgacttgctcctccttgcctctgccatgattgtgaggcctcccagctatgtggaactgtaagtccaattaacctctttcttttgtaaattgcccaatctcgggtatgtctttatcagcagtatgaaaacagactaatacagttactgtctgcttaaatgtctctttttgctccctgttgcccaccaactaattcttagggccacacaagtatgtttagaatctgttacccatctttctccccttacctcctgctttgctcccttcttcttcattcttacccaggactgctgcagccatagaaaatctcaggtcacagaaaacccaatgcgattattatcctccagatgccctcacatgctgaattcacctaacaacagaatttcaaaattcctgaagcaaaaactgacagaaatgaaaggaaacagacaagtccacaattgtagttggagattttaaacttcctcttaaagcaattgaaaaacctagcagacagcaaatcagtaaggctgcagaactgaacaacactatcaaccaactggaatcaaattgacgtttttaaaaccttccatcaaaaaccaacggaataatagccttttcaaagtatgtagagcatcttcaggacagatcatatcctgggacataaaacaaatcttagcacatttaaaatagttgaaatcattaaaaatgctctctgaatacaatgtataaaaccagaaaccaataagagaaagataacagaaaaaactccaaacacttggaaattaagcaacacacttctaaataatccatgggctgaagaggaaatctcagggaatttggaatatattttgaactaaacaaaaataaaaacaaaacataacaaaatttgtgggttgtagctaaaacagtacttaaatgaaaatttatagcattagctgcttatattagaaaagaagaaagatctcaaagaattaatcttaccttccaccttaagaaactagaaaaaaagagaaatgttaaccaaaataagcaggaatgaagaaataataaagataggagaaatcaatgaaatttaaaaaatagaaataaaattaaaaaataaaaatatcaagtgaaactgaaagtggattctttgaaatatcaataaaattgacaatcctctaagaaaactgacaaagagaaaagacacacattcttaacaccaggagtaaaagagagaacatcactacagacattaaaaggataataaaggaatactacaaacaactcaaagcataccaattcagcaaaataatttaccttttccccaaaaactataaactgccaaagctcacccagtacaaagtgggtaatttcaatagtcttctactattaaagatattgaattcatagctaaaaactttctgaaaaagaactcttcagacccaaataatttcactggatgagtccactaaacatttagaggagaaataatcctaattatgcccaatcttgagaagcggagaaaatacctcccaacatgttttatgacaccagaataccccaatattaaaaccaaagacagtacaaaaatagaaaactataggaaaatatctgtcatgaacatagatacacaaatcctcagaaaatattagctaatcatatccagcagtttataaaaattaatacaccatgaccaagtgggatttattctggtactgcaaggctggttcaatagttaaaagtcaatcaatgtaatccactagattaatagcctaaataagaaaatccacatgaatatatcaattgatgcagaaaaatgattccacaaatttcaaaaccattaataataaaatctcccagcaaactagaaatgtaagaaaatttcttcaatctgataaaatctattttttaaaaaacctacagctaacaacctacttaagaggctgtcttatagagaaatgttctccctttaagacaggggacaaagcaaagatgtacactttcctcactcttattcaacatcacactgcaaaccaagctaggaaaatccagtacaaccaagctagaagaagaaataacaggcactcatattggaaaagaagaaataagaccgtcacctattcacagatgatataattattaatgtagaaaatcccaaggaatatttaagatattctcagaaatgagtgagtctatcaaagacaggatccataatcaacacaaaaattgatagtatttctagacaatatcattgaaaaataggaaaccaaaatttaaaaaattactgtttatgatagctgctgcaaaatggaatacttggttacaaatctgacaaaacatccttaaaagctatttgctgaaaattataaaacactgatgaaagaaataaaaaatgaactaaataaatggagctacatctggtgttcatgaattggaagatctatacatagtgaagatatcaattatttcctaattgatctatagatttaataaaatttcatttgaaattcaagaatatttttttgtaagaatagaatgtctggttctaaaatttttatgaaaagacaagagatttacaatggtcaaaatcaattttgaaaaaagaataaatccagaagaatcaatctactcaatttttggacttactgtatagctgcaatagtcaagactgtgtgttattgtcaagggatcacacgtagatgactggaatatagtccagaaatagacccacatgagtataccaactgagttttttaaaaagatgaagcaattctttggagaaagcatagtcttttcaacaaatagtcttggaacaatggaaaaaccatatgcaagaaaataaaccttgacctaatctcataccttatataaacattaactcaaaatggatctttcatctaagcataaaattataaatcttttagaagaaaacatggaggaaaactttgtgatctgtggttaagtgaagaattcttagacatgccatcaaaatataatcaatccctaaaagaaaataattatatgttggacatcatcaaaattaaaatcttatgctctgcaaaacacattgttaagaaaatgaaaatcaagctgcagcctgggataaaagtatttaaaaattacatttccaacaaaggacttatagcctgaatttataaaaaaccctcaaaactcaatagtgagaaatttgaaaatgggcaaaatttggacaatttaccaatgaggatacacagaaggcagatgagcacatgaaaagatgctcaatatcattatccattaaggaaatgcaaattaaacccaagatcagatgccactatacattttttggaaaggctataattaaataccctgattataccaagcactggtgagaatgtggagcaactggaattttcaaacattactgatgggaatgccaaattacatagccattctggaaaatagttcagtggtttccagtaaagttaaatacacacttatataacctagctattccctagtaggtatttaccttagaggaataaaaacaagttcacacaagaaactacacatgaattattatcctcagaatgaaagtacgttttgtcatgaaaggtaatttgtttcttattcttgcagatattcaattacagaattaaaaatcttgtgcaatagcttgtacaagtaatttgtcttagtctgtttgtgttgctataaaggaatacctgagactgagtaatttataaagaaaagaggtttatttggctcaccattctgcagactgtgcaagaagcatggtgccagcatcttgtgaaggcctcaggctgcttccactcatggcagaaggtgaaggggagctggtgtgtgcacagatcatatggccagagaggaatcaagagacagagaagggataggtactaacctcttcttaacaaccagctttcatgggacctactagagcaagaactcactcactaccttgagggcagcaccaagccattcatgagggattcatttccctgacccaaacacctcctactaagccccacctccaacactggggatcaaatttcaacttgaggattgggggaacaaatatccaaatgatagcatgattcctgcagaaagcgtgatggtttggaatggatttctgagattatgccatctgagatttggtgaaataccaggagccagagggatgtgaatgcatctattatggaaggcgaggaataatgctggttggctaagttgtgcagcacattgcgtcgctcacaaagaacaagttccatcaaaattattctaaagacaccaattttggagcttgatctatcaggctagttagaagttctgaaaattgtttctcagcagaaggtcaaatgtggtgaaaagagtgactcccagtttatttatttttaaaatctttcttatagctatttccaataggtgtttagtttacaaaccatttatgttgattttgatgtaaagctgttagtctctttatataccagacaattccttaagcttctctggtctgttaggggacaaagcagagctagtaaccctgaagcccttttctagtttgctaatgtaaagacgcaaacctgcttctacagttagtagtggcttagaacagtccctaatcatgtgtttgagcctgtggttcttagttgatggcctagaccagcagcatcagcttcagctgggcgctcattaaagatgcaaattatcaggacccaccccagacctactgaagcagaaacttggcagggggtagcaggtggggcaggcagaaagccatgttttaataagctttccagatgattctgatgcaagctaaggtttggctgatgcatgctaagatttgacaagtatcgtacagttaactttgcttctgatttatttcaagcggggctctggacaagctgccagaggtgatttttaggccatggggaatttgcattatgttgtcccaagctgtcttatcatacaagttccacttggaccactattggcttaattcaacattaggcatcagagaaatcaaaattccatcataggtctgtccatttcctacttacaagttatcttggtttgtggccccaagttacaacccctgatcagaaagcagaaacccaaacatacactactcttcagctcttatgtgattagctcattattagtccatttaagaaggcatactctctaaattacgtgtccagctctttctttcaaaacttaatcattaccctctcaccactcctttttttcttttttaaatttccaattggtagttattgtctcgtggtgcttgccagactgagtttaaaacttcactgtctgttttaatatctcagttggttgccataatatgactgtagaggtttttcgaaccaaaagtatgtctgccaagtaaagctttctgtctgaaacttgaatgtgacatgtttcctcatcatttaaagcactgttataattaaggattggtgaaccctttttcagtttcagttagttgaatgtctaatgtttattcaaacatcctggtttcaataaaagctctaaatgtgagttgccagcactttttccattaacttttaaatccctgtgtgtttcaagggaaatacagttcgtatgtttctgattcatttacacttaactcatcagaatattattttgctagagctagttcttatccaagtatcacgtaccccttgaaatctttagagatatgatgttagttaaaatactgcaaaataaagaccaagctgaagcttggaggagttgaaccatagttggctttgtttctgaatttggccccaaataccatatgtttaaatttgaaatagattagcaggattcattccattattctagaaaaaaaatagctatttactttgtactctggatgtaatcgcatgcagaatattattagaggtaactgtaagattacatgagtgacaataaactacatgtaataccattgttttagcttcagtgatgaggatgcctcattttgtaaaacgtgcatatgaagagaagccatgtgcccatttaacaatggagcctgggaaatatggagggaaaacaattggctagctgccatccccttaaaggctacaaataacaaatatccaggaacacagaatcgtgtgaataaatgttcaattttttgagtagggctatactaaaaaatgtgacattctgggttatcagattaacagaaatatatatatctatatgtagatatatagatatacacacaaataaatgttttaaaatatgtattgtttacatgtttctattagcatccagccaggaaaacagatccactttatttcaacagagagaatttaatggaactggttaaacaggtatgagaagtctcaaaaagcaaaaggagaaaactgaggtaatgaaaaactaatgactacaggaagcagctatcatgcctaagacttgaagaaaaaggggaagaagttggggttatcacaccaggaatctgggaagagactccttggtgctggagctcagacttctgaggatggtgtcggggtgttcagctggtggaagtacttttgggttctgctccatgaggctggttctgggaatgctgaacaaagctggatgctagaaatgattctttgctactgccagcataaagagctctattattatgagttacaatcccaactggatttctgttgatttacatgtatttgtcatccttcaagttgagatgctataaggctatgttttcctcctttctttgcctcagtctctaagaacatcatcctcaaccacaaaacagaaccaatagtctttgcactacccatctttatggtgtcttgggaaaataaagaaatgttaaaacacttggtaaatgataaaacagtgatacattttagtatttctttacttcaaaatacaatattcaaataagataaatgtaagaaaaaattgcttataatgccgtcatctcatcatgtaaatgggttgtttttcttttttttgcataatcattcagttttatttgctttctgcttttattgtcattttaaacatgaagctctagaatttttgactttgagtacataagtgaattgtttctcaatctctctaaaataagtctaaaatttttaaacataagtttgttttttatagaaacatatatagaggaaggaagcaattttaagtaaaatcatattattaaaaaatagtgttaaggatgttttacagctgcagatcacagcactagaaggaaagcatagctgtgtttataaaattctaaacagaaatataattccatgttccttgatcctttttcctaattatgctgcttttatgcaggttagagtaaaaatatttataaaataagatacagttctggcacctgttgcagaaatatgtttatccttaaaattttaaaatattactctattgaaattgaacacttgatttgcgataccatgaaaaaaaatcatcaaacaattggatttcaagtcaccatatcaagtatatggctttgagcattgacagtccctaaaagtatgaataggtggcattttctgaataacaaaatgccatttcaatgccccttgcatttttgaattttcatttagtaaaccaatgtacaagttgagtgaaatgcctactaccaatggatcttttttaagcactcttctaatcaaaagtgacagtgggtaccttcttctatatgtcctaaacaagtatggtttttataatttttcttttactttttccatcaaaacatatagtattggcatgttattttctgcagaccccaaggtgctttattatctaaccctctctgtcaccatcactaaaagtgggtggcaatggactattttccccttgagatattgtcggaatagactgcctttatgtgtattattttcttagtcaatgagctttggaagacaaaaagctatcagtctgctactcagtgacttgcttcaacacaaaaatacccttaggggaaccacagtgactggtagagtagaaggtattgcttcatgtttagacttttccagtgaaaatgaattggaaagttagagctgttgtaatatgggggcgttccagggggagtgccacaatcaattggaaaagggaaatgtgaatttgaaatagctatttggtcttcccactccactagcagaaaatgttaaaattgtgtctggtctgaagcattcacagtcacaactgaatttcagtagaagtgtctcatgcgatgcgtaaatgtatgcagtcgtcattccattggccctttaatgaatctgaaggaattgcagagccaacacattgtccctagaagttatatatattatacacatatatattttttctcccaaggaaatgatcccaaggtgaggggcgttattctgtcaatataagagcccttgggatgtcaatgaagtgtttttttaatcctcaccccagccccgcccaagttttttaaatgactttacaaagtcaagagcggtctctaatatggttgcactgacagtatataaggtttgaaaaagctgtcacagcatcaatcaaatgtcagctctacagaaactttacaatgtcagtgaaattttccctattaatgctcaggattttctgtttgggggaaccctgcaagtcacagagcattctctatagctccagctcactgcaacggataccactgaggaatgtttttgtggttgggtcaatttcccattgtacctattaaaagtgaggtcataaatttaaaaaaaaaattattgaaatgtggccttcacctggggaacatgaaagagatgaaagaatacaagtgggattttaataaaccgaaagtaatcttgtaatcagggaaaactacatttaactacacctaaactatattaaatatattctatatttttgcgatttttaaaaaactctcaacattctttttactatggtaaaatatcataatataaagcataccgttttaatcgtacagttctgtggcattcaatgcattcacactgttgtgcagccatcaccaacgttcctctccagagctttttcatcgtctcaaactgaaacgctgtacccactgaactcattgaacaataactcccctttcccccaaaactccccgttccagaatacttattctactttttgaatttgactactctaggtacctcatataagtggaatcagacaatatttgtcctttcgtgtctgacttatttcacttagcataatgtcttgaagtttcatttatcctgctattttttttcaggatgtttgttctcagtattaaatgctggagcttctgtaataccaaaatactccttgaaactgacttttttttttccagcacagtgttaggggctatttaaagcaacatttaattacatttaaatcagaaaaatgtattaatcctcataaacaaatcactgtcccatatcttcaagtattataataatagcaatactatatagggatttctatgtgctagacataattctatgtactttgcatgtgttagtttacttaattctcagaatattcttacaaaagtggtctattatcttcctcatcttataaagagtaaactgaggcagaggacaggtcacttgcctatgaccatacaacaagtaagtggcatagccaagtcataaggccaggctgtctggtcccagaggctgtgctcttaagcactgtattacattgcctctcatgtacccctcccactaacaagagactatacttgaattgatctggggttgggtctgagcgctcatcagctgttaaatctcctccagtgattccagttgtacagtcaaattaagattgcctgggctagagcataggaaaataataaaagatgactctgggtacttgagcgaatggccttgaacatcagtctccttaaagaagtttgactttgatttagttagcaatggaggaaaccatgaaagtttagggtagttatataagctgaacttgttttaagaaagttaacctggtaaagattttagtagtcacttatggtggaatcttatggtaggccatgctacttttgttgactttggctttacctttgatcctatggagaggggcatccccagggacaacttaaatataggctggagagaaaaatgcattggggaggcaatatctaaagggtaggggttcatgacatgaaacagaataatgttttaggacagcaaaggaaaatatgagaggtatggaccaatcagatcacttgataacatttcatgtttttttttttaatttgcttatttgtatgtttagtggtcagatagttctggtggatatcatacacctatattggcttacatatattagctttcttttctctcaaaatgctataataggtacctatatctgcaacctcggtcaggtcacctatttgggcctcattttcctcatttgtaaagtatggtttcaagggtccctaggggcctttgggtattgacatcacgactctgggggttggggtttatttctctggattatgaaatccctcagcccaatgcaaagttccagggtagcctaaggcctgaggaaggaagctctttcaggagataatgttatcacattagaactgggccataatggaagatggaatcctcattcctcttcttgttgagacagtcactggtgatccatcttttgcctctgtcaccctaatttaggtcattcctattgtgagccttctcaaacagtacctgtctgggtataaaatttatgttgaagaagcattaatgcaagctcttaataagatgaagaatttaacagcatggtgttatctgaggatgatatattttatatactcaaggcatgtttaattaggtttgcagaagtcaaattggcttgggcagtaatgaagctttctttctacccctttctttcagattctgctgtaataacatacaagccattcttaacaatctccttttagttttggtatgttggcaaatcagtctctctctttctttgttcttgcaaaactgatttgttttgaaaatccagtttctgcttagggtggagggcagaagagagagcttattgagaaatacacaatggaacaaataatagggctaataggtgttagagctcctcaaatattgaacatgcatccttttgaaatagagttgctaaatatttaataagcatttacatctaagcagcactcaagggtttcataacctttgatccttgctcccattttgcagatgaggacactgactgcagagttcaagcaatttgctcaaagctttatgtgttggagccaagactcaaaacgaaccctctgccctgaatccctgcctccttccaaacagaaagacccaagtttaatttactaagtccattcccctacttaatgaataaaagaaaagatgaaatcgactaaccaggtggtatctttgaacttcaatggtcggatgagggtttgtttctggtgcacccacccattcagagctgaagaggaaatacaatgaacataataatgaatttgaattttgatcccaaatcactgaagtattttcatacttgtggtctcagttattttttcaacatgactgtgcagtcgagtattttgagcccagtgtatatttgaaagtctctcttatccagggtcagtcacacacacagtcagtgttcaggcaaggtcaggaaactgctgctccaagtctccaactgggataaccatgaagttttatcaaaattttcaataactcataattgatagagacaagaccaaagaataaatgagaaaagtgaagatcttatcaaaagtgacgaataatggaaggatgtaggtcgttatctgttgtaaatgtattttaaaaaaagaagggggcaatttagaaatcgtttgaagaatgaaaaccttagcaagaacagttacttcctgtgataaagacaggtcttttggttgaaattttgatgtctaaacttctggaaaatgtctgattttttttcttttggaagaattatggaaagtgaaagaaggggaaatattcttacaaagcatccttctactttaagaaacagaaattctaagttgttgctaataagaaagattaattgtatcaactgtagtccatggcttcattcactaatttgctacttaatgtttgcagtattttgagagagttcaatagagtttaacagaggggtcagaatttctttacaagttagatatttaacacacctaaacttattttcttgcctatttttgctgagtcaatatctactagtcttggattcttaaccctttcgaaagcagggtaaaaagatatagtcatgggcttctttgtcagcagctaaagaaggatgttaacaaatatactttacaaataccttaatatgtattttaaaggacttttactttttcctaaacatttttatttattccacaatctctgagcattgcttgatgcaaatatatgaccataaagattttatctagattcagggagagtaattgtcaaatcacctgccactctggctacgaggaacgatggtgaagaaggatttaaaagttacacctgagctgacgaggcaagcgtagcatgattccataccttagagccctcaggcaagggggagtgtggtagcacatgaatcaaaatatacgctgaggagaaggtaaatggcaatagtatgactgtgcttatcattcacatgagtgatatggatatagtaatttgcaagagtttaggagagaaaggtccctagtggaatgaaatgcttagaaggagcttgaaaaataagtagttttggtggcaggagaggtagagacctttaggtgaagagagtgacaatacaattgccagattaagaatgtctaggggtaatcgtttaacaaaaatggctgaagcagaatttattttgcaaaagcctagacataatttgaaaatgtagctaatgattttagctaccaatgagtaaggatttactctacgcctagcatttgctgaacgcattatgaaccctgcctcctttaattctcataacgatcttgcaaggaaatgccatttattgacccaattttacagatgaatattataaatctcagagaggcaaaatcacttgcttcagtcacatcactgatcagtggaagagtcagatttgaagtcagatctgtctgactccagagcccccactcttgtaccctcacagtttttgtgtcttgggtaagataaaatcagtgtgtattttatagaactttcagtttaaatgttaggttgagctttggatgtttttaataataacttcattcagcatatttagcatatcagataatttacccttttgacgtgtacagttccaaatttttaaagtaaatttaccaagttgtgcaaccatcactacaaactagttttagaacatttttatcatcctggcatgattcctcatgtgcatttgctgttaatccctctcccttgtccctgctcccacctccagcaaccactaatctattttctgtatttatatctttgccttttctgggaattttatataaacggaatcatacaatatatggtattttgtgttagacttctttcactgagcataatgtttttgaggttcatcagtgctctaacatgtgtctatagttcattcctttttattgttgaatagtattctgttgtatggttataccacattttgagtattcattcaccagttgatgaacatttaggatgtttccaagttttagctattatggataatactgctaagaacattcatgttcaagtctttgggtggacactttttttttttaatgcaaacaagaaaagtagtaccttaagtagggaaatacatggcttttagtaaaagcatgggaaatttcctgcttacatagagaaatttagacacatcaagagaagccaagagtatagaatcaagaaaaacattgcttgtaactgtaaatccacagtttaggagatggttgaaaagtttatttttaaaaaaacagactttagagttaaatcaaaacctcttgcaaattttactgagtagattaatactttaggaaaaccttgctattctaatataggggaccaaatttatacttttgtattagtgtatttttaatatcaaagctcaatatttagaaagacaaaaataatttccttttaattgtaggcaacttgtaaaaatttcctctatatatttgtcctttccaaaccttttgtgacttactcagacttttcatgacatgtttatattttctgtttttttcctatactttttaaaaaattgaccagtcattttacattaggacaaaaatttatcatatattattattgtttacttaaaatgattttctttctacaaccttttttgatacccaaaatatattttcatacatgtaaggtttttatcttttccttttacttagtgatttttttttgttatactttaacttttagggtacatgtgcacaatgtgcaggtttgttacatatgtatacatgtgccatgttggtgtgatgcatccattaactggtcatttaacattaggtatatctcctaatgctatccctcccccatccccccaccccacaagaggccccagtgtgtgatgttccccttcctgtgtgtggacacctgttttcatctctcttcagtatattcctaagagcaggattgctggagttatgtgctaactatatttagcattttgagaaacttctaaactattttccaaaatgattgtaccattcatacattgatatcagcagtgtacgagagtaccaatttctctaatctttgctagtatttattattgtctgacttttttttttcagatggagtctcgctctgtcacccaggctggagtgtagtggtgagttttcggctcatgcaaccacctcttgggttcaagcgattctcctccctcagcctcccaagtagctgggactacaagcatgcaccaccacacccagataatttttgtatttttagtggaggcggggtttcaccatgttggccaggatggtctcaaactcttgaccttgtgatcttcctgcctcggcctcccaaagtgctggaattacagtgtgagccaccgtgcctggccctgactttttaaattatagccattctagtgagtgtgaaactgtctccttgtggtttctatttgcatttttctaataactaacgatgttaaagagctttacaagtgcttcttagccatctgtatgtcttattttttgattagattgtcttattgaggtgtaagatttctttgtaatttctggatataaattctttgttagacacatattttgcaaatattttatcccaatttattgcttttatttttgttttcttaatgaagtctactgaagtacaaacattttgaattttgatgtgatccaatttattaattttttttgttttatgaatcatgcttttcatgttatatcaaaaaaaaaaaccttgcctaatacaaggtcttgaagattttctgttttcttctataagttgtattgttttagctcctacatttaagtctataatcatattgagataatatttgcatgtgttgtgaggtaaggatttccttccttcccttcctccctccctccctccctcccttccttctttctttgcagttttttgcaggcaatagcttattgtaccagtacaatttgttaaaactcgaattgtttcttcagtgaatttctgaggtgggtttgttgaatatcaattgacaatcgaccattcatagaaggatatatttttggactcaactctcttcctttgatccatatgtctgtccttatgccagtattatgttgtcttgatgactgtagcttggtagtaaattttgatatgagtaagtgaaagtcctctaacttggttcgtttctcaaactcctttatcatctgggtctttccctttccatatagatttaatgatcagcttgtcaatttctgaaaccgcaacaaggaaaagcctgatgaaaatttgaaaagtactgcattgaatccatagataaattggagcataattaccatcttaattctgactcttccaatccatagatatagaatatctctccattagtttagatcttctcagcaatgttttataattttcagtatagaagtctataattttaaattttattcctaaatatcttattctttttgatgctattgtgaaacatattctcaattttatttttggattttgtattcatatgtagaaatacaatttagttttgtatgttgatcttgtatcctgtgaccttgctgtacttctcagttctaagctttggctttgtttgtggatttctacacatggtatcatgttatcttcaaataaagacaattttatctccttttttccagcctagatgtctttcttttgtatgcctttcatttcttcttcctatctaattgcactggcttaaacttccagtacattgttgaaaagaggtggtgagagagcattcttatcctgttcccaatcttaggggacttccttcagtcttttatgaggaagtatgatgttcactgcagattttacgtagatgcgctttatcacattaaggaaattcctgcctattccaagcttgttgagagcttctatcatgtatggatgttagaattttttgaatgcgttttcagtatctattgagatgatcatgtggtttttgttctttctctgttactatggtgttttatattaattgagttttagctcttaaactatcttaccattcctagcataaattccacttggttgtgttaattctttttatatgttgaatttggtttgctaacattttgttgaggatttttgtatctatattcatgagggatattggtctgtggtttttgcttttttgatgatgtatttgtttgactttagtatcagccttcttagaatgccctcataaaatgatttcagaagtttttcttcctcttttattttcaggggaatttgtagagtattgatattattgctcctttaagtggtttatagaattcaccagtgaaccatcttgacccaggctcttctttctggcaattaaattattttctttatttgttattcaaattttctattttttcttgagtcagtttgagtaattcatttttttaagaatttatgtcatctaagttatccaatttgttgacataatgttgttcttagtactttataattattttaatttctaaagattcagtggtaattctgctctttcatctttaatttttgtgatatgtgtcatccttcttttcttcctggctgaattttgctttttcaattttgtcagtgattccaaaaaacaatgttttggtttcattgattttatttatttatttttctgttttctaattcaatggtttttcactctaatctttattgtttcctttcttttgactgccttgggcttaatttcttcttctttttcaaggatcttaagatgtaagattagtaaattgctttgagatctttcgtctttttaaatataggcatttaaaactataaatttctctccaagcgttggtttaggtgaaacccacaaattttggtatatgtattttcattttcattctgctcaaaatactttcttatttcccttgtgatttcttctttaacccttgggttattaagaaatatgttgtttaatttccaaatgtttgtggactttacaatttttttttctgttaccgatttccagtttaattccatttgattgaagaacatactttatatgatttcaattattttaaatgtgttatgatttgtagtatagcctagtttatctgtcctggagaatgttccatgtgcacttgaagtaaatatgtattctgctgtttttgggtggaatgctctctagatgtatgatagatcaagttggttggtaatagtgtccaagtcttctatatccttgctgattttatgtctaattgttctatcagtttctgagagtgtaatatgaagtgaccaactattatttttgaattgtctctttctccttttatttctgtcagggtttgtttaatgtattttgagggtctgttgttagatgcacatatgtttataactgttatatattttcctgttgaattgattagtttatcattataaaatgttcttcctctttgtctctagaaatattttttaatcttaaagtctattttgtctaacattggtatagttacccaacttgttttttgtttactgtttgcatggtgttcctatttctatttttttacttttaatcttattttatctttgaatctaaagggtatcttttataggaagtatataatcgaatccttttttttcattatctagtctgacaacctctatcttttgattggatgcttaatctattcacattcaacgcaatgattgatatagtatgatttatttttattttgctatttgttttccatatatcttatgtcttttttgtgttctttgtgccaccactactgccctcttttgtgttaaatatatattttaagtgtaccatttacatttctttattttctgacatataaatcagaactatatatatattatctatccatctatatagaatatatatatatagagagagagagagagagagagttatctttggttgctctgggtattacaatatgcatcttaattttaaacaatctagtttagattaatattagcttactttcattagtatatagaaatattcttccagtatagttcccttccccctctcctcattcatgttattattgtcatataaattacatgaaatacttactttgtaggattttaaaatgccaggttggggttttaacttactctcataggcagtgaggagacattttaaagaccttgggcaaaagaaagagagtcataacaaaaagcacattttaggaatattagccaggcagtggcatgaacactgtgttggagctgacgatgcggggagggattggaaattagtaaaaagaagaaagagcagtgacttagtaaaacaacggcctcttaattttactgaagttcccaaattgaagttacagttattctggagaaagttagaaaaaaattgcctcaagcatttgcactagctaccaaacactaggtttacttgtgaatggattcaatggttcaaagcacagatatgaaagttcccaaggtaattgccttgtatagtttagccatgtgccccataaacccatgaaccctatttttaagggcaaatttcttgtggtaactggcaaagtaatccctttaacttatccataagagttgattaattggagacactggtccattggccttgcagtgattgtgctgatggatttaggttcataaaaagcctagtttttattattaccaattcatctgtttgtcatttgagggggaaacaagtagaaagaatctgagattctgatgcaggcagatgaaagctcatattttagttctgcctctaactagctgtgtcatttggagacacttgcctaatttttctgaaccacagtttcctcatctactcatggtaataatacttatctctctatgacaaaatatgtatagaacccctagcacaatgacaggcattgtttaattaataatggctatcatccaaagagggcctatcagagaacaatataaaatttcaaaaaaagatctgttttctctctttctgtaacttcaagggatttattgaggtgaatagtacttattgcatgaattctgtaaaccttgtgcctgcactttttctggttagatcatttgaagaccagcaaaattttaccaggtagctcctgacctcccacctgtgcaacaaataaggcttccaaatcaaggtagtatgcatagtgttctgtccgtgagctccatagccagaccatctgggctcactcactctgtgagcttggacaagttttttaacctctctgtggctatacttcctcatctataaaatccagaggataataatagaacctaccacaaagaattaagtgagttatcacatatgaagttcttggaagagtgcttggcacaaagcaaactccgtgtacattttaatgttattgttcttgctgttgttatttgagtttcacataaaatttcctccggaaaagactttggggctttaaaaaagaaaacttacaaactgcttctttgcattattgaatttggcggcataatattttgaagaaacagtgcattagtatctgcagtttcaagatatgtttcaagatatgtacagatagatttttaagacatatataagatatgttttcaagagatgttctactaaatggtcaagttaactggagagccccaagaaaatgaattctctggacatgtggagtaagggtttgagaatttactatgaacaatccaccacatgtccagaaaaacaaatctcttaattaggatgtaatttgtgtcaattatataatcattttctagatgatatggaaagaacaagacttgatgcagacttatcagataacacaggctaatatagtgttgtggtctgaatgtctgtgtcctccccagattcatgttgaaaacctaatctgttggtattagagatgaggccttttggaggtgcttagatcatgagggcagagccccatgagtgaaatttgtatccttatagaagaggccccagagagttttcttggttcttccacaatacaaagacacagagagaaggcacatctatgaaccagatgagcagcgcaccccagaaccgaatatgctgatgctttgatcttggacatttcagcctccagaaccataagaagcaaatttctgttgtttacaagctacccattttatggtattttgtcatagtactcccaatgacctaagacatagaggaagttgttgtccagaaatgctacgaaaagctcattcctgaacactctgtcatggcttttctaccaaggatcagaagtttctcttaagtaaaggatatggaagatgcttctctgtctactcttttaaagttcttgctcatcaaatttaccattcttataggacgtggtgtcatggatatgtctccaaaattcaatgcatcatattcccaaagctattgccatcggaaaatgtgccatccagctctctggatattttatccaggaggtaccatgaagtggaaagactgggagttgtgatggttccagattttgcactaattaattatgggaaatttagacaggacatttaattcctctgagcctcactttcctcatctgtaagatatgtagactgaattaaaggagctccaattttccttatagctaataatggcttctttatgaagcttctagaaatttcgggggcaataattttgatggagccattgttttgtgttcagttggttaagatcatgggcctcagagtcagccaaacctggggttgaattccagctctgcagtatgatattaggcaggtcacttaacctctctgaaaccattttaaagcatatgtgaaaaaatgtcctggttattagagttttacagtgaaaatgtatgtactggatttctaaaaggatgaggctttgtggtaagtattgctatgatggtggcttgccttctctaggttgaagaattgcttccaatagctagaagaatagcagttacccctgggcaattttgctttctcatatcctatgttaaatgtagatctctagaagaggtgttcttgaagatagtatgacttcttccaaaaagaacaagataacacaatagtttataaaccatttacagcacccgtatcctccatggcattctttaataattattgccctcctagaagccactgaccttcaggctgcccaagagtgtctggctgctcccgtagaggtagagggtgatttaaagaagagcagaattaaatttaaattcctgtttataaccccacaggcctatttggttttgaataccaatgctgagtccataccttccaactgaaaattgcctgtgacaattttcttttagaatattaacattgaatactcacccaggacaaaaatttagtgaatttgaatcattgatgtccatggtttgtacaataagtgtcaacagattttcctttccttgccctccaaggaaagagaatattggagataggtggggctagacattattatattttataggcattattctctttagttcaccttattttctatatcaatgctgtccaatagaaatataaggtaagcctcaaatgtaagctacacaagtaatctaaaattttatagtagttacaataaaatgctttaaaaagtgtaaaattaattttaatactacattttatttaactcatatatccaaaatattattctttcctcatataatcagtataactttttttaacttagtctttaaaatccaatgtgtactgtacacgttatattttaagttctcatagtcacatgtggctagtgactatcgtattggagagtgaagttctatatccttgcatattaaactatagttggctaataaaaataagtagattggtagaaacacaaatggcttgttattttctacctagtaatgggtacagaatatatagtgagtgatttttgcatttaaatagtgagcagaattctaacatcttctaatagatgatcttcttgtgaaataatacacgtacatgaaaataaagatcatgcttcagatgcagcatttctctaaacgtaacataatatatattttcacagcctttggacacattgtattttgagcaatacagatctagtgatttttatcactagaagggaaggtggtgactgaggctgagctgagaaaaatatggccagagtactcctttcagctacctcctaagaagtcctgattttcttctactgggagatctttatctcctggaaatctggtcaactagatgcatcagctttcttgctagcacaaagagcgttaggggaacaaacaggcatcacagaccctgatgaacgtcagcaccaattgcattatgacaccctagctgctaaatctttcatggtaatgggccacgctggagatgactacagcgataggcttcatagtagaagaagcctgtggtcatcgcaggtggtgccgatgctgtccttatcactgaatttgaaggattgcttgaacagcttgtaatgagagtggctaaagtattgattttggactacatctgaatatggaaaaggcgacggttttgaatcttggagagctgacctcacagggaaaaatagcatcttcacagaagcagtttttagggagtgaaaagtaaagcattgtttccatggccaaagacgtctccgtgaaagactcgcatattctgaattaaggacaaagagtggttctcctccagttttcctattccatctttgagtatcttgtttggagcattagatagctgggttcacaagtcaagggcacaggttcaatcatcacgcaggctagtgaccttcagtatttcctggccacagatacctgccttcttctagctgttgtcttgaatgactgtgtagttggttccaagggaattaagggaggaaggggtgacagatgaaagccatctatgacctctattggcaaaacaactcataacctatagagcacaggtcagtagtggcgccttttaaggaaaatcagcacatggagcttatgccaccaggaagagtcatgtgcttataaactggatcatggtaaattttcattgaaagtatgcattggtactaatgctaagaatggatgcaaagccagtcaacgaagcagcagaaaaggttagctctttgaaatatgcgactatcagaaaagcctaaaagaacacaaacgattgagatcaatgagcacagataagaatgctgttaggcatagaattggtagccaacatcagcactaatgtttccatatcaatacttatttatggccccacttgtcaacattaggcgtacgtggagtggagtgttctcaatagatagcatcttttctgcttgtccatcaatttattagcatataccttgcttattatgtttctcatcattgtaatttcttgtactattctaaagggggttattggttactttttgctaagaaacaatgtgttacatttggaacccacaccaatatgtttgctgacacctcattcaaattctcctgctgttttctgtgtttgttagtttccacccaattcaatagctgtgtgttgaattgcactgactatgctaaagctgctctcctaatagaaacaaggggaagacatcatggcccctgtccagaaggagttctgtatctagctggggagaaagaatcacaaaacaactaaaatataaaaagaaagtttctatcatggaaagtggttttgcacacatgtgtttaatgtcacagatctgggagaaaaaaagatattttggataaactttggttttgcttatattgctacctatgaataatctttcaaagcaaaagtgcttctcagttttaagatggaaaatatcatttgaaaaagcttaaaataaacataagtatcaaatacactatgaagtcattgagtgaaggctattcagccacagctttcaggatatcaaaaaagcatatgacgttttatgcaaggagaatttgtggcttacacttcaaaactttatggatctaggaaaatgtttgtatttcttatttggtatgatttagggtgatatttccttaacatctccttttcatattgtgcaattcacactagagacatgtctatgaaatatttacacatgatttttatttgaaaggaagtagctggttgctgcatgaaagcttcatggcgaaggttccttgctttcaaaagaaaattgaagctaaataaaaagatttcagggagagtttagagaggtcttttcttttttctttttttttttttccttctcaagaggtaattgatttgctccccagaacagtctttctagaactctaggtagacaatgctctaaccttgtcagaagaggataataaatttagagttagactggtttggaaggaaggacttagaatgaactacattttataggaacagagcaccgagggtctgttgttagtttataggcccttgattagatagcttattgattttggctgctggtgatagggttcatgttcagaaggtatcaaactcatgctgaataaaatagaagcaaacgctttagaaaaaataccccagaaaggagggggacactggctagcagtctagttgtagttcatcaaatggaatgggcagctgtgccttattgcctttagccctctggaagcagttatgtgtattaaatactggaataacttgatattttaaaagctcatatgctcatccaagtaaaatggttttagaagactaccgggagttttatgattttatagttaaatcaatacccagatttatgccttttggacagagaaacttgaatttcattgagaaaatggatctaatgaggatagacatattttgtgcagatgtaggaaaggtttttttttcacttattatctgaaaaatgaaacaggtacttttgtcatgaagatgaatatagctttacaggaaaaatgacaaatgttcaaaaattttaaaagaagatttgtgatataatatagaggttcctgaatgtctggaatctggcggaataatttttttgtctcttttaaattcttgaatttaaaattcattaattatacagaaaatcacataatatttttactttataccgcacaattaatggccatatggtattaaattggcaaccagactttcaagaataacaattttaaacagaatcacttgcagtctagattttccttttttttttttttttttttttgtattttatgatgctttgaatagaaattcgtattttattcactggctaaacagaggtgaaaaatttttaaaaggaaattgtgaaggacattgttaattttttaagagctagatatgaataaagattctctagatattattttctgtattctcagaagtcttggcattttccaaatagaagggaaaatcaaataagaaaaattagcgagtgcagagatgttttggtgatctgcaatttattttccactaacccaaactctccacagtctttgaccacattttgttgtaggaaatattcaaatacactgttcttaaacaaacaaaattcaatttcatggagattctgcctgtgtaataactgcgtgattagaccttgaaatgcaatgaagcaaattcagcttctagaaacatatggactcaagtaactttaagaaaaatcatcggagggcagaatttggctctgtgatatttttatgcaatgaaagacttccagaaataactgtctgctttcctgctgtccagaaaacactcttaaaaaaacacatacacaacattttttttaattttactttttcccctagactctatttctcacaaattaagagctctcttctctcaggacactttatgaacatcaaaattttaaaagtggaatttgtctatcaaagtgccagagacaggctaacctatgtttttcataagtatagagaactgatcactagtaaatctgggagcacctaagagttatgtctagaaggttagctgaagcttaacttcattgccatatatttctcctggaagatattgtgaatataagtttaaaaaaatcttcagacatatcaaacccatactgttcagagaatttataggttttatgtataatgctataaataaaaatacattttcaaaatgagcactgcaaaaaatagaaaatctgagtatagttttggctgaaataattttgaaaatgcatgaaaaaaatggacattgatgtaacttaaaaggcacagtctttgggggggggagcttgactcccagtttttactcaaatatgaattatcttcattaatgaaaacctaaaagatgtttatactcttcaatttcacttcgtgtgttttggaatttattctcgtgtcctttaaaccttctctactcttttcaaagtgcatactcattatcccagaaaatcaaaacaagaatcactggatactcaaaaatgaatgaatctcccacccctgccacatatttcaggaagacacctggcgtattagactaggagaggtatagaattcagctgaaaaagcctcaagttgcaggtttctatattttaaggctatagtggagtgatttggctggtgctggtaagtgatttgaaaagtaagcagtgattcagtcattttgtctctggaaagtaacctgaaaaagagttgctatctggggagaatctgctaaacaacaatgatttaatctagataattgatctgatccactagaactacatttcctattacagagaactttctattgagcttcattcaattaagtttcatttcttacatcttttgcctttattcaattggtaaccacaggccaggtaaaatatttttaaaggctagttagttattggaacagattttccccccaaattgttattttgtttcattagtggtcttttttttttttttttctttttaaggtgacagtctcatgttggccatggggtactctctgcgtcatgctagaaagagtttatggtcccacctgcatccatgagaaagagaaaacaaagcttcaattttaagtccttggaaattccatgccattaagaaactgctactgccagctttctggcgttattcaaaggggtaaaaagttcattacactagtgttcttataagtgttggttttatttcatattatttgaagagctattctgcttagtaacaataaattgcttggaagatgtcagacctgtgtttgggttaggggttgcttttagctgcaagtaagaacactcacaaaagaggggcttaaatgcaacaaaaggggaagggctaagggcaaaaggcacatgacttcagcatctgtcccttatagcgataaccatattttctctagatgctcattggacagaactatttctcatggtcaatcacaaccaaaagacagctggggaaattcaggattttaacagggcacacttcctatgctgaacaaaatctgagttcttaattttaaaaaagaagagaatgatattagagagatacatgttccataatagttatttaactgttcgtttttaataaacatcacttcatatcaaatgtcagctttacacctgttattttttctttattagaacttatattgtcgaagaattttctactcttaatcgtttgcttcatagcgttctcatgttagttctttcctactgaggatgttgaaaccatccatatagggattgggaggacatgtaaattattgcttgcatacttgaccactaaaagcccactacatttttcttcttggataaatataagcagtttaaatttatactgatagagatattattaccctatcatattaacgcattgagagtttaatagattgtaatacaggtaactgtttcctcaaaccatttatttttcagcagactattttacctttaaagtagtctctgttctgtttgtcacaggacccgtgggatgtgctgcattaatcaattgagtttaatttaaaaacatttattgaatgactactatttgctgtggcttttcaaaatccattaaaaatagcttttggatatttcaaataatgatataaaatttgttcaaaattttcacagcagtaacaaccaaaatctactttaactaaaaaagcaaatatatggtatacgttttaaatcccctgtctaggcattatattatccttgatctttacctcatctgccctctcacgacttttgcatgtgcttctcataagtaggagaatttatatatgctcaaactagataatttttgcaaaagttttaaaaacatttttccctgaaccattagttgctcacaatgatcacgagccaaaatgacaaaaataagtactttttttgtgtttttacagtcttgttaatcatatttgccaggtaaaaatcatatctctatttagtttttttctttaagagaataaaacagtactagcagcactaatactcataaagttttctccttgaggtgatattttgttacttttcattataagaaacaacttaatgcatttaagttgcagggaaataatatagatataccagaacatgttaccaagttccacatttctgcatctggggaatgtagaatggataggaatctgaatggctgattagcaacaagcaaacaaaaccaaaaaacttccccaggaaagttgctcaagttcttaactcctaaattacatcctccctttggacatctggacattctttttatgaggcatcttgtccagcttaatctcatataattcttaggttatgaacagattttgttttttgactagaattttacattttggataattacattgatttgtattcattttcaggtttaaaccacacctctacatctgagtgtttattaagatggtatgaagcacggtgagaacaaaaattgtttgtactaggaaactgtattatttcatcttttggaaaaaatctaaatgataaacctaatcacatgttgatatatttttaagtacactttaagggagtgtaagtggttaaatagggagtgaagtgttggttgctttatgaagcagttgtatctaaaatccaggctcagggtccagccaaaatagaatgtgcatcatcaaaccatgcagagtagcagagctaagcaaggcataacgtagagataaagaatcctggaagtggttgtagatatttagtagccctagatttaggtaaattaccattaattataagaaaaaaatatgctagtgagaggtacttcatggtgtctaagaagaattttcaacttttctcaatagcatatctatttttctacagaatttagttttattgtattcatatgcctacaaatgaaaaaatattctagaaaaggttgactttctatcccttcaattatctattcaattagggtcaacaaggtctaagatttttttttttaggctgccatctatgaggaagtagccactgaactggaaccatttctaattatagatcatgaatcctaggtggacaatctaatttcaaaatcatgaaccaagccaattctaacatattttcatgtacagtttatttcccaaattctaataagtacttccccccaccttcccacatacattttaatgttttcaaattgaaatgcatcttaaaatcaatatgaacacttaacaaggtggtttttcttttatgtcacaaaagctggtattcgattggcttaagtaataagaaaatttgttatcgcaattaatagaaagtctggagataaacaagtttgctttttgattgacacagtagtttaactctattggggactttggttcttttcatctctcctctgctaatgatatgaatataggtctggcattgatttaatcatgaccataagttggctgccaatagcaatcaagacaccttactttcttgctcatgccaaatgaaatagagaaagagtacctctccccctagtctaatacatatgtccttcctttcagtctgattgggtcagtttaggcatctttcagaccaatcagagttatcaaagaaatgccttccactgactggtttattctcatcaagccctaccagagaaatgcctgagtctcatgaatcacttgaactgtatgagagacaggaagtataggattcacattagggctctgttaggagagaagcagaaggaatagatctagacagacaacttgtcatgtccacttttgagaagtggacatatgtgagctgatccagaaccccaaatcttctgtgcttttaaaaaaaatgtttctgagacttcatagatatcaaccaagaatttggatatatcccttctcttaccccagttgctctacaatctcctccagaaactctgccaaatgactaaataatgaattcctgataaggtgataatggcttagaatgacttaatgtggtaagattctcaggactattgcattataacaagacactcctagcacaaaatttctctctgacgatggtaaaaagttgggtcctgggtttcagtaggagaaagctagtttaaggtgaggtgtcctgaccactcgtggttggctttacatggggccaccgaaacacctttgcacatagtaattaggcttacatttttattgtttgccattcaagagcacacttcatctagagatatttctgccttttctccaagactcagattcagcatacccatgatatctccatgccttagggattcagacttaaggtcagaatttgagttcactaaattcaccaagacacaaaatattcacaagtgggatgtaaaaatcccatttgttcactgtcttcttcatgctttaatatatttcttttggtggcattgaggaccaggcaaatcatggaggtagtgctgaggactaggggaactcaatttatttgtagttcacagggttatacctgtaagaggccatttggtagaactgattgctcaggcgaaacccaagaaatgtacttgaaggaaaccccataagcctctgttatacacaagtaattagaggcattaaggaaagcagaagaagcttctgtgggtgagatagaccccgtttatgagatgacatcatcatttgagagtttagcttcatcaacttttcatcaatgtcttgacctgacgtggatgacaaaatattcttttgtaatgtgaaatttggaattttctttcttttccaatgcccctcaaaatgatgttctatgagttgttattaatacaatggtaattcaatagaagctttcatatctgacccctacttaaacgacttttcaaactaataattctctttttctaccagaaaacaaactctgatcccttgcaatgagaaaactactctaatacacctatcatttaatttgtatactaaaaagataagactaggtgttcaaatatgttaatgcctaatgtacttgttatatacataaatgatcaaatattatataaactggttaaataagagtataaaaagatgatcatttttttctgaaactaagttacatattatggaaatacttgataagggcttaaatttaaaatttctcttcaaccgggtggagaatagatcaaagtctgaagggtgcgagtatcacaggtatctagaattcttcacacaggaattttattaaaggtctatgagatgtttgctttaagagctaaggacgaaaactttacatgatgcattaaggcgttggtatatacaagaaagatgatgcagggtgttgaagatcagacatccacctatcctttgatgttaatccaaacaactagagaatatatatacatctatttgttctcagtgaaagaaaatatggaaagaaagtatgtgtcttttttaggttgttttgctttatctgcacatttttgtttaagagatcagcttttactggaacaatttacactggtacatacccctacctgaccaaatctgacacttccctgtgtgctgaaagatctgcacagggtgtgccatccattcataataatctgttcaatcaatatttattgagcacctaccgtgaactggtctcttgtccagaaggtagaaaacacagataaaaatatgctctctctgacttcaaggtcatagtcaaatgaaaggagagagatacgacaggttaagtacatatgtctggggtgtcgtgagaagcagaggagtgacattcagttgtcgaagtatctagatggacaatgtataatatgctgccattcattttgacctctcttgtttccaaagacttttggtggtcacaacctggtatgtcacctcatattaataatactaaaatttattgagaatttacctcgcactggacaatatgctaattgctttacatgcacaatcctatggggtcctcacagttatcccatgaggaagattccattattattcccattttacagaagaagttgcaccactgaaaagggtaaaactgaaattcaaactgagttctgtccatctttaaaatatgccttctcaagtgtccacttatggtaccgccggcaacttttagtgtaaggagatccttattcgttcatgatatagtttaaaaattgtttgaacatatggacaatatatgtgcgtgtttgtatgtctgcaaaatatacagttggatgttctctatatgtacttgctgggaaaatgtatggtgtatgtatatatctataaacactccctgcccatatgccgagcgttatagttagcaagatgaaccagttggccgttacacatgctggcagggccatcctaggagcagttgctggggatgtatatcaccccccttcccccaggagggctgtcctattgtcttatgagggctcttcaaaacagttccaggctcttctctaatgccagcatttctgtagccaatggatattttctgcttttctcttatgctggggatgtgtggaggaaggagggggcattaaaataattttctgctctaggctctgatacacttaagacagccctcttcctggaatatataaatgccagcaaatcagcatttcttaaactgcagtatccttcctggaaatcctgttaaaggacataccctggctgcttgtctcggaccgaacaagaatatagcaagcctcataatttccagtgctgagatattagcataaatctcccactaatgcacctctgtcttttagtggaagagtcactgcaacctaagaaaatgcgttaaactgagaagggactaatgttttgaaactggggcatggcactatgaaggaggcatttgctgggagtttccagtcctgcaaataccactgcggaggcatttagaagcttttcttgtttgggccatgaaaaatgattagatgtctcactaggaaaaatggttttgaactgcttatggagcaataataagaactttgtgctgggcacagtagctcatgcctgtaatcccaacactctgggaggccaagggggaaggagcacttgaagccaggagttagagaccagcttgggcaaaatggtgaaacctcatctttaccaaaaatacaaaaaaattagctgggcgggtggcattccccagctactagggaggctgaggtaggagaatcacttgagcccaggaggtcgaggctgcagtgagccatgatcatgccactgcactccagcctgggtggcaaagcaaggccctgtctcaaaataatagtaataataataataagaagaagaactttataactgatcagtttcattttatatttttgcctctggcatcacaataatctcatgagagaggcaagataattagtcccattttaaagatgtggaaatgaagacttaagaggttaagtgactctgagacttagaatgtcaaactggaagggctctcagaattattttggacacctggagctctcttctgtgggtgctgtctctttttccccttctcacttcttaaaccttggttccccttctttttgagaagtgaaagttttaggcacttctacatttcttggagcatggtgtttaatacagacatttttggtgtttgttgaatgcgtgttaggtgactttacacagaatcctacgtgggactgcagtacctaagacagacaggagcagagttgcagaggctgagggggaagagaagcccagcgccctgctccctcagctgctcttggctcccaccttgtcctgttgaccagtccaagcaatgcacagggtacacccctaatagagttcaagatctcattttactaaggcctccttatttgctgaaagccagtaagtttctttatggcagaggtgggtcttaacactaggatctttatctaccagcccaacactttccttctaagcaagtctgtacttgtacatgagagtggctgactgtggcttagagttggaagagaacttaagagtttttttaaattgcctctggacattggaatatcctctgttctatatctgaatggggtcaatgaacttctgcttgaattcttggattatagtcacaggcttatgtccaaaggacattaaggaaaagttcaactgctaagaaagatgtgcttcctgagtgagtggatgtatggggaaagatgcccagtggatagtgtcaacagtcctgtgacctttattctcctgggattcttttcctctcatcatgggatagatttttattattttacctgtgcttcgtatgtgtgtgtgtgtgtgtgtgtgtgcgcgcacgtgtgtgtgaagaaaaaaatgggtagaaaggaaggagtttgttttcagttttgagtgatggcataataaactgaaattcagttgtccttaaagaaaaaatgattttgagtcaacttaggttttagtcttgggtctgagaaacctcacatagataacttgatggtcctaagcagtatttcttcatagataaaatgagtatagtaatatctttttatggggttttgtgaagattgaactaaataatgtatataaattgctttggccaatgtctaacacacagcaagttttcaggccaatagaggctactccaataataacaacaataatacaattataatcatattgacagttactcatatatgtgtaactgtatatactacctacatatattacacgtatgttgcatatataatatctagtatatatttatatgggtacaaacacacatatgtatgtatgcttaatactgaggccttagaaaacagaaacctaagaactgaaacccttttacaagcctgggtctcttttatacaccgacataaaccagaatctccttgaattgcattactgcccaatcaagcaaatgttcaagttctttgagccttcagatatgctatacctcactgaacaattagggattacagaagtacaccgtgctactccgaacccatttagtcttccaaaaatattatatctgggccaacaatgggatatacagtggtgcacaacagacagactgttcctgccctggtcatggagttacagattcaattaagtgctgcgaaggctaagaaaagttctatgagtcagagaaaagcaaaggccccctaatttaaattgaggtttcggtggggaaagagaacaaagctttaggcctgaagttagccagatgaaagaacagcaacaacaaatgggctgagttaggaaagaactgcttatgttgggggactagctgggctagccaaggccttgcacggggtcagatcttcccggcctggcaagtcatggtgaggagcttggaatttatcatgggaacagtgggtgaacgttgagagtatcaagcaaggaagtgataagtttcagtttgcattctaaagagacttcttcaggaccatcctcccagcagcattgctcctttcctctctgcaatggccaagtttattgcgtgaaacatgtccacagaaaaggatccaattttctcactcttgaaaggcaaagtggccaatgaagctgcgtatgtggtcttgagaggacatttatattttaacagaggttcaagttttaagctaaaggaataaaactaaagttttaagctaaaggaatgcaagtgtggtttttcttgcatcagcaacctcaggagttgaaggggcttcttttggagagggatgtggcctaataatgtgtggaaactcagagataagcagaccagggataaagtccaagccctgcttcctacaagtgtgacttgtgtatactcaatcttcttaacccgcagtttccttatctgcaaattgggaagagtccccacctcatagggttgttgaactgagtagaataatgcatgggaataaatacaccattgtgggactgtttatattaaaccctaccatgcagggtgggaaaaggaccttccttccttgaattcttcttttgaaaacatgatcacaagattccagggtaatttcaaattgactttctcatgatctgtatcacatcatctatgtttagacattttcacactttcatgcgaaaacattttgggtgttcttcctttaagaaacatatactttcttccacacatatttttgcatgttacaaactgtgtcaacgtgcaaattatttccttgaaataattggcgatttagtatcagtgatgggcaggggtgagtcaactggaagctcaggaaagagatttcagaaagactgcagggaaggagcattggggagggagtagtcttcagaatcacagggtttagaatcctgtgagacactggcaggatgaaatgaatgtccaggatgctccagtgctctgaattccaggcccgagatgggctggaggtcctcattttgccttcagaaaggggcctgggtaggaagcaggtgtctaatggtgctaaggaggttttttttaattcctatggcatatgccctcagaaagcttgcttatctccccaacccccgcccccaccttcgaaagaaaggggtgggggagctgaaaaacacttggcacaggtgcaagaaagctgaaaacgtctggcagagctcacagacgtcgttttccactcggcaccaaatgttttacagtcttcgtgagcccatatagattctggcttctgcccagtcgtttgtttgaaactgtaggctctgagaaaaggctccacgctgcagctggcctttaaactgtgttttatggggggagagtgttcagggtacaattggaattaggagagcttgcctttgacgttggacgtaaaagtaacagattggagcggggtggagctcatgctaaggaattgttggtctgttcattttccccctccgaagacgaagcttttggaaattttacctcaatctcaatgatttcacgggctaatttacagcgaggcccccaaatgtgactttagcccaatttggctcaatttgactccaacataaatctaacagttccaagtaatggagatggcagaaccgttcttagtgatgtaaatttcttgctaatttagggcaattgtggcttagttcccacctgcatgcatgttcattatgaatgaacatttaatagttaactatttgtctttctctttctttgtaaccctttttggttccttatcatgcttatggctcataatttcaaaggactaatgactaattggattttttttgtaactgtatattaatgatgcaaacgaaaaagacttcaacaagagagttaacgctgaaatctgagcattaaaaagtctttcttactctgacagtttagggaaaagtaggcatttgggtcctcctcaggtctctggattcaaataataactattctttgttgaacactcgctacatgccagctacaagcctaggtgcttcccatgaactttctcattttttcttcactgtaactgtgaagtatgaagatgaaatccacgtttcagcagaggaaactgaggcttagaaaatttaagtgactttcccaaagagatgattatgaatgtgcattatggatttacttatttgatccttttcagttttcaggaaccatgaagaacaaaatagttcacagttcccagagtaaatataacacccacttctctgttctcagtggctcgtgtggaatgacttatcctggaatttagagttgaagataatcctgatgcttcaaagagaagagttggaacacagtccttttttctaaacagaggaattgttgaatatgcgactgaacctctgacttaactaattagttaatttggagcagagtttgaacacagtcctttttctaaacagaggaattgttgaatatgcaactggtcctctgacttaactaattatttaatttggaagttataggttttttattacttgaggagcagctttctctgaacaaatacagtgtcccctggggtgtccaaattgtgacagaaaagtagcgccagcttgaaactagctagtcatcacatagtggcatcatgtgaatgaagaatcccccaaatctgtgaccctcttctatccttatgaactaattcaataaataaatgagcactttctcagttcccaaactgagagcagtttaaaaaaataatgagagcacagatatctatttagagagatggcgagatagaggagagagcaagttgcacaccacgaaacaaagggaaagataagaagagagagtgtgtcactacttccccgtggcagaatcacaatcttttttggatgtcatgttgaaaagattcccaattcgtagttctgtgagctaaagcagatggatgctccatgttggtacaaattcctatttgaagcagtgtggttgcaaagatggggtttgggtcatttgattttctccgaaaaacaatcttgtgtaactgttaaaagaatttataatacccaatgcaatgtatcatccgtgatgcttcttcaaaaatgttaaataaatgctgaaaccagtgtttcaaatatatttgtccagattaataaacagggttactttggttaatatatgtttgggaaatgctgaatttaacatatatagacaggtttgtttttcccctgcaggacttctcagagcctttactattgccctgtgattctctaagaagggataatactataccacttgatcttagagtgctttttccataaagtatctgcttcacactactgtgcttccaaacaaccttcggaaaatgctgaaatattatcacttaggtaaagaagggtttaactttttcacccgattttggatcattatggctaagcctccacttacatagaagtttattatgaaaatttttgatagttaacacgtatctttagtcctctttggtttcttatatgtttgttagcacataattcctaaagattgataactgattagatttttagacaatcagaaattaaagacatacatgaagagattaaagcagtaaggtaaatcagaacagaaatttggagtctcagttcccattgaataatttagttgccagcccttgctagactaaccacatgaggtcatgtcacctttctggggaatctttgggaagaatcctgaaacagaaggcaaaatacctctcagcacaccacattttacctctcaggttgtcaggtgaaactaatggactgtgtactgttcttagcatgctggaccaggtttgcagtgacctttccctgtaagacagcgctatctccaccaaggagaatgccagcatatgcaaagtctctgctgcagtcctttttgattaggtgtaaacttgacgtatcctattgatgtctgggtctccatcagtagcttgcagagaaacttactgtattgtatcccaaatagaaacactgagcccctttcaacatatccatgtgtttttggaaaattgcaaaattaaggtattttttgcagtcttgatcttggagagattctctgaagttttaagcatcagactccacagaacacggatctactcccatcaccaaagaaagccttaactggatttgccacaaaaggagaaaccatataaaaatttcctccatggcatatatcttatcccatggaaataagaaaaaggctcagaatagcccttccactatgtaatgtggttgaaatgtccactaaaagtttcatacgggagctcacatgtagctgggagctccttctgtcttttcttccctataattaagggggcatgtcaggtctggggcccagagctctcccatgattgaagtttgccaccctcttgcagacagaggattgaaagcctggcatagaatatctagctattgtataagttttataggacaacagagagcatgaataacccttgggttgtctttggcagttgctttctagaaattcccttttcacaataagtaaaagaatcaaaatatcacccccaagattggcagatgcagaagtatcacctaaagtcagcttctaccttctaaactcttccatgggtcattcaaagaggttgtgccagccaggtgtagtggcacatgcctgtagttccagctaccagaaggctaaggtgggagggttgcttgagcagcatagcaagaccccgcctctacaaaaaaaaaaaaaaaaaaaattagctgggcatgatggtgtgtacctgtagtcccaactacttgggaagctgaggtgggaggatcacttgagtctaggagattgaggctgcagtgaaccatgactgtgcctctgcactccagtctgggcaacaaagtgagaccttgtctcaaaaaaacccagaaaacaaaaattttatgccatagtcctgacccactactgctatgagcttccactgtgacctacagagatctatttattctatctacacctcaacatccccacttcaaacacagaaagagatcctttcctcatcacaatgtatgtcacacgaagctttgcatactccagaaactggaggacttattaagttttctttacttcaaatgaccatatagtcattcattgtataaaaaaaacaaatctcagtaatgttcttctcattttcaataatgggatttttttttttttttagacaaattgtgctctgttacctgggctctagtgcagtggcatgatcttggctcactgcagccttgatgtcctgggcttaaggatcttcccagctcagcctgccaaataattgggactacaggtgcatgccaccatgcctggctaatttttatttttttattttttggtattttttttgtagagatgaggtctcactctgttgcccaagctgatcttaaaatattgggcttaagtgaccctcccgcctctgccccctcaaagttctgggattacaggcgtgagccagcacactcaaccataggaatttttattttgaaaggttacctaatagttgaaaggggtttcattgatggcaccgaattgaggggtggttaggaggagaatgagaaaaacctttcttagctgaaaaaggagcccccaagaagcttccactgtgtgatgggaaacaaatatcactagcatgttaaataatcagtgctcataaagtgtcattatgaaagcaactttgcatttgtctcttgccattcttttatatttatttgtcagagggagtcttttcctagctcttggaagtaaactcagggaagccccatgacatgtctgtcagacagcctttaagtcataaacgtagtctcaattcataacctagtttgagtactaagaaccatagttctgaatttgattcagtcaatgtcttctcctgttctagctggggactactgtgtggactggctgctggaagaaaggtctgtcatgggcctttcgtctttctctagctaccatgtttccttcttcagtggcactgtggctcctgaacccaccaaggccgaatggggagtaggagggtaggaagaggataaagaggatagaaagcttctaatttgattgatactcttatagcattgtggcatattctctgcatcttgcatacattgaaggtgccaatttcattaaagggtgccttttatggtttcatcagagtacccatgatggagaagggtctcccacgtgtgttcctttgacctgtgaatacaaaccctatttatccagggcttggtgttgcacacataatttctttttgctgaagtctcatagacatttttggtggccttatgagacagagcatgagacagctctgggaccaactcttttttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcacacgccaccatgcccggctaatttttgtatttttagtacagacggggtttcaccgtgttagccaggatggtctcgatctcctgacctcgtgatccgcccgtctcggcctcccaaagtgctgggattacaggcctgagccaccgcgcccggccgggaccaactctttctcaggcacctcacccatatgtagtccatcagaccacacaattcccagcctatgcttgctctgcagtgtggtgcttttttttctgggcaaaggcaactctacctcactctgctgccatagaagctcagccctctggtttcctgggtaggagtccatgcggttcactttgtctccctataaaaagaggccatgtagcaagctctctgagtgttcacttggacatacctcccaccacattaaggagaagggcagccaccccacctttcccctggggaggcatcacagagaaggatctctaaggaaatcaacaccataaactcgtctctatctgtctgccactgtcctacctttttaaatcctcaaaatgttgggttggccagcctggccttcaaccatggccatcttacagctctctttattgtctttatagtaaagtgaggaagacatggggtttgaagtcagacaaactctagagttcaaatatctactctgccattgtgttgtcttggtgttagaaagctatttcaagtctccaagactcacttttcctcatcaataaaatgggggtcataatacctttctcagagatcattgaggtagttcagtgagataatgcattaatggctgtttatacagcactgacacataagtgcttattaaaattacctactacaggaggtattatgctaatcttgggagaaaagtgtgtggtatctaagagaagaaaaaataaagagatatgggaattagaagtgctcatttcctggaggagtgaacaggaataatgaaagggatggtatatggaataagtctcaaaaagttgatatgatgtgggatagtgcagaaataaagaatagacatctctcatgtgttacggaaacaaatgaactaggtagtgataagaataattatagctgaaatttagtgagtttaccatatatactaagcctacgctaaagacttggctgaatcatctcttttactcctcacaatgacccaatagggtaggtattattaacaacactttatcatctagcaacctgaggctcagagaggtttagttactaactcaatgcatttgactggtaaatggtggtgacgactagaaccaatgtttgtctgcagtctgcaacctttttttctgctattacaaagctaacatgaaaacttttcatgaactatacctgaattataacagggcattctggagcaggagtctcctaatggttcaaacaccccaaaaatcagaagagagggtgcttgagaccatgaatctttagaatgtttctccaattttgagtgcctaagtaatataccgcccccagcacaaagaagtataatccttctaagatggttttaaactcaaggatgacctctattctcttactttcctcacccccaggaggaatcttgaattactaataattgctgtgttcacaaaggataaagccaggagaattgacaggaatttttttttgcatagatggtattagttataaaatttatgctagttctagagtttcatagggcatcctggtaactctctccctcatgcagaaagccccagtgagggcagagaaaagtacatttcaggcatgaccaataatatatacactaagttctaagccatgcaaatgtgctgaaagttcatcagttaagtgttcactgattattcctacaggaccaatccagctattgagaagtcagtttccattatttttctccatgaagcagaacttgccaggggcctggaatacaatatagagtgtagtcagatgggttttgcacttcgcccaacctagcaaagtcactccttggctattatttttcactctattgtaaatagcaagaggcagatgaaaaggtaaaaaatatgttggttggaagatacttattctcgcctacctagggtaatcaagaatagacatcagctccagatttggtaagtaataactcacatttgactttaatacaccatgataaacttttaggaatatatcttttaaaacataaaatgctttacctctgatttaaagtttgggggattggtcctgcaccgtaggcacattagatttagcatctctggaaattccagagcaattttaaactactctttttgatcacttgctgcagctccagctttcaaagagaatgagatgttttgggaatgaattgtgatggacttatatgaaaatttatatggccaagaattggatttgttcccctggaatattatagattatattttatgttggaattacatcagtgtgcagagcagcagaaggctggcttaatgtagctaaaaatataccttgactttccacttggaatagaactcccccctccccaacccatttcttccctaatgaaaataatggcttcatgactcatatatgtgatagacagtaggcaatatttgagttttaaaataagaagagtttgagaaaggactaatggtccttttctaatttctttcccatccatctcttccctcctgtttccctgtcaccatcctatttcaagccttcatcaccccatgccttattgcaattgcacctttctcagtctctactctcctggctttaatttgtcctgcatgctgctgcctggtcaatcttcctcctccaccactttaatcatgtaatctcctgctattcttcagtgatttttcatctgctccttaataaattgaaagctcacttcacaatcaccatcttagtccaggtcactactaggtcttacctgaagttgggcagtagcctcctacctggccacctaattggtctcaccattgctttgatttgacctaatgttttccaaaaatattattcaagtacgtttggttacatgcaggaggattttggtgccacacagatacttttattcacagaattacttataaaacattgctaatatagtattataaatgcgtaacaaggaatttgtgtatattgttgcttggagtgaaaggcatcaagaaagtgagctaataaatcacttcatggggtgtatacattctaagggatgtaattttctacatcccttagaataccatcttcacctcacctcccaggggcagttttacaaactcactttatgtgccaggtggtttactgccatgcccacattggcaattataggatcacagcaatggcagagtagtgacagtgggaccatcctggcctcttgccttcatccctgatttcagggactggcccctagtattgccaactacacagcagtaattggacacgttaatgcagctttctgcagtctcaactttaaatgatgagtagcttagctactgagaggatcttcttctatattcttattttattttttaaattttacgggaacttgatattaaatgaggaaccataggcagaaagtgctgaaagaggaaacaaagaggatgttggggagtgctgaacttaatgaaagctctgtatccacaaaataagttgtggctttgtaaattcattctaagtacatttgaggaacaataaaccataaaagaggttagcatgaccttggattctgtatagcttttgagataaaaggtctaagcatcagaatgcattttttgagcatagtgttgttgactgattaaaaacaattcatgctcctagaaccctctggtggaatgctgatgaggggctggcctgggtgcattgtgcacgaatgactctcttaaagcaaagatcaaagttgcttttctaaaatggaacactaaaaggtaagtctttgtaaccatagataaatgaggcaaagctactgacataaggattaaattgcaatacattgactttgcatttattacttattgggtacgtatcttaaaagcattttgaagatgttccaaattctaatcattgtacaggataacaactcttaaaacatttactaccagtgaatgtttttctttgatatagccatagtatttttctgaatgctttaaaagtaactacttgaactttatcttggtttcataatttttcacatgtataactttttaggcttagtgattaaaagcatgggttttggaatgaacagatttggcctcaaaccttgtgataattggttatttgccgtgtaacctgggacaatttacttaatctctttaagactctttccctaaaaaaaaaaaaaaaggaaataataataaaatctactttagacggctgttagagaatgtaataatataccaaaatacttaaatattttctatatgatattttttctcatctgtaaaataaattaataaaaataaaaattatgtagagaacacatcaatctctctggtccacccctaactatatactaagagtgtaaggtgaaattcggattttagtagatggcattgcaatccatgaccaagaaatgtctccatctcgccctcccacttaccccctttcccccaaagtgccctaacagcgatatatggaaaggaaaattccggagagaagaaaatactcctttatagctgtgcaagcacctctaatacaggtccttctggcaaaggattgaatgagaaaatgtgttttagatctccaggcctaagtagttctgcttcccaccctttgaatcaagataaccctttggctgagggtcctcctcagttgccaatcaagatgtgaagcagagaaggagacttggccagggtagtccagggccatgggccctgtgtaagcggcagacaggaaggaaaatgccatggaggtgatctttaagccagactccccaaacctgtcttaaattacaccacattgtaaattgtggcccaatgaatgtcctggcctcccaccaaaaagataaacaacccctactctcttgaaggctgggagaaagctgaaggttcatcacttctgttgactccttctcaaaacgtggagtctttagaactagcgttgccagatttagcaattagaaataaggagcatccagctacatttgcatctcagataaatgaagaatcatattcgtagtataagtaggtcacatgtaatatttgggacatgcttgcttgttgtttttctgaaattcaaagttgactcggcatcctgtgttttgtctggcaactctattttcgacagtttctaaaggtgaattggtgatggataattgagactgacagaatgcttcagaaaaatgctgttgacatttagatatttgttggtgggcgcggggggttgtggctgtcctgtgccttacggatgtttagcaacatttctggcttctatccacaagattctagtagcagtctcctgccctccattgtgacatcaattgtctctccaggctttgccaaattgtgagggagggaattgagaaccactgctttagaggcagtggcaaaagcagagctgtgaagcatatcaagatggtagaccagaaggaggcatatttatccaaataatggcacagctctggcccccacctgcatttcttgtcctctccccacattctgggctccttccctgtaatattaggagcaattcagacctctgttggagaagccccaaaatataattttagtcccatattaattaattaattattttgaggacaaggtcttgctctgtcacccaggctggaatgcagtggcgtaatcatggctctctgtatcctcgaactcctgggctcatgccatcctttcacctcagcctcctgagtggctaagactacaggaatacacaactatgccagcaaatttttaaatttttattttttgtagagacaggggtctcactatgttacccaggctaccaagtccagcccctatgttgattatcactggaaatttgtttgactctattcactttgcctttctacacagctcacctgacgatacatgtggcaactgtttaggttttactcagatcttcttcaaaaaacacccaataaactcttaaaccaaatatttatattttatcagagtctatagtttgtgtggactgagggaacttagtatttgatgggcaaaattcttgcagtcaaacaactttacttaagtttacatattaatatttttctccattttgttgagagaaagaaacttagaggcattgggtaattaattctgcctatcaaatatttccatctatacatttatccttgaaaaaatgctaatatgacctcccatgatgtttcctatttataaagtttctctgcctggatgttttcttgctcctttggaaaaaaaactgaagcgactttcgctctattaactttgattgtccagcattgataattaattttgtaggcctatcagcttatgtagtgggaaaatttcattagcaagtcaaacgtaacttcgtatcttcattgctttccatattttgtcggcttttacagaagcaatggttttataaaaaatccattgagcagagcaaagacaatgtagctatgtcgttataatgctgtaggaaaaaaaatgtctgttcctcattctatataaagattgtatgttcttaaatctcttttataagagtgtgcttccttaaatcagaatactctgttccctgagaagtcccaccttaaagaacaacattatctttatttgtaatcacaggccttcatcattgcagaaaatatctgagccttctcagattctgatatttgtatttaatcaataaccacatccctttttgatctgccttacttctgcaattgtatttccccagctgcgtatgttttattgtgtaagaattcaattgaaaaagccattcatgtttgcaaaaaggatgatgttttattattggttataaagaaaagaaatttcacactttgtataaccgaccctttctgttatagcacagtgaattctgaaagtgaggaacaaagttaacaaaccgtggaaagcaaggccacagaaagatcttgtagtgttctgaccacattaccacataagacctggtgatttttatgtctctaattgacaagcattcaattcacatttgaaatgcacaatctttgcataatttgagggtatgtagagtagaaagaataagggaatgataattgaaatatttaacaccaatatggcatggcctcaccaatgataccaggtaccatattataggaatagggttccagagacccccaggtgttcctcctttagtgactagaccacgggtagaggggtgggtgctcagagaggagccaagagggatgggacataaggaagcactaggaggtgcaaggaaacaactgttgatgagtcagtctggtagtgttttagtattttaacaattgtaacacctgcaccactgagtaccagctggactgagaattgggtagtgcaggtagtcagaaaattagaacccaagttagagttcctgacactgccaataattcactgtgtggtcttgaataagtcagttcatggggcctctcttttcccctgtgaaatataaaaaggttgcataagaacagccttatgttcccttcctgttctaggaatctatttttttttcttctaatgatctacaagttctatgcattgagtatagagctgtttcttcgagcttctgaaaagcagaaagactttttcatggaaggtgtggggcactttcatgctccgtggtttgtgaataacatggtcatcaaacaggaatgaaatcagcattaaccatgggtgcactgcacttccaggagcaagttgagagtggttaaatgcctttttagaggcagtttacaaatatttttaacagatgaatagttttcaatgtttgggagagtttatttcaaattggaaaaatgtgctagtttgctacagaaataaagcaaatggtgattttgcctgaaattacctaagtcaggaaaaaacaggtattttggagctttcttttgttgttgctgtttccctaaattacacacaaaaaaattccctcaattctccatttcacttttgtgttctttgtttggttactcatgcatgatgcttttttatattcagtgaaaatattaagatatatccatggaaattaacacaaagtaatgagcaatgtatttgcccaaggactatagaattgtttctacagaaagtaaagaacattccaaagtaactttaacctagatgtgttttcaccacaaactgtttaaacttatttgagtcgaaaatcactttccagtctatatcacatctttttcttaaaaaaataagtaaaataagtacttgacataattattgatcactttaattatcagacaaagaaaaacatggtttctgaagcacatgctatattaagaagcttggtgctgaataagtaccctcaacgcttatttctttctggtgtctatacaaatgatagttttgtaaaatgagctgaatctgttttaatatcctgttgcttattgtacctgacaaataaaaatgaagaaagtgaagaattgagatttttttgaaacttgcacataattctcatttatgcttattagaataactaagagcctttctgtaacgaattaagaatatgaataacctgttatgacatagtcatagacatacaataatatggtctagaattatagtactctcttgaagtacaccatattcaaaattcactggagatgttttagagacatctgttgtaattacaggaacatggtttctaattcatttaattccctttcctacctaaactgtacatataagtgaattttaagagactgtataaataaatttttaattacaaaatgatgttatacaatacattattaataataaccaacaatgcataatgtttatgcatgagtccattagaaagacgagctaatgtatgtcaattctaaaagaatgcactaatttgtcctgaatttgtgaatgaggttgaatccataatgcaagctgatgagtgcaataacgcagtggcttaacatgctattttatagtcaagaaacatcttgtacctacagcatttaagaggtatttaagatttgttcatcacatgtgatcaagaatcttatttttcagtgagccatgcggttgtgaaatttggaataagaccattgagttgataatactagctttcctagacaggtgcagaataaaatggcctatagcatccaagaaatgtgtacagtccttacatttcagcacatggaaatcagtcttgttgtaatggaatttcccaccgtggccaaaaggactgccggaatgtggttacttcactgtgctagcggtaacagatttctgaaatctccatggccagttccagacactcgctggtctcatggcaagattcaaaaaggctgcagtccatgtcacaattgcagctgcaatcattccgagagtggttttcatccgaggtgtggtgataccggcgagaggggcagcacattttggtacacaccgtttcgcaggtgccggggagcatcaggagacagtcccaaaactggcaaaacagacaggcgaggataagggaggcacactcctctgtttaaagaagaagaccaattaatagtggcacatctgggggcgtctatgaaggacaggcatgtgtgctgggatacttgataacttgatagccaactcttaattatttatccacattaggggtaatgtacacccttcttctctcaagctcccccacccccatgtcagtactcactctacttaagtaattgctttattaacttcctgagcatttcctattgattcgacataatctggttatttaaagtgctgtcagttttctaaactcctttatttactttgcctgcaaggctctgggaagccacacaattagctacctctctggaaaccttgcaactgtctgaaaaattgcagggactccccaaatacaaggggcttaagaagcagttaggattggggacaaggagagactgtacaaatgccctgtttcttgtcactaggctttgttatttttcgacatggattcccataaatctgccacacccatattccagtgcaagcgaaaagcacatttcaaaacttaatataaatgctttttaaaataatcacagcttttgggttgtgttttatttttaatctctgtttccgtttccctccagttatgtaaagccttgattttatattcaagttgtttaagtgaaatacgtcatcatatgcctaaaaggttttaaatcttatcaatcctctttaagaaaattggtttaaaaatttactacacaggcttgtaaaaatctggaaagtatctctaaggcattgaaggtaactggtaatttctagccaaacagctgtgatgggttatagattattatgttttttgtttgcataaagggaattagttagaagatgtagcagttctcttgttaaaattttaacttttctttcttttaagttaaaaaagtctaaaaaatgtgtgagtgctttgtaaaagggtaggtaagtgttcatgtgatatattacctaattaattaaaatcagtaatctgaagattattgatgattgaaagtaacattctagcatgaattagagaaaaaatttctcctctagatgggcttatcaattgatttaagtttgactttcataaggatctgtatttttcccaataagaatgctaataactttggttttcagactttagtcaatggggagtatataagcatatagaagagattttgcctacagtataagtgctcttatcgccgtattcatttacttttattttccagaaagctcttttctttcattattcatataatagtctttaagtgaaagaaaaatatggaaacttcctatgaaaaggaacaaatattttaaagaaagccactttggtttcttgtaaaaacactatataaagttataaggtgagtcctgaatataagtaaacagaaatctttcttctttcctctttttctctccatcctctttctcttaccttcccttcctttcttcccagaaagatggtggtaaagaaccacaccatgactgttatgactactttaattgtcatatattgttgcaggtgctgtggccactactcagtatttatagttcaggcagcatattccacaatacctctactgtgtacaaactcatctctttgccagatttgctgtatttttcttcacttagagccagcttttagcgtgtgaccaactctcccatatctcataagtcaccacaaacctcccacaaaaatgcaagagtaagttagtaatagtatatagactgtttcaactatgcttttctgaaaaggaaaagatggtcaaagatgagggacatacaacctcatcgagttttaccaatatgaagaccactactatagcagtggctgcactggcaaagaagaggctgtcagcagacaatctccaagtgaatactctgtgatccctcaggctgaatgctcaagagacttactcaagcttatgaccatataaaaatgagtccactggatcctgtcctttatacatgcaaggttaaaagtttgctttggagttaagtagggtgggaatgcaggtgaccttaaggattggagctggtgtttcctatcagagtgtgaaggacctgttcgtaaagtggtcttataatttcctgagagtgtacaaccttttggttcaattgctcttgccaatgtctcctcaagttggcagactctggaggtctcctcttctaatgtatactgtagattttatttacaaaagaaaaaaaaaagttttggcttaatcctttggccaaattggcacttgtttccttctacctccctattttgcacttgagaatagagcccatttttttctgtttctaagtcagtcctttttatttggttttaaaaggcagagtctcttgcccaaaaacaacatggtaacattaatgaattgaaaacagatttttccgatctttcaagtgagttccacacttttcctaaaaggcatgttaaatagttctacatgagcaggtaaaactgttttgcatatggccaatttttgtttgcacaagcagttcaggggaaaatttgcaactgtttgaaaagagcgttggatttcctcttgtcctgaatgagtatatttttctttgcctgcactatttcctggtgctttaatgtttaataaatgtgatattcaaagtcctatcccaggattcgcaccccttctctcagcccatccaaaagtgtataccatatatgctattgcctgctgcacgtctcttctgcaacgtcttcaaaacatctcacttaccaaggccaaactgcattttggatctctctctccccagtcctacaaatctgttcctcctcctactttcttttatggatggcttctgaacacccagatgaattcggcagaaacctggtagtcattctttgtcattttgcttttcctcatcataccttccccatgcaattcattgctgagtcctgctgtttccacctcaaattcgtattcgaaatccacaagctgctcaccacctgcagggccaccattttagctctggccaccatcagccaccagcaggtcaacagcaatagcctcctggcaaggacactctgcttccacatgagcccgcttcaaattcatcagctccttcagtatttttaattctaaatttaaacaactcactctccccttagagaaaagtgccaaatccttgccttagcctacaagcccttgcatgattggattcctgcctatttctctgacttctggacctactttacttacttcacactcacagcactccagccacactgactaaattgcagtatttggaatgcacatggctcagggcctttgcacatgctgtgtttttgcctgcattgcacaccctcctgcccctcaacttcacccaactcctattcaaacatttaagtttttagctttaaacaccttccctttaaatcacatccttgctgaaactctcacagcaatctgttttattttttcttcatagcactgaccatacgatggcatgaaactaattagtttgttacctcctcctattagaatctacgttgcaagaggcaagaaagccatatctctctctctggttgactgactaaatcaatgaatgattctaacaagtaaatattgtaatcctcattttttagatgcaaggactaaggttcagggattgtttctgactgtcctaaatcctaccaactgtaagatcgtagagcagagattcaaatctaagtctttctgaatccaaagcctgtggtctctatcccactgttatatgtgtcaactattttgccaaaagccaatctacagccctctatactttttttggggtgggggtgggtgttcatttctcttctccttctatatttagaacctttgttttgtaactttttttttttacttatttaaattctttttttaacatttattaagttcaggggtcatgtgctggtttgctacataggtaaacttgtgtcatggaggtttattggacagtttatttcatcacccaggtattaagtctagtactcattatttttcctgatcctctccctcctctcaccctccaccctccaataagccccattgtgtgtcgttcccctctctgtgtttatgtgttctcatcatttagctcccacttatgggtgagaacatgtggtgtttggttttctgtttctgtgctagtttgctaaggatgatggcatccagctccatccaagttcctgcaaaggacatgatcttgttcttttttacagctgtgtagttctccatggtatatatgtaccacattttctttaactagtctatcattgatggacatttagtttgattccatgtctttgctattgcaaattttgtgcaggcctccacatacagcttacacaggcctccagatcaccctgagttgagtactattatgatccctgtttatggatgaggaaactgaggcaaagagtgtttaagaggcatgccccaggaaacataggctattgcagcactgtaatttgaaccagactgactcctccacagtttttaactaggaatccaacctgccttccataatatgctcccagtttccttctgacacacttgagcatggcacaggccactaccagcttcttgatggcctgcttccctctccattccctcctcttgccctcctctgtgctggattcccaagactggcaaagatcattttccacttgctcttagtggcttctgtctagattcagccagtagaaggcagtaactggaacctgcaagatgggaggaagagaaaattcagggtgcttctcctcctgctctttgctttgggtggtgtcttaggcagtggttttatcttctctttgcttttatctctctctgaatgtatatccctctgtggctctggctaaccacagtgactgtggtctaatagtagttagtgactagtggtctatctgatagtggttagtgactagtgttctaatagtggttagtgactagtggtctatctgatagtgattggtgactgactagtggtctatctggtaatggttagtgactagtagtctatttgataacagttagtgactagtggtctatctgctaatggttagtgactaatggcctatttgatagtggtcagtgactagtggtctttctgataatggttagtaactagtgctctatctgatagtggttagtgactagtagtctatctgacaacagttagtactagtggtctccaagttcataccagtgcactagtagtctggagggacaaaaggaagaggtgggagagccttcttgttgttgctaatatctgagtagcttactgttcactgtatttgacttttctgctcttctaaaacctttgtcacaagttctttgtatattaaatctcctctatagaacacctggcatcctggcacaggctctaatcactgctattgaagtgcccacctggctttcctattccttaaacctgaattaaagaaggtttaagatggatcagagacctgcaggctgcacagtcaacagtggtgttttgctgggagcaaaaagccatgacaaaaacccctttgggcttcatttcctttctacaccccagggtacctttaggacatggaggctgtgatgagcaaagtgataccctaatgacactgaagaattaacacagcttccagaggtgttaaatgtacaactggggactggctaattaggagggagaatctctctcactagaaagcatcatctttaattagagtggaaaaggtggcaatccaaggaggttccacaagtgtgtttgaggggagcctcatggctgcagtcttgcactccctgattctgccctcccaactttgggtcttgtcaccttggtgcccatgattaggaggtgggagggataagagcacccacagaagttcctgaagcatttctgagctgctgaagcacacctcctgctaccccaggactccttatcctaagtggcaagaatcattctcccagaagtgatcccagacaaatcacaatccctcctcatcctccccaaagcaaagaaaaagaaaagagccagcatgataccagccccaagccagtattttaatacattaatatgttatcacagagaattcagcatcataatgagattcatgacacaatgaatccactgattactaaaagtttccaaaagtgtaaaaatcggttcccactcccccacactgagttctttaaaaaatgtctgtaatgtagaatgggaataaataaagagtgattgaatgcctttctctagctggggtatcatccctgatgttatcaattttaatagctacttaaatatgtcaagatctatttaagttcagacaagcacaactaacactcaagtcagttctttagaactagaatgactagatttgggtgatactaagtaaatttgggcttatgtttttttctgagcaaatgaactgaaataattataaaattgaaacattttataaggtgacactggtgcatttaattgtatgaaatttacagtgtagaaaatgtaatcattttattcagtagtccatggtgtaattaagactattcttttgaggtatcttgtatttatgattttcctcttccacctggatgagatgtctcaaattcaaaattatacatcaattaggtatagtctcaggattatttttaaggggactgttttctaatatcatgtatatttctgactttcttatccacagagaagctttcacaatcagaagtttgcagaaacagaagtggggacatggatagtcctctggacactttccattttattcaggaaagggaccacacacgatgaaccacaatttagtaataaagtaatgtttcagcacacagtgtgtgatgtgcagtaaagatccttttaaattcccatcagagcacacaccatgaactgtgctaatggatgtaacacattttacaaaatctgcatgtgtgaggcttttccatcctgttttaagtggggcaatgtatataaataatagatattagcaattaagcatctattactatgcactcatttatacatttgaaaataaattagccacaaactacatgaaagtggatgcagtattctcttttcccttctgttttccctgctgttcctgaaagatatttctgtatttatctcagtacgaacaatgaccccagctctcaatttctgcatccttaaattaattacaattactatcgaaaattctctaaaatggagtgagtctgacttaactcttgttttccttgttgtttgctgtttaggataatgagagtttcttatcactctttgtgggtcttaggttggcttcttttcctttctcttttatccaggtaccaaaagctcttacttcaccggggagatttttcacacgggaggaaaaggacaagtggactatcacctaggtggtcagcttacaacctgaatttcttggaaatgacctaatttaattatcttcatggatctcctttgctctttgaatgaagagtagtcagctattttctttctttttttttttttgaatggggctcttgagtgtcagttgccattttaatgaagtagtgatttgggccctttcctgataatacaagagttaggtgtcatgctagttggcttggcccctcttattcctccagtatccctgataggtcagatcagagtgattctggagggaaagtatgtttcactgtggatatgtacaatggcaattcccagttctgggatttaacttaattcaattattcacatgatgagtagcatccacacactcctggtaaaatttgataaaatgctgtagcatcaagatgcttttgtagaggcctctctgccattacctgttttcttgactggcattaatctctaccaaagctagagacttgagcatcatcctgaattcagagtcataatctgatagctacaggtcaaagttggcccaacgatgtgttgttgggagtaccttgagctttgaaaaaataaataaaagtaattatcaaccctggaaaacttagaaattttacataacactcctggtctctggattttcttggaaaacttcaatatctggcaactctggccctgtatttccttctggcaacaatcagctggtactgtgtcgaggtagtgacatttagatgagccatgtgctctccagcttgccatagtcctcaccaatccctgttgtttacttccagcctacttagtattcatattatctgcaggcaactacaggcaattaagcctgtagtttctggcctaaagcattcatgacaacatgtgcacaagacaccacatacataatatatgatagaaatcttccttactttctaaaaatgtaatcacaatcatggctgaaattgagtaccttctgtgtaccaacttttgtactaggtgctttatacgttatttttttttgatccccaacataccccatggtgtgaactagcctatcatataatcagagactaaaatttagagatggtaaatttaaaaaacgtgtccagtactgtacagttaatagacttcagaggcagaagtgaaactgatgtgattccaaaggtgctgttattcaaagtttatttaatcttttttcttattttcaaaaagtaaatatgtatttaaatgtagaccagaaaccataccttgttacattttcctttgagaaactccaggctttctttaaatgctaatgtagatactgaacactacaaaatcttgaatggtttttctcctgtaaaggtcattgcaaagttaacctaagtaaaattccatatcttggtgtggagtccataattttgaactttgtttggctgattgtttatttagcaccaaaacaatttgaaattggctttgcaaacgaaatgtactctttatgtcatatatagggatgattgggtctaggtttgcactgatcaggatgcctatggataatacccaggggaaccactcctttctcatagattgctgatgagattgcttaatctcatagattaagatgtaaacatcttaattttttatgctgtctatatttatatatttccggcattttaatactatttctctctgccttcttttctctgactagagttatagactgaatagttccatgtctgaggagagaaagaagtttgccatttttctttatctgcctcatagccccatagcaataatgattatgttccaccccagctatttaaaacatgttgcctctgattcccagctttgagagcaaacaatctgccaagcgcctcataactgcaaagtgaccttgacatatgtcattcaccagagttttcaaatcgaagtcttcgtgtttaatattcataaggactttttttttcctaacagcatatgtgatgattttacaggggatgggggttgggagctttatttagagatgggttgaattctgagaaacataccatcagtgtctctgtgatgaactgaagtatcagtttggaggtaagaaaatgttgtttggcattcttcaagggaggacagtgatgtgctggattctgacagttttttctcattggggttttccttggctggtccatctgtgatattgaagtcagatactgaatttataacaatagcattaatgggtttctcatctgcatgctttgcattcgtgagttgcgtatctagaggaaaaaagaaaaaacacatacagaaacccactatggtttacgtgacctagtgacctaagaatgcagaaattttcacatttgactttcctaagattaaagtcttaagaaaacaaatgaagtattattgagcaagacaattttgaataaaaatatgagaaagaagagtgcaatcattataaaattttatacacattgcaaactttacctatcatggtaatttgtaacacttatttctacttttttttttttttttggtaataagtagggagaatcaagcaattcattcacttggatcaacaaaatctcatagtacattgtcagcctcctgtcacagagtattattaatctgaggaaaaggataaggatcttatgtggtgggcaatactgctgagttattcatatgagctcaatcaagtcactttattactttgtttttacaaacctcattttcctcctctgtaaaaagaaaaatgcatataaatgaatagtctataagctcattcctgcttctgtcctcataacctcacagtggctttctctgccttggtatttaagttcctattcaggtgatagcctgtatggctttggggatatgcttcttgggaacatgctttatttccacataactgtctggcacaatagctagagatgttcagggaatttctagcgaagttcttgactgaaattctggtttggagagccatagagaaggctgagaagccccaagcgttgtatgtattttacatctcctatacagttggccctccgtatctgtgggtttcacatccccaatacaacaaatcctagatacacagattgaaaatattcagaaaaagctccccaaataacaatgtaacaataaaaatgatacaaataaaaaacaatacagtataacaaccacttacatagcatttacatagtattaggtatgataaataatctaaaggtcaagtaaagtatatgggaggatatgcataggttatatgcaaataccacatcattttatattagagacctgagcatctgaaaatttcgatatctgtggagtcctggaaccagttcccctcagacactgagggacaactgtatgcattctcctgccatgtaatgattgggagtctgctctgcaacaagcgctgggctgtatattggggatagagggatgactaagacaggcgtggaccttgaccttcatgagcatcaaacaaatcgtcaaagaaataactgaaagttacaggattgagaagtgtataaaagagaagcatatcataaaatcatgttagagagaggaccagactgggtcatggtgcagttagcttataacttccttacaggctgatgatgcccaggaacaacttaaaacctgaacaagcaacagtcctcgtggtttggtggcacaactgggacgtggtcaagaggtgtccttgggaattgcattcccattgttaacgcaatgcctggttggttcaataatgctcattgagttactgaaattgataatacaattggcaacctggtttgattttaccatgcttatgcagctcagtgcaaggaacatattcttgccaagtccatctttatttccctttccaaggttgtttcttagtttagggccaatggaaatgtctagtgggttctgctttctaaggcaatgggttctagacttttctgcagagtagaatcacctggaaaatctttttaaaattcagaatttttaaagctctggtattcccctattcaggagaccaattaaatcacaatccttggtgggatgggagaatttttgaagctcctcaggtgattccgacatgtagacaagtttgggaaccacgatgccagggatcttctgcatttgagacaagaaaaagagagagaacagcccactgacttgtgcatcagtgattttcagaaaccaatcttaagatggttgctttccaaagactcctaactggcaccagaactatcagtctggtaatacacaactgtcttaggtcatttttgtttctttctgatcctccaaacagccttggttttcaacagtgtttaatttctattctcttccttttatgtgctggctttaaatttcttggttgtggtttcatccaccataaaagggattggcagaaatagggattcaagaaaacatctgtcgttgaaagcaattaatgtagtattgaatattgaagtggaatcagccctacagatgagagaacactaggcttcctctaacccaagagggattcaccaaattaatgatataatgatgatgatggtgatgaaaatcataattagtttatttttcttacttgggtatcaaggcatccagtaatcagctaatattgcagatagatggacattcaaatgatgtcttagaacactaagaacagcatcaatattttgggccagataattttttggcatggagagattgtaggatgtttagtggtatcgtagtcttttatccactagatgctagtagcacctgaccctctagctcatgacaatgaaaaatgtttgtagatattgctgcatttcccttgtgggacaaaatcactgtggttgaaaagcactgctttacacacacacacacgaacacacacagagtggcgtgtatcttatgtcaagttctatgttaccgcttatataccttattgaacttaagcatcacaaagagtctaggaggtagatattgttagcctccttgaacagatgggaaatgtatgaatgggtatccccagttagcagatgaatgaaggtaaccaaggcttacagagtttatttaggtaaattgtccaaggcctcctccttattcagtagtagaactgagattcaaatctaggcctggtagattccaaaagctttgtgcttgtccttttcccttttatattatgcaatgttttctctgatttattcttagcttttatctctccttcctaactgctgagactgcacatcagcaaaacctcctcaccctaaatactgtgatgtgtcacctgcccaaaatcgagccttgcaaatagctgggttttacacactcgcctttcccttagcagtctttgcaaagcaaaactaccttctttgcacactcagggaatccttcttgttccattacagctgctttatcccatacattagagagtagctcagaaagagctgatagataacgagaccttgatgagtatggagattgcagcagctatttacttaacagaattaattaacaatcagttcaaattatcacacgtagtcaggctgcatgtaatttaaattgcttttgcacaaagtaattcagtaacaaaaaaaagttggatagaggttactggaatgtaagaacatgcggcgaatacagtatacagccaagtggtatatgattctctttttaattttgtgacaattttaagtatagcattttgaatgtaagtggtgtgctacattaagcaaccatttggagcacactaggcttgtactgagagaattttatggagaagttaaactgccattcataaagttattttaattctatatctctgtttatatttttattttttctcattcctcagtgggaactatctgttgctcattagaaaatcatctgacatacacacatttgagaacccagtctgttcaacccagaattctgacatctgaagtgagtcacaatttttgggtgaatgttactgacatcttccatcttttatagatgatgctaacaataatttcatcagattcagattccttcctttattgtattattcgacattgcacccaaagtactgtaaagtagcataagctcaaagtagaaacataaaaagtagtgtcatatcttctgtagagaaaattattttagagttaaataaggaactcgtgaaactatatttgggatgttattcatagttcttgacattaatttagagaaaataatttttaccaatagttaaaaacaaaccaaaattaggacaaaaaatagaagctcatctatatttcttggaaaaaaattaaagtgaatgttaaacagtttgggctacaggtaattgcaagaacaaatggacataaacttaagtcagagaaaagatagacagctagttaagtttttattactgttgagcaaatgttattaatttaattcaattaacatttattgagtacccacatgcaacagatgaatcaatgtgacaggagctattaatttatttactctaagttattaagaaaacgttttaatgattttcatttttgatcactaaatgtgactttgtaatttttgcatccatgttttctctcatttgactcttcatagataaaagcattcaaatgatgaataagtactaggtcctctgattctattcttgtttcttcctttcttttcccattttcctttcccttcttttttcttttccttttcctttcccccttcctttcacttcctttcctttccctttttccttttccttcctttctgcttttctttctccattcccttccctttgcccttcccttcccttccctttgcctttcccttccctttccttcctttcccttcccttccttttgcccttcccttccctttgcccttcccttccctttccttcctttcccttcccttccttttgcccttcccttccctttgcccttcccttcccttcccttcctttcccttcccttccctttgcccttcccttcccttcctttcccttcccttcccttccctttgcccttcccttcccttcccttccctttgcccttcccttcccttcccttccctttgcccttcccttcccttcccttcctttcccttcccttccctttgcctttcccttccctttccttcctttcccttcccttccctttgcctttcccttcccttccctttcccttccctttccttcctttcccttcccttccctttgcccttcccttcccttcctttcctttctctttttcctttttcttcctttctgcttttctttctccctttcctttcctctcctttcctttcttttcctttccttacccttcccttcccttccctttttcctttttccttttccttcctttctgcttttctttctcccttcccttcccttcttcccttccctttgtcctttcctttcctttgtcctttccttctccctctctggtgtaattccttgactgacctagcccatctccattatcagcttctgctatcctccagctccttccatgtattttttccttaagactttgtcctcttagtttctttcttcctaccctgcccttgaaggccgtatttgtccacactcacatcgtcattgatttctttgtgaagttggccactaaatcttcatccagccatccaaagatgcaggcaatatttgccaagcataaactacactcctggcactgcgctaaccactgcagaattcagagaagcacaacaaatggtttcagtcctcaagaagctcacagtaatcacaaattacagcttcacacttgtaactgtctattggacattttttgtgggtaactagcgaaatcctttcaattatgatgcctctttctactaagcccctcattcttctccccaaactggaataactctggctatccctggagaattcacagttcaatttgtctttattgtattgtcatttttccagttccctgggcttaaaactattatttgactggccctgtccctccatccaatcatttacaagttcttatttattcttcctactaaacatctctcaagtccgtgtctgctttttcatttccattactgccactcagatttaatcttctctgccctcacatctggactctttttcagcagtcattggctctgaatacagtgacaactctcttcaagatatcttatgcattataatcaaaattatactttggacaatattcttctcgtcatattagtcataaagaaagcaaaacacacacatcatgaacacacacacacaagtattaatggctcactattacctgaatattttcccattttctctctctttttttgagacagggtctcactctgtcacccaggctggagtgcagtggtggtggtgcaatcacagttcactgcagcttcaacctcccagactcaggtgatcctcccatctcagtctcctgagtagcaggcactataggcgtgcaccaacacagcaagcttattatagtattattattatttgtattttgtgcagagactcggtttcaccatgctgcctgggctggtcttgaattcctgggctcaagggattcacctgccttggcctcccaaagtgctaggattacaggcatgagccaccatgtctggccttcattctctctccctcctctgtctctctttattttgtttttctttatagagacaggttcttgatatgttcccaggctggactagagctcctgggctcaagtgatcctttcacctcagcctcctgagtagatctttttattctcatttaacctacaaattctattgccaagttgcctgtggaaacaggtagcttgttgctaagtttttcttgtgagcagtaaactccagaagagtatatgaaaattattagataagactttaaggtagggtgattttaattttagttctaggccaaaacatttaaaatgagtgtatatttcaaacgtatagaccattttttaagctataatggtgaattatgttttcccttggatttaaactatactccagcttagaatttagtactgtagttatccgtggctgaaatcagaccaaggcagacaagtgacatttcaaggtataagctaccaaaccattaacaaattattgtggttagtaaaaggagttaattgaagtgacactgtatagagaaaaaaagtttttttcctttgtatgaaaattttgtgaagttcattcaaatgttagaggtgatttttgttgttaaaatgtatgattatactctctgcagcttggtaggtaataatacaatatataaaatacaggaaatcattcaacatgatcaaacgtggtgaaaattatcagccagggtcagaatcatctttctttacatgtgtagatcactattatttttatattgagtaaaatttgaaaacatactatggctgaagacagaacaaaattaggaagaggaagatttcttgacattgagaaaagcataataaaaggtgattgatacccaaagaagctatgttttcaagaaaaaatatattttcttctttgaaagctgggtaataaagctgagtggataattttctccagttgagggatgaaggcttctaaaatttcctcacctttttgaaatgaatggaaataagtaactatggagtattcaattgctacatcctgatagattggataagacaaaaccttgggttcattaaatctaattggggagggaggataaataagatacatatatttgacattttttctttaattttcaaatggcagctctggttggaagacgtcctttaaagactttcaagttaaagtcacagtcgtataaatcgttgttttgatttgtcttctgtagcacttcaactaaaaccctgcctcaagaaacgttagatgaaatgtttatcaagggctacgacaagaggacattttaagccttttcaatcaggcttggtaaatcttttttaaaaagagagaaaaggctaaagtatattattcctccagaaataatagaagtgagtgttcaaggtgaaaaggattaaagagtacaaaagaactgagggaagaaggctgagcatggccccctccccaagcttccccaacacctgcaaagcaacttcaatttttgggggctgaagtgggcttttttttttttttatctaactattctggataattacttcagttttctgcccgccactatactttgcacctgtagacagacataggctaagtgatgtacttttatagctagatcataagctggtaacgaggaacaattgactcctaagagatagttgaatcttcttcagacatgaaagcagtttgcaattatgagtctccatttcatttttatgcagttaccttcagtttaatgtttgtaaaaagtgtctcaagaaataaagattatgttatctgagaaaaaaatagttagcagtttttatagtttgatgcacttggattaataataggtttagggctctgaaaaaataaatgaagccaatcaggctataaactcatgcatgattggtattacatatacagtcaatttttttactatcagtgtttaaatataaatgttaaaaataaaccataattattcaaaatattctctattatgttaaaaccatcacaatttattcatccgaactatttgaatgtcacttaaagtctcttatgtgcattatcacatttgaagctcacaacagttttgcaaagtattattatcattattacatgaatgaggaaactgatagagggtcagagattttagtggtttgcccaagattaccccgctggtaaggggcagagctagtacttgaacttacgtcttctaattcctatggcagtcagactttgcatttcgaaactgcttcagaaacgaagcactctgatatgagcttgagatacttttctgaaataaaactgctttgtcccttctgacttacccctctccaggttaattgatcctgctggtatttgattaggaggtactttttatgtaggttcaaacctagaattcctatttgataactaataactgctttttccaaacttagccctcaaagcccactataagaagcttcctacaactgtcccctgcaactccaatcccaattgtttcctttgggagcccccagaaatccaggttgatatccttactagatcccttagtttagtttatagtactgtgattaattttggatgtatttctcctctcctttctgttgtgaactccttgaggaaatacataagccattcagctcaatttctcagaacctagcatggtgtctggcagaaagcaagtaataaatacattttagccaactgatgaactgacagactaaaggtggcgtgtcttggttttcagttgacaatggactcatccttaggggaggttttctgagtacatcccagtggtcctctttccacattctctgtagactaactgatcctagtaaaagtctataaatttctgtcttttgtggtaaaacacatcttggtattttattttgatttgaatgcaacatttgcattgatatctgtagaactgtgaaaatacaaaaagatacaaataaattaaaatctataattctaccattttaaacacattgttatatttgtttcacaaaaatgtaaatatctggtatatgtggaatttatgtttatagatgtatatgtatatatctacatatttatatttatgctttatatttgcatattaggatatatattctaattctactttatatataaatccatatacaattagaatatatatcaacataattagattaataacaaatatactattctaattagatatctgattaatactacatattctaattataatttatatatatatataaacttgtagtgcttcctagatgtcattcatttttctaagagttttgcatatattaacccatttaatactcccagcaaccctatgtggtaggtactgctagtgtcattcccatttttcacatgaggacacagaaaacgcggggatatcaaataacttacccagagtcacataactagtaagtgatggagctagaattttaactaaggcagcctggctccaagtccatgttcctaactaataggctatactatctagatagagattttttaagtggaattttattgaatataatgtattatagatgttaccgttgtatagtaaccatttcccttcatcctaaagcttattgaaaaacatactcaggtctctgctcaaatgtcacctcctgggtgaggcaggccttcccttacctgacatcaaaaacagtgcttcccaatcagggcagattttgccccccaagggaatggatatttggcaatgtctggagataatgtttattgttatgactgggctagatgcgctagcattttgtgggtggaggccagggatgctgctgaacaacctattatgcacagggaccccttcccctcaccaccaaaacccataaaaaatgtggtttcaaatgtcaattgtgccaagattcagaaatcctttaatctcatagccctgatcaccagccattgctatcacatcactctttcatttttctgcacagtgatttttaaaaatattttatttgtttacttgcttatggtgtacatgtatttcccacccttgaccaaaatgctgcctaatgaaagtttgtctgtgtcaattaactgctatatcctaaaagaggacctgggagaccgtaggtactcaacatacagggaattaaagaatgcttagcatttcttacatggtgaatcataagctaacagttcccccattcagtacaaacgtagatagtttctattttttgataccatgaatactcttgaaataagcattgttgtcatgattttaaaatatttattgatttgtgtaggttgaattaatagaaaaggacctattgaattaatggttgaatttctcaagcttttaatataatttgctaattgccttccagaaagattgcgtccatatagacttgtaccaagagggattgggagaagtttgtctatgctctgagctttctaggttttaccactaaaatattttatttttatcaatttaaaaggaactttgatttaagtgtccaatttttcctagagctgaaaaaacagtttttcactgtaagaggtagaaggtgttttcatatccaccacctttctgtggaagttttgtttcacaactagattcattggtaatctgaaatctcttgcatgatatcgaattgggcagttaaggacatccattctgtatttataaatcagtaaattagtgttgaaaaatacttactgaatgatcattgaacctggtttatttagctagttctgtctctgagttatgagggcttgggggtgacatactgttggatggacttaagaggctccctatcagcatctatcaggttaatatccatttgtgatgtgcctgtataaatgtaggatagaaataagatgtatacagaggccttggagaggccagaaatcaagccacatttttggaaggacaagaaatcacaggagcgagggaacagaggagcaaatcatatgcttatttttaaactccttttgcccactctgtgtgcccaatgaactatggaatctatcaaaaggcctcactggggatttaagatctattttcttgatagtccacttggtggaaatttagcccagtggtctccaaagtggcatatgtatacctggaggaggtgcaaacctatgcaatggggttaaaacacttatttctatttttaaatcctaatatgataactatttctgcatgttttataacgtatagtacagtgaatatggtagcatgtgcctccattgtgtatgcatgtgcacatggatgtatatagatgcatataggcatgcattaggtgggcttgctatttttcccttttttactagtaaaggtttataagctttacagtaaaaaatctggagaccactggtctgagtaatagactgaggtcagtactctacatccctcttttactaaaaaaattcaattttcttttgcttcctttcggtacccagggtgtggttgctggaacgtttacagccacagcagctgcagtagtggcctgagtagacttttcctcagagtttctatagtggtaacaggattaacagactctattctggaagtacttgggtggcataacacctcccagcagaactattcctgacaaggatgtgcagatggaaatgcatatttatgtcacttaaagcctacaagagacacaaggatttgagctataacaataaatagaaaaaaaaattcttcagcatttttggtaacccatactcaagtgcattgactgtgcttggcgaaagacctacagtttgctctttgtccaagcataaaatattcagcattcaagcatgttgaggtgaactattctgaatatattttagagtgttaaaataagctaccacaaagttagtttaaaatttcaggtcttaaaaataacaggacaattttatgaagtgtttgggccatttcaagaaaaaaaaagtcccctttaaaaaagaatgttcatttgttccaatttttagtaaaggcaggtttaaaaaaattatttctaaacaccaaatagtcattatagtcaaggctttcaagtttaaggtattgtctgcatcacagtccttgaaacagcctctcctagctttcttctaaaacacctttaaaaatatggaaaaacaagaatgctcacatctgcaaatttgggtttgatagtattgggaaagatttacactaaatatcaacccattagaattgaactgaataatccaatcagtctagcacttacagagctctgctgaaagtagaatggaattagtgttgttttctgcatgctcccgattcacaaaccatattttgtgtcaacaagaaaattaggctgttaagtttttttagaggtgttgatttttgatgtgaccaagagagctgtagttctttgtcaccttaactgatccagaaataatttgttaccataaacagaagaaatttttcaaaaattgtgcaaggttttcattagattgcaagaataagtttgtaaagaaaagagaaatactgagaaataatcttaaggatcaaacaaattgggatgaaaaaccaacagaatggatccaaagggacatgtgtgaaccaagagagatactgaagaattcaaaattgaaatgacagaattaaaatctgcatcagaagcagtaaaatacagaattgacactgcagaaaatatcattagtaacacagagattaagagcaattctgaaactctcccacagttcaaaagtgaaggacaaagaattcaagttatgatggcaaaatgatgccaaactcaaaggtcagaacatacagatctcacctaagagatacagtttcctggagaagaaaccaaaaccatctaagcataagcgttgttcaaagatggtactgcgatgtatttcctgagcagaaacaatttctgagagtgtgctccactgcctaaaatttagtaaaaagagacccacaattctaaaaaatattttgaattacaaaaataaagaaaagatttttcaagtacccaggcaaggaaaactagatcaaatgagaaataactgttcctgaagctggcctcaaattttttttgtacaaaactaagcatcagaaaacagtggtgagatgtattaaaattttgagagaataaggttatattccatgaattttatcctcagtttgtcttttctgtgtgagagtacaatagtctcatgtattatcagaagaaaatatgccgcattaaaaaaactttcttgaggctaggctcagtgtctcatgcctgtaatcccagtgctttgggaggccgaggtgagaggataacttggctccaggagtttgaagctgcagtgctgcagtgagctatgatggcaccactccactccacctgggagacagagcaagaccttacctcttaaaaaaaaaaattacttcaagttatatttttgctgactgacagcaaaaattaagaactggtgcacaatttctaactggtacaaaattgaatttactaccaaagcactgaagtgaatttcaacatacaaaactaaccctggttggaaacatagtcaggacccaggaagtatgttagtgtgttgaggtgtttggtctccctttagaatggcatctgggtatcatgtatgaggaaaccttcaacaattaatttttattcaacaaatatttgctgactgctactgtatcaggcagtgaaaatatggggatgaataaaatcctttgcccacccttatgaagatttcagtctctctgaagcgttcctagacttgcacaaaagaaggtcatttccttttttgtgcttccatgacattcagttgtaagtgtgtctttcccaccatcagggaggggaaccatgccttggcattcctgagcttagcacagggcttggcgtaaagggtgaatgaatgtagtagctatgcatcagcttactaagtggtaggtaatgacatgttttaaatctggttctaaggctgctagtctatttgctttttcccatattatattgcatctaaaccaggtacaacaataactagcactggtgaaatattttcagatgagaaattttcagacgtgaagttctttggaaactgaatagaagtataaaattttagatgtggaataaaccgtagatgtcagtgagtttcctctcccacatacccattcatccattcatttattcattagtgcctgctataataataaaaataatgatagctaacattcacttcacactatgagaagctttgcctaagtgctttaaatgaattctcatttaatcttcacaaaaacccaatgcggaagttattatacgttcaattttcctagtgaggagaatacatcttagagaagaagggcgctgtgccttattcattgcttttttactaaactggtaaagattaggaggaagaatttgaatttgggcatttggattctacagcctttcctcttaaccaccgtgatatatgcaggagatacaaagatgaatgaggcctggttgagccctcaggagctttatggcctatttaaaggagaaacacatgtcaacagatagcttacctacaggcattccttctgtgctgtctctaacctgattttggaaaccagtataattcccctgaatgacaagtgactggtcaatgatgccaaggttcaaatggaaggggaaaaaggacaatgaggtagatcttggatgataaggaaatttggctgttgtcccaatccttgggaccgtgattatatcgagcatcattgttaaggtggtcttgccatttacaggacattgctaaattttttggctggggcaaaagtaattgaggttttgtcgttactttcaattggaaaaaccgcaatttgtgccaacccaatagataatgagtgttagtactcatcctatcagttgggtagattagtcacctcattcccttttaagcaccttgatcaattaggttgtcatagaaaaatgtcaagtgttccataggcgagtgctttggctctatcccacttagtaaataacaacaacaatattaaccattgccacacccaccctttatcctttaggtttctcccagtgcttttatgttccacagcttctccctgtctccccaggcttacacaggcaaaggtattctgctggtctctttctctgaaaatctaaggcaggtgaacagtcagagccttggagaattgtgggtttgggtaaaattcatacttgcttttggcaactggagatgaagactctttgaaacttcaggtcctctactttggaagttcttctgtgttaccatgaagataaaactactcattttagctcattgctaagagctcattggcatttttatttttgtcaaatgagttatagaaaactatacattttaaatctattttaataattggtatttatggatttgtttgtgtctatgtgcttacaagttagcactttggataggttggttttcggtaaagcaattcttcactactgctagatctgctttgggctaatctcacttaaattgaattccaaataaatttgaagagactcaaaagggttgaaaacagtaatagaaattccaaaagaataatacttaagatggaaccttagggcctcctaggttactcagacatccttaccacttagctaatggactattcaaacctgaagtgagccagccatactttgtacaaagttgtctcttggtgatagaaactggtataaatatacaggtgcctcctattaaataattgtggtagactggaaagagtatttcctccctaagatagctccataagtcattagaagatactgctgatgttttaaaggaatgctatttgctattgtcaaggtcaatctgagaggaatgccttttcaggtgatcagcttggtaagcccaaatggtatacctacataatttatatatcatgacctggagtgcttgttgaaacacatattgctatgttatactttcagaatgtctgattctgtgagtatgagttaggggcaggcttcaaatttcagatacattatattaaacaaagagtgatggaaaatgtggcaagtcttatggccaaccctctgacacctgcttctgatgattgtcattgttctatactactctttacgtctatttgtaacagggtgctaacatgtgaaagtgacactttttgtctaagttttcccttattgtgctcttatttgtgagccacaaagcaatcgaaactcagagagatgaagttatttagccaaggtcacacagtcaagactcaactcacttttttttctgactcccaagccctatctcttaccaccacctatctctgcacagattccttaaaaatcaactgagatgagtgcagagcactgatataaacactcatatccagtattttgagcctacatatgtttaagaaaatgagatagaattaaaaatgattccattttttccttcctgagcaaaagttactcttgtagatttcaaggaaactagcgcagtgcctcaatttggaaaggctgaggttgtctcccccaccaaaaatgagaacttgattgaaaaattattgtccttcgggcaggtacaatgagtcttacaggctatttcctggtaccctgtcacaggttcattcccaagacttaagtctgaaaaatttcttttcccaagttatttcccagttttaagagcatcctagaacaggaccaggtcagctccaagctggttgcatgcaatcaatttaattcacatacaaatgaacgttagctgctttggatttcttttaatggtttttctcagaggtgaatttgcttttaggcacccttttagacttaatcttttttctccctttatcgtgctctttctcttactctgcttcatcaatctaacttttgtactctcctctccccccacccttttggttttgtttctttcttgactataacctgatatgctatctctattggaaatatgcaagactgcagtatctacagtctttatatatttccccatatatcttgatctctattctttatcacagtagatactgtaacaaacaccaggttagtgtaaaatccaaatccctgtgtgtatctttatcactaacaagcagagggaaaataattgaatgtggatgaaactggattcgtagactttggtaaatagccaaaatatattttcttctcagtttataagtaggctgattcgaagtcccagccaaggtttctacatgcacctgacatgttgcactctttctcagtcctccaagcacactgcaatggtggataaatccaatacatttggagagatgactccatgctgcagcggatggtgcaaacttccatggctgagctgctttatttcattatgttctcctacctattctagaagccctttggatgggctccagatgttctataaaaggtggcccttttttaaagaaaagcgcttcattctcttgttggcagcacttaatgagtgtgttctctgaagataggaaagcaccctgcagaggatacatttaacacaacactataatttccgcaatgctcactaagtgtctgactttacaactgcccctttggcttctcaagtgccagaggcagtaacggggtcagttagagagcttcctgcaatacttgggaatccactctctgagacccgtggagttaaatatcaggagaaaattcacccttggttttttttttaattcatttaaccattgcgctcggcaaaatgctatttccaattttgcgctctattaaaacattgcagttgataatatcactgtaatttttgcagtttccccccccacacctcacccatccaacaaagaaaggagatggctgaaaatgtatgttaagtgaaaacataatattataccctcttttccttttgcaaagtgtggtgaaacagattcattagttttgactaaatacaaggttttcatgaggattttggataggtgacatgacaatgttgatacgtgtactcaagacaatggaggttaaaactgtttggaaaatatatttctctaatatatcttgggtgttggaaagttacagaataaatatatggtagatctttctccatataagaaaggaattttcaaagcaagtacatcctttcatgaaacaccttttgtgccatgatgaactagtccacaaaagaaattttattttttggtttaataagagaaatgtataatactgatatgtcaatatgtttttcaataaacttttccccagattttcttgaattctcttcagtgtgagaattataattatatgtcttcctcccacttggaaagtggcacaaggtgctcatttgcagagttctgccgttcaagtcgctagaatagaaatgtcatgactcagttaacaatgctttattattcacattgatctttttttatagtgttctttatctcaaaaacattgtaaatcagatatctacctcccactcttttgttcatttgcaaatttctattattctagtttaagaaagcaacggtgtgtcaagagtcagtgtatactgtttatattctccctgcttcaaaatccttttctctgtaaaagtgaagatgctagaagcatgcctaattccaagttctctaaacacattcacaagaaacactgtttcccttctagatcaaaagcagtttagtgtttcttgaacacccccaaaatgaaacaataaagtagaacgatagtttggtgataagaacaaaaacacttaagatttatgtcttttaaaaaaatgtcatttgtcagttaaagatacatggtggtgccattgttgaaataatgttataatgagctttgtttagacaaacgttgctagtggaaagagttctggcctctgagggcttaagaattatgttatcaaatctttgttccctcgccatctaccaagtggtcttttgatgatgcttacgtcattaacaatgtagacaggatgagacatattgccttaatttttcaattcctctctatattgaagaatatggtaggcattttccaggatggattaatcaacattcacttaaaaaaaataaaagacaacagtggatcacatccctcagaaaacacatacaacatccccacctaatagataaatttgaaggaggacagtaatcagcatttccttcactcattcgataaacatttatgaatcttcataaagtgccaggcaatatactagctgctggtagataatacaaagatgagtaagacctggcctctgctttcggaatttgctcttcaatgtgtgagaggcactcaggtcattttaatagcatgtgatgagacgtataacagaggcacacacacagctttgtggatgcaaagcccaggaatttcctattctgttgggtataatatgcagaagggtgtctcagtgaaattttcactggatctttaaaaattagtgttcaaggctgggcgcagtggctcacgcctgtaatcccaacactttgggaggctgaggcatgtggattacctgaggtcaggagttcgagaccagccttgccaacatggtgaaatcctgtctctattaaaaatacaaaaattagccaggcatggtggcgggtgcctgtaatcccagcttctcgggaggctgaggcaggagaattgcttgagcctgggaagcggaggttgcagtgagccgatatcgtgccactccactccagcctgggcaacagagagagactctgtcttaaaaaaaaaaaaaaaaaaatagtgtgcaatttccaggtggcaattaaaaacaagatattctgaagagaagacaaagtttgtagaatatggaagtgtaaaaaaaatagtgcttagcagagcatggtaagaagtgggatggaaaaggagagaagagggactggtgggaattctgatgaagcttttgatctttacccatagattttttattttagcctatagacaatggagaggcactggagcagtggctcttgattgacaggggatggacctcgaaaaaatacatgcatctttttcctgggaaaatataccatatgcagacatatgatatagattcctttgatccccagcacacaaattatatccaagttcccttaactcctgtgtaagatacttgaaatacaggttaaagcaggactacaacaagatcatatttttgtcttagaaatgccatgatggaggatgaattagaaaggaaatagactggattatagttgttcttatctcactgttctttttaaaattaatctctaaacctattatagtctcctccttatactatattttcctggagaactgtgataacagtctctctagtttgtttttgttttttccataccacttcttactcaagagatgagaatatgtcaagaaaacaatgtgattcaaaatatcaagttctgcaaagaaggcaagtatactttggcaggaaaaacagaccactgactttggcaatatggaggtcattggagacttttgctagaacaatttcgatagagggacaaggctagaagacaaagtgagtgggctgaatgaaggaaaccaaaaataagaaagtgaaaagttgaacatagattactctttcaaaaggtattaggtttttgccattgaaaccgcaattacttttgcaccaacctaataatactacttaacaatttctacaggcttttgagatgccagatagtgttctgaggctttcaatgaataagctctgataattctcccaataactccgtgggataagcactactaccctccatgttttacaaatgaggaggctgaggcacagaaaggtaatacaaactgtgaattataaatgcagatagtagtaagcggcagagctgggatttgaatacaggaagtctggttccagaaaagagcatgagcttttaactaccatggtgcactgcttctgctaaagcaaacttaataggtgaatagtataacattcatagtaagtataatataataaataatattgataatatagtagtataatagtaatataataagcaatataaataatatccaacagagaatcttaatgatatcagattgaataggtcactactactgttaaaataacatgtactaaatagttcaacatttaaaagtgaagaaggtggtaagagttgtctttactgtccttaatttttagaggttttagtatcaagaaaggcattttacagctaatatccactatgctatctactaaaacattgcaagcatgccaagatgctgaagaaaacataacactatattatatattttatgtttcactagaatggaaaatattaaccaaaaaatcttttctttaatcaaagtttcatttgacaagtaattcatcttcaggatagcttttctttcctctcagaaggaattgttgtcttatgactgacgttaggctgccaaaaaaaaaataatgcttcactgatagagattcagaaatagactctgtattttaatatagtacagttttgggagaaggacccctgttatagtttttctaagttctttgtttgtttgtttgttttctaatgtctagattaagtaaatgaaaggaaaatatttcagagtcgacttactggaacctgatgaaacatttaagttttcttactttttttttttttttagtgtggggctaaatgttaaaaattgaaaacaaaataacagttttacatttgatgaaggaaatgtatattcttctcattaattttttcatgaatctttttttttttttactaacaacagtcaagtttcatttgcattctccttttctctacctattaagatggatagctgggttatacctcaaaattccttaattcctttagctaatgctaccaagtgtctattatgtggcagactatgtagtacgtgaggagaaactcagctaaaaggtgtgagttagctttcaaatagcttctagtccaagagcagagtccagtgaagaaacacggagaataccatgtaataaatgctacaacagaggctaatgggataccaatgcagggcaccccacttagcctccacagctaaagaggtcttcccagagaagatgaaccaataactgaattttgaggaagaatagaaaggatgtaccctctcttttatcaaaagcataacactttttgtaaactttaccacaatttttagttatcagcatcttacacatacaagaaaagaaaaggtgtcagaggaggaatggtcaggaagcaagagaaaattccagagatagccaaggagggtgagtgtgtgaaagaatttagtgggcaaccatgtcagtgcctatattaggaatattctgtattcagaatgatccttatttgcatatgctggtatatccgatccttcaaatatggctaaagaagatcattttaattaccctctctttagctcataaagatttatgttggtgacagagactagctagatgctacatagcagaacttgcttcctttttctgggcacacggttaaactatatttttctggttttcttgcatctcagcaggacataaaaatagttctggctgaagggacatgggcagaaatgatgtagctcccttgcatgttaggcctctaaaatatatcacatgattcttcacgttttattctctacttattggccagctgaaaacagaaaatatggtagacaactctgatgagcccctaaaaatgacagagccacaaaatagaaaaagcctggatccctgagtcaccacatggtggaaagcaacctagggatatctatctgcattgagattttggtggccaagaattcacttttattaaatttggatactaaaatttggaggtcaatatttgaaacagctactgtcaatcagcctagctaataacatgttaatttgggatacaacttatatgtgaattaatcaagaatattttggggtatatattatggaattataatgatacaaatatttaatatttattgaattctaagatttgtacaaagtataatatattattatctaattttatcatattaaaagtgctatgtcttagatgctgttgctgccatccccattaaaatggttaagaaattgagctcagggagttggaaatatttacttaagtttatagaattaaaaatggtcaggccgaaattgaaatccatgctatcagacacaagagccatccatttaacagcacattgtctcttactggtagataccataatttacattggacagtgaatgcccttttaagaaagtaaacatagtttaacaccacccaatgcagttcccttcattctgtagacaaacataggagattcatttcactgcaacgaaatttcactgcatagcaatagaaatttttttcaccaggatatcctttcataaaaatctgtgtatatttgagggctggtgtcaaacgcttattttttgaccactagaacttttacttggatctcaaaacctctatgaaattattgttacattagacaaattcgagatgaatcatatatatatatatacagttttgcaatcctagcctaatagatgtttgaataatggaactctctcttgaaattactggcagaagttgtctacttattgtttattatttaaaaactggtttaatttaacaacaacaaaaaaagttgagctgcaatgacagcaaacggtaatttgataatcaattctaggtttctttggtggattcctctgtaagtggtggtttgtctgtggaagaattcatcccatgccttcaccctccttgagttttaaaggcaatgcttcatggtgagaccaaggtccaaatacgtcttcaaatctcaggatgttcatgcccatgccacacctgctgtgttactatcttcctcccaagtcagaaaagagaatcttaacaaacccagctctgttgaaaaggcaaacttccacttttcaatttggatgaaaagaccacaacctgatcccatttcgcagtgattccctgctccaggatgctgcactgaccctccagggcctagcagccctggaacatcgtgtcttaccatcgctctgcatttgcaacaaatgcttttctaccattcctgacataacagctctattgttatcaattgtaaatgtattaaaaacacacaagggcattttcgtacatgtacgtgaaaaatattattgcctgacaggctccagtcagcaagtgcaaagaggttttattgaaggaaacagcagtggcaaacagctagccatgctcaaggaagggaatagttcctttaacactggcggcacacgttcgcttaagacgacgctcctgcccctgccttttccacacccagaggacctgctagacaagcagcccgccatctctctctgggatcaagctgtcaacgcaaacttgcgttttttctctttttctgagctaagctctacccccagagctcccgacgccttcctgagtgaaagctctaaaagagctcccttctaaattgcatcacacgtgccgcgtactcttcaaactgacagaacaaaagagccaaattccaaaattctggtctgaatgacttgttagttgtgctggatgattaccccttaatgggcttggagaacaggctggggtgtccttccctggttagttaccaattaaggctgatttgcttaatcagggaaacacgctaaggagagagagagaagggaagaaagccacacacgcagagagacagagatacacggagagaagaaatgggacaaggagagaagaaatgggacaaaagccagtcccacgactgcccccttgcccctactaattaggtggcaatgaaattacttggaccaggagtcacaaaaataaattctcatctggaagctactaaacaggcctgctgtgatgtgtgcatgtgtgtgtgtgcatgtgtgtctgtttttcccttccagagctgatgctacaccaaataacagtcgtgtattcttgacagttgttcagtgttgggagcccccaaagcgttattgtctgctccttccacccttcttccccttagccattaataagcatattcaactgctgagggtcactttgttattctgacataatgaactgggagatgtgctttccaagtgctgaggctgacacggtgacactggcagcgagatgttttcacctcgaggtgccccaaccgtacactcgacacacttggaagaataaatattgatctgctctgtgagggtgtgcaccatgtgaaatgttaatgcttttcaacagctttggacacaccaagtagctattattactactgttattataaggtagagaatcccagcaagtgtctcatcttcaacctttatcctcatgatcagtgcacatgtgtcgaatgcccacaatattcacacctccactcatgtggctggacacaatgatgatgttcctatttttttttttttcttgcgatggagtctcgctctgtcgccaggctggagtgcagtggcaatcttggctcactgcaacctccgactcccgggttcaagtgattctcctgcctcagtctcctgagcagctgggattacaggtgcccgccaccacgcctggctattttttgtatttttgatagagacggggtttcactgtgtgggccaggatggtctcaatctcctgagctcgtgatccgcccgcctcagcctcccaaagtgcttaggatgaagacatcattcctgaaacccctcaacaagagaggtaattagtcacaataataatgtaaatacgtattgtttttaccaataataaatatttattccatcacagggactgacttcttactgggttggagattttctgtttgtcttcccagggtgattctctcctttgtacagaaagaaggaaaaaaatcttgccatttctaaaatcataagtgcctatgaaagtttgaagccctatgctaggcgtgggggttcacaccggtaatcccagcactttggaaggccaagggaggcagatcgcttgaggccagaagttcaagaccagcctggttatcatggtgaaatacagtctctactgaaaatacaaaaattagccggacatggtggcatgcgcctgtggtctcagctaattgggaggctgaggcacaagaatcgcttaaacctgggaggcagagtttgcagtgagccaagatcgcgccactgcattccagcctgggcaacagagtctcagagtttgggtactaaaagcgagctctcccaaaaccctagtgtaggaaagagtcataattaaactgctctgcaaaagataaaagctgaaatctgtggagtgggtggccctggtgatgtttgagggagataggagtgcagcaagatgacaggagcaagatttcagcgtggaataatgacctgtgacagtaagcaagtgacacagttcacaatacaggtatctaatatctcattttaaatcacttgccagctggcattttgatgataaagcttcccttttcgttgtttgctgtttaaaacctttttatagatttaagatatattacatacaataattgacaaggctttaaagcataacatttgatgacttttgacatatgtgtgcaccaagaagccatccccacaatcaaaacaacaaacatttccatcataccctctgccagagtttccctatgtccttttgtaatccatgcatccctctacttccttcagtaggcaacctgcgacccattcttcttactacagattgactcaacttctaaaatttcatgtaaactgaatcactcagtttgtacctttttttggtcaagatttcacacagcataattattttgaaagttattcagattgttgcatatctaaacaattttttttagctgagtaatatttagttgcatgaatataccttaattcagtttatctatccacccaattgaaggatatttgtattgttttcagttgttggctgttgcaaataaagctgctatgaaaattcccgtgcaagtttttgtgtggatatttctcttggctaaaactctaggagtaaaatgctgagtcatgtgataggtgtgtgccttgcccattgttttctcatttttgacaaactttaataaaattctgatacacacattaagaataaaaagactggagtcatatctaatgagacccagaaatatctgagtgggatgtggacaactacttacaatgaatgacttaggattgggtatgagacaattccacttttcaagtattctagacacttagagggctgggttgacacctaaaaaatacatttgtttattttttaagctatttagtcaactcatgtttattgaacatctactatatgctaggcactctgatgaggtttgggataaaaagcaaacagtactgataaaattccagtgctaggctaggcacagtggctcatgcctgtaatcctagcactttgggaagctgaggtaggtggatttcttgagcccaggagtttgagaccagcctgggcaacataacaaaaccccatctctacaaaaaatagaataatcagccaggcatggtggcatgcacctgtagtcccagaggctgaggtgggaggatcacttgagcttgggaagtcgaggctgcagtgagccatgactatgccactgtactccagcctgggtgaccaagtgagaccctggctcaaaaaaaaaaaaaaaagtttctggtgcttaatagagctatggtcacaagtaatggacacacatacatctactttgcagcaatttgaaatctttgtgatctactcacagaccaacttttctatttcgtccctcacttcttccttgcttcgttttaagcaaattaattttttaattggtgctgcttaagatgtcatcacatggaatgcctcctcttcttctcacttattcaaatcttgcctgtcactttttaaacgctgccttggacatcttcagcctgaagaaacctcacggtttcctgatttatttggtctggagtgcagtctgggcatcacgatttttagcaactgtgaagatgattctaatgtgtagccaggcttgagaacctctgccccaaagagattttatcagtacggtttcctatgattgcactttgctgcagaatgtccttgttcctttatgtttttttccaacctctattggagaagaaggggccctctgtcttttaaaggtgaacctttgcatgaggggtttacatccctatctcttttaccatccacaaaagatgtgtcttcatcaaccgtcgttctctttccttgcatcttcagtcttactctactgactgcttcctccctctggatgcattcttaggtgtactagagactataaatcctttgtgcactattttttccatcttcaaattcctctgggtagtccttaatacatactatttcatcacccactcactccttaatccctcacaattggcttccgtctcctcgcaaattaaactgacctttcaaagctcatgtgataatacatgctaggtgcttaataaataattgttgaatgaatgttaaacacatgaatacatggctctaatcaccaaatcaatgatctgtaatcagtttccatccttgacacatggtcagtcaggctcacggctctgtccttgtcttctttaatgtagaatcctggtttttctcctcttttagaggtttctctatgacccctttgctgaccactcttgaatatgttagtctgcacaatgtgtaagggttctggtggcagacaaagttggcattcaaatcaggccattgataatttattgctgtatgacttaggacaaattatcccttgtcactaagcctcatttctttatctatagaaaagaaataattatagcattgtttcaaaggttgatgtgctacttaaatgccacagcaaagacaatacatgttcattaaatgttcatattagtggttcaatggacgtaagcttcctatgggcagtcaccacgccatttttcccaccatcatgattctgtcttcaaaacctgcacaggatttgtcacaaggtgcttgaaaaaatactagcagcgaatgaatgagcaaatgcatcattctacttctcttaatgaataatctttcccacgaccttggctttagctctcttcactctttcccttgctaacctaacttattctctaatgacctgttgaccttattcattcttcaactctctccttcgcatagatgactgctaaatccaaactaaaatcgacttggccccttgtgatctacagatccagatgtgttgtcttttagacacttcccaaaataacttttccagagacatcactttgagactttaaactccctgcacttaaaaaagaatgattatctccccttaatccatattgttcactcatatatattcacttcttgtatattttatgtattttattatacatttatatttggaatggcctctaaagagttctacctgcctatttgtttattagccttaagatattcccacttgcaacatgttcttcttactaatgtgtaagccttcatgtattagcaacctccacattgacaaccaaaaataatgataatattaattttttaaagtccatactccttttggggcctgtaaattgacccttattttactagaaaactttttttttctgagacagggtctcactctgtcacccaggctggagtgcagcggcacaatcatggctcgctgcagtctcaacctcccaggtccaagcaatcctcctgcctcagcctcgtgagtagctgggaccactggtgcatgccaccatggctggctaattaaaactttttttgtaggaatggggtctttgtatgttgcccaggctggtctcaaagtcctggcctcaagtgattctccctgcctcagcctcccaaggtgttaggatttcaggtaacagccactgcgcctagcagaaaacctttatttatgtaaaaaatatttctttattaagcaagtcacatgtaggtaagtttctattgtgaaaaatcatagcttaagcaacacagatgtgtcaatgtcaaggcaacatctccacttcattactgcagcttgccccattctcactgctctttgacaaatttatttggttccgtattatcagtttgggataaagcttttccagatcttttgcattcattctcgaacatttgcatatctggtttttacttaatgtaaagggggccaagctgtatttattaatgggaagctatatttttccctttgttagtatatcctggaggtgtgctcatttagatcttcctcatcctaaagaattactgcatcatattctccagtgcggatacaccacaatatagacagacctctattaatgaatgcttaaacactaccttgctatgtttatttcccatccctctcatatgtgtgatcttttaaccaaataaaaaagcccatttcagacttttctatcttgacctctttgtgcatgcctttcttttccgattcctttcagtgaaacgtctgcttatcctccaaaactcagctcaaatgttaactccatgttctgtccatcatgctatgctaaaattgatgtcttacacctcttactcttcttcttcaatcattcaaggacaggctctaatgtttttatactcccacagagctaaacctagtgtcctacatatagtaaacttggaatccatgtattgcctaaatagggaaaagattgttaaccttttgttatctaacatgtatacacacacagattataagcaactccaaggtgaaacatacctcaatgggctttgaataatgtgcatgtgttatgatttgtatgccggtgccatggcagccatattgtgggcatggacaaaggcagagtatttttccttaaatattgcactgaaagtgccccttaatcactataggaagctaccacaaagaaaggaggatgaacttaccaggatctccaagaggatttagaattgaggtggataatcctaaaagagaagggaaaagaaactaattgagtggtatcttttttttttttttttttttttttttgcctgtccaggatccctttttcaggaaagagaactgtactttatagtgacgaacctattctttataccttgagtggaaatggcttgccctgtcctgctcctcacacagacatatgatagccagagtcctctatctcctagccacagcagcttgttctaggatgcttgtgagactcgcatagcaccaatccaggcgttccctgacacttgaaattagcatactgggagtaacagttctctccttctatgtaaggtgtaaacactatttgggctttgggtagacagagccatttttctgccatgtgtaaaaagtctatctgaggctgggcatcgtggctcacacctgtaactccaacattttggggaggctgaggcaagaggatcatttgagcccaggagttcaagactagcctggcaacatgtagaaatcccatctctacaaaataaataaataaataattagccaggtatggtgatgcatgcctgtggtctcagctacttggaaagcagatgtaggagatctattaagcctgggtggtgaaggctgcaatgagccatgatcacaccactgtactccagcctggatgagagtgagcacttgtctcaaaaaagaaaaaaaaaagtctctctgagaataaacccccaaaagggggccaagaaaagaaagtaaaggcagggcactttagccacagggacaaattccaaatgtattgtttgggtccccatatttagttgctcctgaagcttgtctccatctggacatcctagatatgtgagtctacaaattccctctttatctaaactggttaggtttctatgacctgtaatggaaagagactcacagaattgcataggaggtttaattaattttatatatttcttctgactctattttcttcccatctctttttagaggatgcatgctgattaaattctctaaatctaattgtttaatctctgctttctaactcctaaaatattcacagagtggaaatgtttaattttgtgaaggtatgccaaaaatgatctacaaaaatggcttaaaattggaggctgaatcttatgctaaaatgaatggaaaagaataaagaaactgagatgtggtttctgctgaactggtctttcatcagttctattcaatttgcaatagtgaaaagtggggctaggaatttacgtatgttatgttgagtacgtactcagttcaactatgtcatgaaatttacctgtatcttgtagatattgttatcttgatttcaaagattgttttaaaaaatcaaatggttttcacagtttctttcttgcccaaggtccaagtcttaccctagctattaggtatagaaatggaagattagaccccagctgtctgagttctcaacgcttctccaccattcaggatgttatgcaattaggttggagattgactctgttcccaaagagaacatttccaactttagtcaactgtcttgaagttcatggtttgatcattattgttttggaggaaaacaaagccaatcactttctagggagtacattactataaagagagtataaaatttgaatttagagacacataaattccagcttcattttcactaaagagctctgtgattctgaagcttaacatttctagacctcagtttcctctttggtcaaacaaagggaatgagggccgatcatctctcaagtctatttcatcatttctctcctggtaagtgcttccccagagccctgtatttttcctgtaggagatcatatcgccctatgttatgattatatgctaaatacagtgacgtctcgttcaactcagtgtttcccaatagtgagtccagcgtctggcagatagatcatcagtgaatatttgttgaataaataaatgagacaattaagtctatttactcttgcggacaaaatattactttgtgtgtgtgtgtgtgttgtatttctttcactgaccaaagtagtaagctttgaaattgaagaaaatacctaatattctaattttgctgatgagaagtaaaaataggttaatgatagttttgagtgcttcaatgctcaatacatcagtatggattttacacaggacatttctttaactagaagcccaagataagcaaggacttaatgtaaatttttaaaataagagacgtattttaaagtgtaaaatggccattttagataaccattgtaattcaaattttaaggcttggtaacagagccatcctggtgaactttctatgtgaaaaaagtttccttaatcagcttttcctatattatctcatcttggggaaaaaaaacagtagctaagccagaaacaagcagaataaccaattactttttttttttaatctctccacttgtgtttgtgaagtagaagtgagctatgtggttttttgtctttgtttagacattggacaataaaaatcataagaacatatatttttgacacactattttttggtgttctttggaagttggaccctaactaaaaaatatgtgtttcctagcccttcttactgtgaaaatccttggcaatataaacagatgcactggttggcttttaattctgacaccagactgtctgaaataatagctctaagaaagtgtgaattctttcattccttcagcgtcaattataagtacttaatttgtttatctttctattgctgactatagtaccaatctggtttatttttcacctggctaaacatggtgcatttcagaaacccctagtttattctgcacgagaagacagaagcaagccacaagtctgagttattttcatacaccggggcacatcactgtaatttaataattaagatattaagtggtgttctgaaaaattcagtaatataggcccataagatgacagaattagggtacttgataagcagtatgaaaacactgaatatttcttataaaagttgattcatcatttgataaatgagccaagttaatagcttactagctcatcttggcctttcacagtcaaggatattcattttttcgtgtccacccatttttacaccttgtaaccaatttactgtcacagtgtttttagcctgtgatgtgactgcggtgacactgacttctgtgacttctgttcatggatggagtaccataaatgacatacgggctgataaatttatcagttcctgggagttgagatattttggaagaattgctagaacggttcctcataaatattgtcatatttctactttaaaactccactctttagaggtgtgtctttatatactggaggcaaacataaaatcaaaaggcaaattattgctggaactcatgataaacatgatgaagaatgtgctatgcttctccaattgttttctttcaaagtctgtctttgtatatgcattcatattttgagatgttttcaccagtcattttggtgactaacactaaaaaagtttatatctcatttgtaaatatgatgaaaagaattattagggctaaaatgtaatgggaggtatggtaggaattgttaagccctttatttttattatcacacttgaatcctcataacattgctaaaggtattcttgttagtatttttctcattttagaggtaaggaagttgaaatttaatgatactaagtacctgacccaagttcacagactcagaaagtggtggaagcaaatactttaaccaaatagggccagagtgttcaatcatgtcctgctgttcctaaacattgcggctactaaggcgtctaatgtctcacacacatgagtccatttaatccttcctaaaaaccattaatgttgaaaatattatacctattttacaaatggagaaactgaaactctgatgaagtgatttgctcaagctcacacagtgtgtaagtagtagagatgggcttagaacgaaggtttgcctgagtccaataacctgtgctcaaaagtttcattctaaactgtataataacatttgtttaggcccttagagtttattatctaatcctagtaggtggcaccaacacagttcttctgtgtgcaacggctgactacactatctttgatgccagaaagactagagacaatttcctcgtaagggtaagggccaatgatgtgtactgctattgtgacatatgtataatagggatgaaaaggagtcttggaggatatgtatttctactggtaaaagcagaggctggggattgggcttctggagtatctttccaaccttttttatatgacacatcatttcattcatatgcctccaattaatctcccctaaaatcaagttggctctgataacatctctttggaaatggtgggaaaaacacatagtgacatcctcttgatctttttgcaaaaacacagctatgattttgtcagtttttaaacttttttcccatttgtggaaaatttctttttgtagaattagataattataattgagaatatgaaatctcagtggcccataggtcccatgaccatcctttggggcagttacttggacaagcatgatagcttctaagttgtttcctgttgttcttggcctcattgcaatcctttccaaaacttccctccttctctgctgcattagtaatgcaaaatgaaattcattgtgcccattatatctgttaaatggtttccattttaacttgagaaaaatgtattgacgttcatgtgtttggcatgaaaaatgtgtatatctatcgaagatagcaacttgtctggtggaattacagtgcattatgtataatgctgcttttagctgtgcatgtacatttcctggaatcttattgtgtcagagcttggaaagtttacacaagcattggtaatctaatttttgtctggtgggtggctgtggaaatatggagtatttgaaaaagcaaatgtcttggccatctgtgccagggaggggtttggtggcaggggtgtctaggcaggtgggtaaaaaacaaccatcaaaaaaagactttaaaaaaattgccccaggcctaacctaaatactaatttcccaagagcagaacgatataaccgttttgtgacatgggtttttagcatatttctggttattctttttaggagttctaattgtaaggtggaggaatctgttttatctttctcctgcctcttaatgataatccttctctagactatattgtttcctgtgccttttgtcttctgcagacaagagtctttggctcatgaacatcttgttaaggtctgttgaggattgggggctgtgacacaattttcttgctgagtctttttattggggatttttcagctggtttgtcttggaggcctttgaaatgtcttctatcaagcaataattttcatttttctttgttttccttaaaattggggttgtatttggctcaactgttcctggggtctaggtaatgaattgtattatttaataggccagtgtgaaattctgtgtgcagcagctgcactgctctctttctttcagagttgcttaaatcctactcactgcactgctgctgaatgtgatgtagttttcgttttttggctttaagtgtatttcagccacacatctaaagcaagatttcttaatttctgcactatcgtcattttggactggagaattctttgtcgtgggggtgctgtgctatgcattctgggttgggtggcagcgtccctagcctctacccactcgatgccagcagcaccttctccaacgtctccaggtattcctaacgtcccctggggagtgaaatcaccctcagttgggcatcactgatctaaagcaagattgaaagacaaggctggcatgatgtaaaggaatttccataaaaagcactgaactcaagcaatgcaatgacaattctgagagagctttgtgtctaggaggatatgtggaggaattgtatcacacatccctggagaaaatactgtaataattgtctatagtttcctagagtaagtaacagaggaggtaagggtcaccttttaactgctttgcttctgatctgctaattatctcctcaccctgtgatgcctttcatctcccctctacgcaacttgactcacatatggaagattctaattcttcacagattttccaccgtaactactttcctagcctaacctccctgctcttcggtttcccccactggttttctttggctcaaatgggaacaaggtgcccattatttctttaatccacttcaccacctaataattgctgaggaccaattttaacaagatgcttccttactctgtaatgcactccagtaaggaactaatgtttaccgtgatgagtattctctgttctaactgaaaagctgaaatgctgccgaccactgcagtgtagactttttcatgtttaacattttctcaatgcctctttgagtgagttacatctattatatttaatggcagtcttatgggcctgtcaaaagggcattctatttgctactgaaatatcaattaaaataacatgtaaaggaacggagtaatcaagtgcatctgatgataatatcaagattatttttaattttttaatgctgtgaaagctgtgagtaggctaacaaatctatttgatcaatatatgggatgtaaaaagaagaagagacaagattgactggtgaataaaatgaaactgacacaaacaggctgacagccagctgtaagtctctttagggcaaatgcaattaacttagaataatagactcaaatttgatggttagaaatgcatttttattaacaatcacaggctgaatcattatgctcttatgaataaaatggtacttatattttgtgcatgtgtgtgcacacatatataaatacatacacatacgtctctatgtatatatccatgcctctcacattcctatgtgctctgcttacaatttgggtggaaaagttgatttttagaataatgtactttaaaaaggaaattcattcataaatagtcttcaggactataaattctgaatattcccccaaattatatatataaaaatcatactacttatctggtgctattagacataaagccagtgagccctggtcccagaactgctggtccttaggggatttggaattgcaatcagggatttacagatttcattttgaagaggagaagtcattactagaaacctaagctcatttcctctcctttaatagctattttaaatcattcatttagaaaatacattaactatttagggtgcttgcaatgcatttctcttggcgttaagtctgcatttttaaaagagtttttttctaaaattatttcaaaagaagatgagaattagaaaaaaaccaaatgaaattttggtgatataaaattacttttggataacattttcctctctcattgcctaagagaaaacaacttaaagctttaacaaaatattagaatattaacacactcttaatgttttaatgctagtatagatttaaaaagtacatgattcttggaaaatcacaaacttgactttgaatatgattaagaaatagcatatggtcgatggcctctttaaatgactttgttaataacttaaatagaaagcagttttaattctgtactacttacttaatattgatgccaaccttaactagtaactgggtaataaagggaaacgagattatagtaaaaaataagtaactttaatttctacaaagaaatcagaatatggattcttgcataacgtttttgcaaactgctttatatatatatatatatatatatatatatatatatatatatatacacattcaaatgcaaaataaagctccctgagttatgtaattgctattcttcaaaaggacatcatgaaggttgacaatttaaaatgtgctcttcctgtcaccatccaatttttttgaatgtctactgatggtgttaaaaacaatctccgcagaagagggctgccattgccaatttaggacactggctttgttattagcataggcatattagatcatcctcttgctcttcctgcctgctttgttcttttgatatggtagggaactgaaattgacaacagcctacatttatataacaataacttgcattgttaaatatatatatgtagatagacagatagagagttcttttattcccaaaagatatcaaagttcactacacaccataaaaaaaaaccccacagatatatgcagatgcttctgggatgaaccgtagcaactatttaaaagcataaagtattgacagccgtaagattcttggaatagtacatcaccatttttaatttttgatatttttatctccttagaaaatttctgttttgttcaccaggaggaaaggataaaggtcacactttgttacttgagcaacatgtcagaaacagtttgaacgtaagctggaaagaaactgtctaagtctaaatgcttgaacaacactgctgttgtaaacacaagaccaagtaggctgcttggtatctcatcattgttcaatccactggtccactgaaacaacatagagtgaactcaaagtggggagtttgatcattggatgggcatcactatacatagggctatcagacttatcaaacagaaacacgagatgcacaatttaatttgaatttcagttaaataatgaatcagttgttagtataaggatgttccatgaaatacgaggaacatacttgataactgaaacgtatttaaggggttgttgacaacaacctacatttatatagcaatacgtgggacacaatactaaaaaaaattatgggcactctatatttaatctggcaatccaaactacgaaagcaagactttgtgtattctttataaagtagactatcattggtataaaaaacatttttagagggaaaaaaacccaatagacctttattttttgtcacccttaaaacaaccctaccatcttaaatatttgtaaatatgttttcttcttcacaaaatagaaataatattatatttagacatgactcttttttcaataattcgtaattataggttctggatggaatattcatgaacaatacaaggctcagggcatatcataataatcagtgagtggtcgcctatctgtttccatgactaccacgaaggatagttatttttttttctttagtttattttcctgaatgccaatcatagtaccaagcgcatggtagaagatcaattcatgttgcttgaatgaatttattcttggccattggattgatttttctccttttttctaactttggatgacttccctgtgttttcagacataatggtagttttacctccatggttttatttccattttgagatattcttcagcagatgcaaggtgaaatttgacaccttcctatcagtaagttataggctgtgtttctctggcagtatttcttacaaggatgaaaacagaggagttctgaatggttaatgcggagagagttagtgaataatttttttaaagcccaccaggaaggttgtataacagaaagttaactgtgctcttgagcacttcatatgtattctttatcatataatatatattatctattatatgaattagttgaaaattttctagaggagtttaaacatataggatttttctatattataccaattttttgatcacatatcaatgccacaactcaattctattagaattttaatatataacattatatctcttttaatcttcagaatttatgactctaatagcacaaggtaactatttttatcccaatcatcattatcattggttttgtttctactgtatacatgctatgagcatttgccaatgcaatataaagcaagtgggaccaaggtaaaaaaagagagtgagacagagcctaaaggaagattcaaggtttcaaacacacaaaatagggttatggtcattaaaaaaaatagatataaaaatattcatgaagcactaaaataatatcataagttattttttataagtttctgttttctgtagtaaagagatgtgtattcttttagatgagatcaatcattacattcacaaataaagtagaatttaatgctacaatgatcaaaataaaagtctaaacaggtcaattcgatccatctttgtagtatttgaagggtaggaaggagaatggtaaaggagataggctaacatttattgagtatgtattaaattcagacactgtgctagacaatgagagtaatgaaccatattattctctgtcctgaagtctctgactcacagtctaataggacagaaacatgagtaagtaaataattgcaaagcattgtagttatgtgctataaaaacatagtatattgtatagatatgatcttacgtagaatattatcaactttctaaatagattgcaggaatgtcttcactggagaaataatgttccacctctgaaggagtttataaatggagaaaaaattttgaaaagcatgttatattgagagcaaaattgccaaaaagtgttgggttatgaagcagaattagaagcacactggtttgaactggagtgtagggttcagggtagaaagaatgccaggaaatggaacttgaaaagtaggcatagctcagaacttggaggctcatatattaaacaaaggagaatttaaaacagggaaaatacatagtcaaatttagaaagagaatgttggcagcagattggaagggacaagattggattagaagagcaatatttaggcttttacaatcaacagtaaagacaggagttaattaaagcttaaacaagatgttaatttgccattggaaatggacagaataaccagattcaagagttagtgaacaaaagaactcaacagctcaacatattggaaaatggtgattaacctggttaatataaaacaagatagtattgagtaggctaccatgtgtgatatgtttgccagtggtggcctacatgactcaattgaaaggaaatcaattgaaaggactcactggatggtaaatctacttaccaggaaatgggctaagaagctttaagacattattccaattgacaacttcactgtcattttatttcctagggagttctatcccattcggctaaagaattggaagctcagagatattatcgtaagttcacagtgctaggaaatgaggaagtggaggtccctactcaagtccttctaaccacaaagtccctgatcttttctttaaggtgtgcttcctgaggttgacttcagatcgatgtggatgtacacttggaccaagttctacattaggaacactttaagtgattgatctagaggtatgaagtgaatcaagagctttgtgtccttaatatttactaaccggtttgaagggacagaactggattcattcattcattcacaatttatgtagtgccttctttctgatggaagttataatgtgaatttggagctacctcaggcttcagtgtctaagggggggatctatcatattgtgcaaatatgagcattgattggaatgcaatttaggagacaactaacagatactaccattgctgtgacctctgcatcataagaaaaataaataagcaggatacaatttcaatttttccctcacatctttctctttctgattaatcatcctttcccctctctcttttatgcctgcccctttaggtctaagtaaattttttttcttaaaatatatcattgcaggtgcccctgctgtgaaaatggaaagaaatgtaatgttttggtcatgggagagctgccaattccacagtaccagcacagtgagagtcatccttcatttatttcccgccttcccctttttcggatgttgatgagacattagtatggcgcgaagcctgtttgctccttgctgcatttattttgttaagattagagttgctaagatacggtagttatttcaaattgtaaccactgatgccagtggtcataaaataagatgctgaaattcctttatttgctaacgttaataaaaaaattcttgagggggcaagagaattttctggcaaaaaaggaacagtactccaagtggcctctgttatagcacataattagatccactagcctagctggtgttgagctattttggtgtaaaatctagagagaagttctggcttcgagttgtttattaagttattcttttaaaataaagggtgtggtcaggttgtgcaaattttacatcccttcttctatttagttgtttaagccaggggattttttagcctgttgctagttattcttctctgttcaataaatattgtgaaggatttggagtttttaacactttctcacaacttcttgagttgggcctcttaattcttctcatcttgtgctgctgaagcaccaaatctctcacgttctattgattaattctactctcttaggatataatttgtaacttgtaattttactattgccagcgacattttttaggtaattgagaagtcatgccctgtgtttttattgttattgacaatattcggtatttttcttttaatgaatctcacacacacacacacacacacacacacacacacacacacaaacacaaacctcagaatgatttccaacgagatgtaaatcaactccaggacatttctttgagcttttagataaatattttcaactaatacttaaaagaaaaaccattaaactattcgggtggaaaaatagtctctgagcagccagtttggcaaaggtttgttcagcgaatgtgtgtaatttcaaattacgctgtgtttttatttcacaaaaatttccagcttccctagaacacttcaaatactaatatccagagtttccactggcaattcttttgtttgtcctggaagcatcttgcaatttgggactaagaaaatattgtgttctctttggatttacagacataaacatatgcatttcttcttcagcacacagttcttttcagggaaagccaggttgaatgggcagactgtcaaatagtaagaaggcttcatcaaaaatatatagtacatttggctgaaaaaaatggtctccaataaaatttaatctatttagagaaagacaaactattaagtaatgacatcccaatgtgatttgattaaaagtaatattttgtgaaatcaccatttaaacgcctttccagagagacttagagaatatgctgtacacggttgaatcgtattcattaaaccaaactcgtaatacccagtggagccttattgtacaacaggcctgtggttaattgtaattccattagagaaattgcaaaaaggtggtttctgcccacatctttggagacagagctactcctcaggttctgtggttattactgtctcagaattttgagatgccaatgctttgtagagtttcatttctaatatctgagttcttagaactcaatgtccagaaagtaaagtgatttactgcagtcttcagtcttcattttctatgttcattgttcacctatgccataatagggggactatctgatttttttatctgactatgcatcccaagatttaaggttacagatatatcaggtatctgtctactggcataatagtgggtatatattagatcaatgtattggtctacactttttcattcccttaaatagtattttataggcatagccttgctctggcctcatgatggtggagtgtacattcctgctcctttctggaaggcttagtggcttgacttggccaacataaacaatatgatgacagcaatatacctgcaaatttaggttctgcttttgcattgagaatattataatattgccattacttttaatggcaaaacccgcaattacttttgccccaacctaataccatacctaagtagttgctcgtctaaggaagatgaggaacctgtagaacggacctaggcacacctgcagctttgagtcaaaccctactgcacctgattcagattagccaaactgcagctgactcatagataagcaagaaagaaataaatgcttgttgttatttgccattgaaatttgggatgtcttgttacactgtaattatggcaatatttaaccaatacagtgtgccaattttacttccttaactgtcttcaaaacacgtgttaaggaactaaaattgaaggcaaaacaagtgccttcaattctgcatatgtgaggaggcaaaaggagtttctcctgttattattaagtctttcaattctaagctagctctgaagctgcagcttgaattcagctcatatagatctgaaaagttttaataaagttatgagtcatgtgtaattgaccaatgtcctgaacctgttacttggcaaaattgaacaaaatgggggaattctgcaaacccatagtttcagtggaattcttatccaatgtatgacttaggcttaaagtatatgtatcgtatgctgtgattttccattggtgtatggtgtggcgtacaattctcccataagcctttcataggtgtcaccccatttgcttcagtgtatgacttttttagacaattgggtgttggggagtgggtcttaactgaggacataaactattgtggtaataactgtcgatggattatggagtcaagtggttcaattaagatgggtcagagagaataataagttacaaacgtgattcaaggttacaattgcaaaagctaagtgaggctaggcaaacaatataaatcaataaagtgggccagataacaggaatgagatatccatggtaaaccggagaagatgtgccccatttataggaggtaactatttggttccaactaatttcatcattcaggcactgtattgccctatgtttatttatttatttttttaaattgaatgcctctacatgtcaggaactggttctgtggatacatcagtgaacaaaacaaactaaaccattaaaaagaaaatcaaaaagaaggccaggcgcggtggctcatgcctgtaatcccagcactttgggaggctgaggcaggcagatcacctgaggtcaggagttcgagaccagcgtggccaacatcgtgaaaccccctctctactaaaaatacaaaaattagccggctgtggtggcaggcgcctgtaattccagctactagggaggctgaggcaagagaatcgcttgaacccagtaggtggaggttgcagtgagctgagatcacaccattgtactccagcctgggggacaagagtgagactttgctcaaagaaaaaaaaaatcgaagagaaactaatacctaaaataaaaaagtattttggattgtgataagtgctaaagagaaaaatatacagcaggtgagtgagatacaacattttggaaaatatggtagggtcagtccttactgagaaggtgccttttagtgaagtcctgaaagaagtaatagagggagccatgtggatagggaagaccattttatttatggggaatgggaagtgcaaggatacagaggcaggggtgtgcatggagtccaaggtgggggataaatgtgcaaggggctgagtggataaagtagagagtggatgaagagttgtagaataccagagccttggctgctttcggtggggcaccttatttccacattgaaaatgtttcatccagctgggcacagtggctcatgcctgtcatcccagcactttgggaggccaagataggaagcctgagcaacatagcaagacctcacctacaacatacaaaataattagccaggtgtggtgatgcacctctgtagtcctagctagtcaagaggctaaggcaggaggatggcttgagcccaggagttcaatgctgcagtgagctatgataacaccactgtactgcagcctgggctacagtgcaaaaccccaactctaaaaaaagtaaaaatacaaataaaaaaagaaaatattttatccagatgttgaaatctgaacataaatactcaataagactataccataacccatttagaaagatgtgaaactcttgtattaaataagcttaagtgaaaaaaattctgttcctggagataaaactttttaaacatactaaaaatgtataatctcttttaaaaacaaaacaaagtccagaagctttcctagtatgctctgtggcataatatagctagctcagaagattcaaaaaaagggttaacaaatgcagagataagactaattatgaatctgtacagtttgattcagataacagttatttagtaggcatatttatatttttaatattcttttcagagcattaaaattttttggtaattgtacataacaaaacccagttccaattacacaaaaaaaattgtatgctaactagtaatgataaaacattagtgtcaattgcatgattttaacagctgtgaagtctgcatttgaattctgttaagtttaatggataaattaaagtcatattttaagactacttaagggattcttttttcaaaaaatctcaaccccaaacattctaaaattgcatatttttattcaatccatgcaattattctcaattattattttgttttgtacaagttgtacattattataaacagatgtgagcatgaactgaaataacatgatccattttagacacaaagggcgtaaaagaaaaatagaccttcttttgggctttccttccactaaactttggggaaaattagttttcacttagagagcttttggaacaataaatacaaatctattttccctaatggtgaggtggcagaggttatcatacttagcaaaccaaaagtggaaaacaattttccactatgaaatcagggactacctagaagtttactatttaagtttatcacagtggtagataatctttttcttaagattataaaatgaaaagcagaagttctgtcatgacgcactctactcaatagagatattctatcacctctccatagtaactaaacagttggtagcttcttgtgcattcttctatacaagatttatgcatacatgtctttatttatgcatcccttatttctgtttaaaaaactgagagcatattatataaaattgtcattgtatttccttttccgactgtaacattcctctgtaatggtttcctaatattcctattatgaatgtgcaataatgtatttgaccagtaatagactgatggacatttagattgttccttataattttacaacaatactttttgaaatgagtggaaaatcagcttgagaaagagagaaacgcaggtaaaacctgtggaacaattgaaagttcaactaatgaaacagtgaactagtggaattcttaaaccatgctgctcctttggtatcaaagaagttaatttgatttatgttgtctaaaaaaagaaaagtaaaaacttaaaatattagtaaactataagatgaatagtagcttagtggaccaatgacacataaatttttgtaaaacaaaacttctatgaaaaaacatacatactgtgattttatagtcagtaaaagtgcagaaataaaaggaccaaagaagaggcttggctgttcttgacatttggttcataataagtagatatggaataagcattttggttctgtgattcagtaatttttttttcttctttattttagagacagaatcttgctctgttgcccaggcagtggtatgagcacagttaactgcagccttgaccacctgggctcaagtgatcctcctgcctcagtcctgcagcctcagtcctcctgcctcagtcctcctgcctcctagtcctgcagctaggactgcaggcatgcaccaccaagcctggctatttttttttcctgtggaggtggggtctcattatgttgcacaggctggtcttgaactgctgggctcaagtattccctcaactttggcctctcaaggggaggattacaggtatgatcccccgtacccagccagggggctatttttcaactgcagcttatgtgccctctgaacattaggaattgggaaatgatcaatgcacaccaattgatggaagcctccataactttagaaaatgctttaacttcttgtttaggtgcaaactgtgtggatcctgagcatttacaggaaaaaaattctaattacagggagaattggtaaactttttacaacacgtaattgaaaatcaagatctacccacttttctttctccactggcattgaaccagtttataggtgtaatagtaccaccccaaattatttttttgatacacatagtaacaatatacttagaaattcagggttttaggtaatggagcaagaactaacaaggtcaaatgattttatctattgctttccccatggttacgaatgactctttaagatggatcctttttattcagagggaaacattaaaactttagttgtaaagtttttgtttctaataaaaatgaagccactttctgggaatcaagatgacacctttgttgtggattttctaagtcagacagagagaaatgtactcgttatgtgaaagacatagtttggcctttttagcaatcttccctatgatgatctattatataaactaatctctaagattcctttaaaatgccatgctgactgtaaactgcaattaataaaagcttatgctctcaattctaatttaaggaggtatattaactctttgagggtctcaggacctcatttagttcatttagttcttcttaagtgccatgtattgaaaccctagtgactttaaagaaattaatacaatattggaaaacctatgctatgccacttgctgctccatcagtaaataatgggaaagtaaagtaaataatgggaaaggaaatcctcaagccatgagatgcgtccctccttccctccttttctagcagtatggggaagcaatggaaagggtcagatggcattactggccttctaggtcattctaactgtcaggaagtcccctattaatcatttacttccaagttaagagttctctaaacatatgtaatatactaatactggaatgcaaagtagatgggctgtttcacctatgtctgcaactagaagcttaaataaacttctgtagatggatgcttgggatttcagcacatgttctcacttccctgggaaatggattataattggtccaccctgtgaagcacaaggaaaagcccgactatgggctgagcgaaggagaggagggcaagtccagtggtggagagaatatcataataattcagagatctgatggcgaaaagcaggattagagcatagaccatgaaaaatgagagaggatatttatatactgtttaaagccagcgctacttttctagaaaatgatttgataatacatgtcatgattatcataggaaattttgtgaactatacatttggtcttccctatacttgggacaggtttctttggcaaacccttccccattccttaaaacctggcacatctggccattcaaaaaagttcaagaatagacttctttggtaatttggtaatggagatattggggaagaatcttccctttttggatcatgggttttaaggaattaggtttaggaatgtcagtagccatcatttcttttgcagagaacctgttcatggcaggagagaatgtggccaagaagcaaagaagaatcacaaatgagcagagctgtaagatggacaaagagaggaagggaggaagggaaagaagggaagaaggaaggaagggagggagaactggaaaatcaattagaggaagatacgctttgcaatgccatcaaaacccatgaaatactgaggaagagatttaaggaagtatatgtgaggcctgaacactaaaagctatgaaacattgcttagagaagttaaagactacctaaattaatggagatacatactttattcatgcatcggaagactcaatactgttagcatgacaatcctctgccaaatgacttatgtattcagtgcaatcccaataaaaatcccagcagcaggcatgtgtagaaatgcaatagatctaggtaagccttaaccattttgaaacagaacacaacagaaaggcttttactatttgatttccaaagttgcaataaagctataataatcatgacagcatggtattggtgtaaggatagacatatacatcaataagactcaatgaagagttcggaaataaagctatgtaactatggtcaattgatttttgacaaagatgtcaaggtaattaaatgggggaaatggagagtcttttcattagatggtgctagaagaacatctggatattcataaggaaaagttaaatgaatcccaactttcatttcacatcatagacaaaaaaattaatttgaaatggatcatcgatctaaatgtaaggcaaaaactatcatgttctagaataaaatataggagaaaatatttgcaactttgagcaatagggtgggcaacaatttcttagatcagacaccaaaagcatgagccataaaacttaataaattggctttcatcaaaattataaatctttgctctttgaaaaataccatcaagaaaataaaaagcgagcatatatgaagagaatatttacagttcatttattggaaaaataacttcaattgagaatacagaaatatgtatttacagagagagagagagagatttacttacattgttacaacctctgggttcaaccgaaactgaagatagatccatttctagactatccagtcacatgagctagtagagtctcatttttttaagttagtatgatctgaatttctatccattgtaaacagggaatactgattggcacaatcttttaaaatattcatatgctctgacttagctctcacactactggaaatttatagaaagtaaaaagaaactatgcagtcaaagctttatgtataagaatgtgaattgaagcatgtttttaatagcgaaaactttaaaattataaaaataacaaacaatagggaaatggaaccttgcaaaaagtgttatttagccaataaaatataaccatagaaggaggcacacaaaaacgctgagagcaggtgatgaccctatgattgaatttttctttaattttttaaattaaattaaatttttcttcaatttctttaattttttcacagtgaatctcttatttttatcattgaaatttaaatatatatttgaaaaactgctaaaaagataaagaagggtgcaagatatataataaaggtactcaagttagtgctaattagagaaagatacagttgatgtgcttatcaggtcagtttgctcattgaaattatacggtacctcctgctagcactcagtttatattctgaatgtctcaggatggcagacaaggccctttttcatatgtggtcctttttccagttacaacctgagctctagccatttcccagaacacattctattcatagtctatgctaaaaacctacaagaaagaggtaagagttggaatttcacattactttgggagaaaactgacatttatccatttaaagaaagtaagcaccatcttttgactccagctctttagaggatctaaagtgaccttgatagacagtggaagaaatcacaacatggaattccttgaataaaaatttattgacttttaaaaaaaaaaaagaaagaaagtaagcaccaaacctcacacccaggtctgggaggtagcacgcaagcacttgaagggcagggagtctgtctgctctattcatggctgtttcagaaatcagagccatgcagggctttctggattacccctctgtgaaatatttttaatttactcctccaaattcactttctgctttcttttaaccatctctacaccctgaaagtctgacgtgtaaggtcttcatcagtgggctcccatattagtttcccatggctactgtaacaaagtgccacaaactgggtggcataaaataacagaaatgtattgttgtattagtctgttttcataccggtataaaaactgaccgagactgggtcatttataaaggaaagaggtttgattgactcacagttcagcacagctggggaggtctcaggaaacttacaatcatggtggaaggtggaggggaagcaaggcaccttcttcacaaggaagcaggaaggagaagtgccaagtgaaggggaaaggggcacttataaaaccatcagatctcatgagaacccactcactatcacgagaacagcgtgatccaattacctctatctgatctctcccttgacacatggggattataggttataattcaagatgagatttgggtggggacacaaaacccaaccatatcaattggcttacagttctaaaggctagaatctgaaatcaaggtgtcggcagagccatgttccctctgaaacatcctgccctcttcctaacttctagtggtttgccagcaatcacaggcattccttagtttgcagctgcctaactccaatctctgcctttgtcatcgtacggcatttcccctgtgtgtgtctgtgtcttcccatcgccacttcttataaggatgccagtcatattggatttaggggcccactctactccggtacgactttatcttaagttagctaattacatctgcaacaaccctatttccaaataaagtctcattatgaggtaatgggggttagtacctcaacatattttttacatcccctcagttcaactcgtaacagccccattccctatcatcttctgattgtgttaagtcaagggctaggagtccctatcatgagaccagaggatgggaggaagggaaggtctgcatattttatttatttattaatctttcctttcaggttccctagtggctgcatcactccatgaaaggttacaacttctgtcagactgccctctttatacagctgttctctccagattcagcacctgggatacctataacttatccctcccctttcactttcagatttagggatggtaatgaactcacttctcaattattgctagctccaaggtactattgtccctcttggtgggttcccagacatctgcccacccttttaaaagcagtccctttataaactctcctccagttagagaatgtaccatcttttcctgctgagatcaggaccaatatacttctagctgatggagaaactgagtccagggaagataagtgattttctcaagtttataatatttgcagaacttgtgggccccaggtctcttgaaaaattccgcttgacatgaaacagaccttgcacaaattattcaaacagtaagaatataagcacttcaacgtttatttaaagttcaattccattaattttagaaaaaaggcacaaaaatcagatgtccattagcagataatattgtatttcagtttggttcccttatgcattgcttgaaatttactcaaagacatttggtggtcaaagctttgaatcattcacaagagtcaatcttggattcttaaaatcaaagccatgctatctcttttaagagagttagtgcagtgtggctttctccttattgctctcttggcttgtcccttcatcataatctaacaactatgcttcaaaaaaagttgatgtgaacatgcatatgtttaatctgaaacctcagcagcttcactctcactgtatcagctgcagccatctagcacttcagatgcaacttccctccatggttgtgtttgtactttccttgattcattctctatatcctgattaataattacatttcaatttccgtggtaatgactcacttccatatcattgctagttccaaggtaccatgctcaccctttttggtttccctgacatccctgcctgaatgggctttcttcactttcaacaatttctaccataagtgcaggaccagccaaaactggccttattttgttgaaaacagaatgccaagttatcttgcagatgtagcaaagccaaaactgcaagtcatataacctgggcatgtgcagaggaggaaagccttaacctcaaatagcatttgaaaccaagatttcctccccgtggaaccaagaagactaggatgtgactggaacctgaatgcccgaacccttttagaaacaaggggtttgttatccaagaagatccggggctgaaatccactgtttcataccttaccataaacggccaagtttaaagcccttgaactctgccctgccagcacttctgcataccaacctgtccttccttacccataagagtttgatctaaccccagatagaggagacggatttgagccattcctcatgtgtccttgctggtcaatctcacgataaagccttttcttttctcaaaagctggtgcgacagtattgccttctatgtgtgttgagcagcaaggccactgctcggtaacaatactttcaatagaattatcaaataaagatgaaagaacaaaaatcatatgatgaaaggatgaaaatgcatgaataattataccaataacgtgagactgaaaacaggcagtgaagcttcaaacaaaatttaactctgagtttccaaggagccaacgcaaaatagaaaatgatgcattgctgagcctcaccatctgataacataagttttaatgagaaaaatataacggacaataacttcaatcagtgttctttaaaagatgcggatgcattcttaataagactgtagaaatgaaataagaccagttatagtaaatgcagagctcttcagtgtttattatggggatggcttgggggctctggaatgccgtttcatgtgggccttatttactgtcataataaaggaattttgaagttatttccaaatgaagttgcatgtaatattatattacagaaatattctgctaggttcaaagcaagcagtcattgactctcaaattttacacttgtgtcacataacagggttggcgcatgcaccatgcttgccttgcttggggttattggagattccgggatctgtaagtttatagttttcatcaaatttggaagatctttagttgttatttcttcaaatatttttccatgttccatctctctcctctccttcaaaactatgttagatgacctgatattgtcccacaggtcaataaggttgggttttatttctcccaatatttttgtctctgtgttttgctttggatagtttctgttgctacattttcatattcactgctcttcctatctgtattgtctaacctgctgttaatactatccagggaaattttaattttaggtattgcatttctctaaaaattttatttcatttatttctaggtaattcatctctctctttatgtttgtctttcctctatatctttgagcatataggacagatttataatagttgttttgataccctgactataaactctatatttgtcattaatggttctgtttttaaccaactgatttttccttctggttatggatcatattttcctgcttcttctttcttcagtaatttttactgtatgctgggtattataaattttatgttatcgagtgctggtttttaaaaaaatattcttttaagtgtatttgactttgttctagtgacaattgtgatcaatatagttctttttaattttattttaaaactcttttagggtaggtctataggaataattactctagagctaatttagcttttctaaggtgtgatccttctgcagttgtgaccctgaatgctcccatactcacagatgtttctcctcttgggctgttgggaattcaagtaattttcagccctgaaagatctctggaaaatgtttggttgacagatctctagtagttgttctttcccagaaagtttgtcatgcctagcctcatagggtttcacttcacacatgtagatggtattcagcaaaagactcaagggagccctacgcaaatttataaaatatttatctaccgagctcccttctcttgggttctctgccctataaatttctatcctctctgcctccccaaatttcaatttgtctttccttcatctcagtaacactgtctggctccatctgggttcccgttgctatatcacagtccagaaattactcctaggcagaaggtctgggcgatggtggaactcactttgtttcctttctctcggggttcacagtcctgcaattgctgttgtccaatatctcaaatggttgttgaatacattatttctagttctttaggtgtcaacagcagaaggatgattcaggctctcctactctgtcatgactggaagcagttaactttactatgaattatcattatgttataaattctgtaatcatcttgtgtctagcacaatcactttgcatttaatatttttccagaaaggattactttttaaatgattacaaaatatatatgtttaaaatgtagcatatgttttgcatttattcattttaaaatatatacagatggtgtaaataaaaatggcaatggcaatgacttgaacatctcttgacctctcttgaccttaaaaaggccttcgtgttatctgctgtctctctagttaagtatacttttgcaatttgccacaatgcaggcctttatcacgtttacatatttagaaatctgctcttgtttagtcttctaagagtggatttatttttagagggcaaacacagcaacagggcttatccaatgactgtctaagaactgaatatcggcttgctaattaacagatcacaaggatcaatgtgcctgagtccacatgaccagcatattctctccctgttagagaataaccatgagaatttattggtgagcatggactttgaacaaagtgagttgggtgagtcaaacagttgctggcatcaggccatatactaagtcactcatctcatcaacaaatgtttactgagcactgaaagtatgccatttactttgctaaagactcactttgctaaacacagtgaacatggcagatgcagtcccataataacagaattcttggacaaatattaaacagggaataatagcagtgtgatgaatctcatgatagggaaaatacagggagctatggaaactcttgggtgtgtgtgtagggacatcggggatgtattagtctgttctcacactgctaataaagacataccatagactgggtaatttatacaggaaagacgattaattgactcatagttccacatggctggggatgcctcacaatcatggtggaaggtgaatgaggagcaaagtcacatcttacatggtggcagcaagagagcatgtgcaggggaactcccctttataaaaccatcagatatcgtgagacttattcactatcacaagaacagcgcaggaaagacctgcccccatgattcaattacctctcactgggtccctcccatgacatgtgggaattatgggagctacaattcaagattgggtggggacacagccaaaccatatcagggggagaatgtaaagtaggctagtgttcatgtaagtctctctggataaatcatatttaagttgagatataggggattgaaaggaagtattcaggtgaagaagggagaaaaaactaacctagtgagatattctcccaagtgtgatattcttttcactaatggaatgcaagagcaggaaaggcatcaattttggagcaaaggtaaaggaagatggagattgcagagaaggcaggaaatctcttgattttaggatttgatgaccaccaccccaacccaccccaccctgctccatgctacctccatactccctgcacacacacactaacacacaagttcatgagcgaaccttcccagccatctcaggacttttagggtggggttgcattatcaaggtgcttcattaatattttttcaaactgactggcaaaggtaagcagataagggacattttctccatgtgctttgcaccttaccaaatgtattagtccattctcacactgctgtaaagaactgcctgagaatgggcaatttacaaagaaaaaaggtttaattgactcacagttcagcatggctggggaagcctcaggaaacttataatcatgatgggaggcacctcttcacagggtggcaggagagagaatgagtgccagccggggaaatgccagacacttataaaaccatcagatctcatgagactcactccctgtcacgagaacggcatgggggaagccatatccatgatccagttacctccacctggtctcccccttgacacgtgtaaattatggagcttacaattcaacatgagatttaggttgagacacaaagcctaatcatatcaccaaaaaagtttgcttattcagaaaagagaatgagaaatctctttgtcttttgagccaagtttattgaaccagtctctcacactattttggctattatatctttttcttcagtttagtagccttaagcagaatgttgctttattaaaaatatttacaaacatttatgtttttttattgaaggaggaacttattttcagctttgtatttttgtgagttgatgtgacctattatgacttatatttaattatgtacttctaatgtcaaatttttaattcatatagctcaacactgttttgattaaactgtaatcgttattaaatataaacattttggggcaactgtaactgcttcacttctctacttatcatagagatatatatttttaaattatattattatttatttatttagagacagggtctcatttctgtcacccaggctggagagtagtggcacaatcatggctcactgcagcctgcatctcctaggctcaagtgatccagagtcctgcctcagcctcccgagtagctgggactacaggcacacaccaccacacaagggtgaatttttttatttttaatttttttatttttatttcagtgaagacaggatctccctatgttgcccatgctggtctcaaactcctaggcccaagagattcttctgcctccgcctcccaaagtgtggggattagagatgtgagccactgcacctggcttatacttttcttttaaaatatatttctatagtatttgaaacatgaatcagcttcaaagcaaattagtagatatcagtccagaaggtacacagatatagtgaacaccattaagggagaagtttggaatcattcgtctgacacatccactgcctgccacagaaggcatggcctggcaatgggattagattattggaaatttgttggctgaggagccttcacatatgaacatgcttggatggagactgccaacattttccggtcatagttttcttagctaaactctcatgaaatagcttccttctgagcaatgtcgtgccaatgaatgaagttgggtcactccccaaaattgctagctggggagggggtgggaaggagaataggaagtaccaagcttctatttttataaattttctctgattgattatgtagggattttatacttaattcccccttatgttttagacagtaaaagaagtctcatttttacgaagggcagaatgcaaaacaagaattgatgggtaaatcttaatattgtgaaggtatttctaccatattctaaaaaatatcatctaagtatcaagttttccatgagacctacctttacaggattatagactctactctcttgtacagattcttttttaatagcttttttttttttttttttttttttttgagcgggagtctcgctctgtcacccaggctggtgtgcagtggcgcgatctccgctcactgcaagctccgcctcctgggctcacgcccttctcctgcctcagcttcccgagtagctgggactacaggcgcccgccaccatgcccggctaattttttgtatttttttttttttttttttagtaaagacggggtttcaccctgttagccagaatggtcttgacctcctgacctcgaggtccgcctgcctcggcctcccagagtgctgggattacaggcgagagccaccccgcccagcctaaaatagcattttttaatggcagcttcacagtaaaagatttcagataaagggtcttcactggatgagagttcagttgtttttaggaaacaagttttgttaggtaaaaaatggaaatttaatatgattactaatatatccagataacttgtttaccttttgaaaagtagacttgaaaatttgagccaaggtcccagtttcctttccttttcttcccatccccttcccttcctttccccttctcctttcctttcgcctcccctttcgcctcccctttcacctcccctttctcctcccctccttctcttcctctttctcctcctcctcctcctcctccttcttctccaatatttaaggacttcattgtttttagagtagttttaggttcactgcaaaattgggcagaaggtgcagagatatcgcatatactcctgcccccacacatgcacagccaccttattatcaacattctccggctgggcgcggtagctcacgcctgtcatcccagcactttggggggccaaggcaggcagattgcctgagcgcagaagttcgcgaccagcctggacagcacggagaaacacccaccgtctgtactaaaatacaaaaaattagccaggcgtggttgtgtgcacctgtagtcgtagctacttgggaggctgaagcaggagaatcacttgaacccgggaggcggaggtggcagtgagcagagatcgcatcactgcactccagcctgggcaacagagcgagactccgtctcaaaaaaaaaaaaaaaaaaaaaatccccaccagaatggtgcatttgttacaattgataaacctacactgacacatcaacactccaaggccatagttcacattcgggttcactctggtgatgtaccttctatgggtttggacaaatgtatattgacatgtagctttctttgtcaaaccattaaattttcagtattctctcttcttttgtttttgcagctgatttttaagagcttctttttaaaatctattgattttggcatctgctttagagaaatacttcaatgaagtatctactttatatctgattatttgcatcataaatatttttccttcatctacaaaacaaactattcttactaaatattttgtatcaataaatttataaaatctcagtttatgaggattattttttctggagcacatattatgtatggcctctattaataactgacaatggaagcaattaaaatttagtgctctcctttgaaccaggaaaaatcttaaccttcttgtatattacaaagtttaaataaaaaaagaaatagaaaagaattctattgtgataggatatattattgtccctttatcaacctgtcaaaagttaaaaaatatatacatatataaagagtaaagagtggaataataatatttacaaggctgacatatcagataaataggtatttttaaacatctgtggaatatatttatttggaatattcacatacaatactcataaaaattaattaattatcaattataggctaggtcataaaagaaccaataaattccaaaaagcagtgttaaattaagtttagcctaaagctggctcattatatatttcacattcgagctaaaggtttctatgaatatactgaactgtaacctgtctggatacatagacaccctgtaacctacttaggtctcaatccctgagttttggccaatcaaaggcagtcaactgttctaaccatgttcaagtaaggcaaatgctgaactctaaccaatctggctgtaactcactcccattttctgtatatcattttcttttttctgtccataaatattttttgaccacgtagcagggttggagtctctctgaaccaattttggttcaggggctgcccagttcttgactttttctttgttcaattaaattatgttaatttaatttgtctaaggtttttgttttaacagcagaaaatgtactagctatatttaatatagtggcaaaaaactaggaattaatgacaaaactgttttaaaaaatgcctagtctattgaatgtttaaatattattctccaaattgctaaaaggacaaagaagaaatttaaacgaaatcacatctcatttcgaaaacaaaggccatgataacactaaatatccaaacttaaggaagaagtcaaatataaacttagaaaaattactattcttaagtgacaataactgaaataaatattcatctcaagaaatgtgaaaaagaaaatgatcctcaaataaagagaaggaagggaaaacagatcgaaacaaacaactggacaagagtacagtgataaataaatccatgagtttatttttccttcaggtaatgaagaacagcaaaaatacaatgttctaagaaatctaatgatgccatccacagcattatgcacatacatttgaaatgtttgattattttgaaatttggaatacgtagacaagtagaatagactaacaactttgaaaaaaagtggtggaagtctcaatgaccagttggttttacaaatgagttctttcaagtttctaaggtacagcaaatcctagcacattacaaaatatttcaaagcatgggaaataaataaaaacagcttccaaaaatagatgtacaaagaatatataaccctgatccctaaactagtattaaattttttaaaaagaaaagaaaaacacagaccaaacacatataaatacaagatctgtttaagcactaagttttgtgtttcattcacttgttgacagtggctacctctcattattgtcagtactggggtactttaattactaaaactttctcaagtatgtatatacatggctgctttcttagtctgagttcagtgtttgcagaaagttggctggaatttcacagctggccagggttttctctatgtatatacaggagtgagtgacttcctgggatggatctttaatatattaaaattgtatttttaaaatacaccatggaatactatgcagccataaaaaggacgagttcatgtcctttgccaggacacggttgaagctggaaaccatcattctcagcaaactaacacaggaaccaaaaaccaaaaacacaagttatcactcataagtgggagttgagcaattagaacacatggacacagggaggggaacatcacacaccagggcttatcaggggatgggggtctaggcaagggatagcatgtggagaaatacctaatgtagatgatggattgatgggtgcagcaaatcgccatggcacatgtatacctatataacaaacctgcacattctgcacatgtatcccagaacttcaagtataataataaaaaagaaatattgaaaataaaaaaaaacagtaaattaaatcataggccatttatcgaagctgggaagttgtatatactaaattggtgcaaaagtcattgtggtttttgccatttaaaagtatgccaaaaacagtaatgacttttgcaccaacctaattatcttgaggatctgttatttatcattgatctaccttagggttcgcaaactcaagatgaccaggactaggcaggtaagtaaatcatgaaaaggacctggtaggaagcagagtaaactggagagcattatgcacaaataaactgtgttgtggctactcacctccattggtgagctcactggtggaactccaatggttccagctcactggaaccatttgggatgcagattcagtatcatcaaatctgtttttcagagaagccagaagtctggaatttgtatgacaaatttctgaattttaaatgttattttgcttaactatttaacaaacatcaccctggccttgcaaatgttgacaaaatttgactcacaggccaccagttggcaaattctggttggtccattactttcatcttatagccaaaacaatagacccagctaagaaactgactcatctaagaaggtctctggagttaggggcacagcagagccttgaatctgagcatctgaaagaatgaaattgtagccctaaatcacagtggccaaaattgctatggctcacacttattttttatttatttatttatttcagatggagtcttgctctgtcacctaagctggagtggaatggcgtgatctcggctcactgcaacctccacctcccgggttgaagcgattctctcgcctcagcctcctgagtagctaggcttacaggcacctgccatcatgcccagctaatttttgtatttttgtagagacaacgtttcatcatgttgacctggctgatctttaactctgaacttcaggtgatccgcctgccttggcctcccaaagtgctgggattacaggtgtgagccactgtgtctggctatggctaacacttttttaaggaaataacaacaatccccaaatatcacatgcccagagttgctcagcacatttattttgtccgaagtatatgtaatgtacatacaataaaatgtacccattccaaatgcatagtgggggtttgacaaaagtgcacaccatcacaattaaaatgaaaaatatttctatctccccaagatgctcctttacgctcctttgcaatcatcacacccttaccagccagcccccaggcaatcactttctgctactatagattaaatttgcctttcctaagatttcatacactatgtactcttttgtgtctggcttctttcgctcaatataatgcttttgaggttcatccgtgttgttgagttcattcatttgcaatgctggggcataatccattgtatgaataaaccaaaatttgtttatctgttctcccctgatggatgtttggatgtttcctgtttttaggtaatatgaataaggctgctataaacattcccgtacaggtctttacgtggacatatgtttttatttctcttgggtaaatacctaggagtagaattgcccagtcgaatggcaggtgtatgtttaactttataaaaaactgctcagcacaatttgaattttgattttagatagagtacattgcattgctggaatgtacaaacattattatccttcctctaaattccccttgctttctttcctccattggaaagcataaatgaatattgcttgtttcacgaagttagaattttctttcggcaagactttgggaaggaagggaaataaaaaagagatcagaggaaatcactgaaacaaaattctaaggagacagctagcaactaacattctgcaaaaaccctgaggagtcatttacagccctgtgcattgtaattggcatcttttcggcttcagtccaggtcaaatcacttcctcccttatcactccacctccaaatatccttctcactctcctgcctacctgttgtcaagggaagttcagccagtgacccaagttttgtctgggaaaggctgccgttacaaggaagatgaatacaatcctaaaaggactgacaaatctaagattcatcccggtgatcactgacacttgaaaggtatgcatgaggtttcatgcagatgtgaatgtttgtccccagagatggaatagcaagtgtgctaagcccagtgagttcattaaatcttagtcgactcaacaatttctctgaagactactctaaggaaaatatgtgtttatatagtacttatcacctcttttttcttcgtaaaaatgagatgctaagacctttaatccaaagggaagtcttaaaagcttcaggatgagatcacagaattgtttctctccaggagtattttgggatcattgccatcactcaggagatcgtccagaaaaatcttccctaaaacagtaaactccagataatacagttatatcacctaattgggaaaaggtcaagcctagtgaaacacttgagctatgaggacattaaaaaaaagaaatgcaggtcttgtgtttggtttataagagcattttgacagtatcaaaggaggaaaaggcaaggtacagatggacttggcacacatatgctgccattactcaggcctgtgccactggcaggcattactaatcaatcccagtttttaaagagtagctttttcagatttgtttagcagtcaaatgtagaaagaggtccagaatttcctttatttttctcttttgttttgtttttccaaggcagagtctcactttattgcctaggctggagtgcagtggcacaatcatggctcactgaagacttgaactcctaggctcaagtcattctccctccttggcccccagagcagccacaggcacacagcactgcacccggcccagaattttctttttgacactaaaatttattggcttctctcaaaactaagatgccattattaatattataaataaaagtaagaaattaaacctccgtgtgtgtgtgtgtgtgtgtgtgtgtgtgtgtgtgcgcgcgcgcatgtgtgtgtgtgagactgggctaaagaaatacctttagaaaataatgtgaaattatactctcatacatatgtgtagggggtgggggatgtgagtgtttgtgtgtttgtagagaaagacaattgatatgttttaatactctcagttagttcaaccaggcaactcaaattttaatattttagagcttttgattgcagataaattatcacttatggaaatgaaacaaggttgagaatcatcatattcaacaaaataaacttaattctcttgaaatatagaatgagtatgtgatagaaatgagcactgatatataatttttaatgacattgttcatcaactcagtgttacaagatatatttgaaaagtatttttctccaaataattaatgttaagttgactgaagaacttagtaagaaacttccaaattgaacagaaaaccaaacactgcatgctctcacttataagtgggagctgaacaatgaggacacatggacacatggtgggaaacaacacacactgggtcctgttggggatggagcggtggggagggagagcttaatacctaggtgatggattgttaggtgcagccaaccaccatggcacacatctacctatgtaacaaacctgcacatcctgcacatgtaccttggaacttaaaacaaatataaaaatattttaaaaaggaaacttccaaattgaataggtattaaggaatattataaaaactactagatattgctagtgatgtaactaaaacccaaatgtcctactattctttctgtaaactctgggatttgctctgttaaagatctttattagtttggcaaaatgagttatataaaagtgggaaataaaatctattactgtttgaaactatttatctgtgagaatgaagattctcagaaccttgtttctcaaaggaaactacagaaactcaaaggaaactacctcttcaggtgatataagcctgcagctgttatttataacctccaaacagaagttcttgtggtcatcattctcactgactttatagttatttaaatattagaattttaacttataaaaaagttaataaactattgcctgttttatatattgtgcttctgaatagcattcatgatgattaagaatacaggacttgggccgggtacagtggcttacacctgtaatctcagcactttggcaggccgaggcaggaggatcacttgagcccagcccaggcaacatagtaagacctcgtctctacaaaaaataaaaagaaaaaaattagttgggtgtggtggcatgtgcctgtagtcccagctactagggaggctgaggtgggaggattgcttgagcccaggaggtcaaggctgcactgagcagtgatcatgccactgcattccagagcctaggtggcaaagcaagaccctgtctcaaaaaataaaacaaaacaaatcaaatcaaaaaaacaaaggaattcagtccttgggactgcactgcctaggtttaaatcctggccttgccactcattagctctgtgacctgggcaagtcatttactcaacctcccacgcctcagcttcttcatctgttcatcagcgataacaatacttacctcaaagcgtcgttgaaaggattaaataaattgtgaagtacaattaaataagttatgaagtactttcagaagtttatagcatataataagtgctatatgaggacctggtaaataaattccatttaaaataagaacttttctgctaaaatatgctaaaacccatgttgtaccgtgtgtttaattaggcaataattacttaaaatcagattgctcattgtcgatgcaaatcatggtaactaatcagctttgattaatattcttaatcaaaataaatggaattacccatgattttattcccccacaataaacttttaaaaatattttgatgaagagcatttcaaactttaaaaaaaagtatatatactctttttaacaaaatacaattataattaagataatatgataatataacttatgtggacaggagttttgccagtttttttcctgctgaattccaatgtctagaataatgttaggtatatagcaggtgttcaataaatatttgttcagtgaaaaataatttcttgcaatacaattttttactaagtgtatttaaagctattttaaaagcataaatattattcttccaattttatatactgtcattttaaataactttatattattccatcttatgaacacactttcttcacccactttcttacttctggaaatgtatgttaattctattgtcttgtgattataagtaaacattgtaacaaatacccataacaaatctttgcatatgcctctcattatttttttaggataatacttagaagtggctgtccagtgaattatacgaaattttaagaattatgattcattccatgtttatttagtaaatatttatcacatatgcaatctgtgctttgtgttagacacctacctgaggataccatggtgtatttacctttgtttaccttctaataatctaaggtagaggtcgataaactgtgacccatggtctacatatggcctactgcatttttttgtaagtcaagttttgttggaacacagccatgctcattaatttatgtattatctgtgttttcacactataatggcagaattgaatagttgtgacaaagactacatggcccactaagccagaaatatttactatctgccccaacacagaaaaaaattgacaaatccttcaaattagattgtagttttgtcaaattacactccagaaagtttatgttctcaactgtaatcagtgagaaatcctcacattaataaagtgaacatgtcttggtttttcactggatttttttttttattctttcttaaggaactcttcacacacacataatttttagcatggcattcatggataattaccaaatttgaaatgagtgaaatcagaattattgagatttattttcaatgaggcgtgagaaacattggctaagtctgtgtgattaggtgagacctcggcagttttatcaaactttcctgataggctcctaaggattgagaaggctggaacaatgaacatagcccgtatctccagctgcctggaaatacaatacgaaaaaggctggaattgttgaaagtgttagtatatcattttacatatgaaattcattttgtttattctgaaactaaccaacaataccttaaaaacttatgtaaacggaaatatctgttatttgacttttttcccccagcactggcctcacacaggcactctaatgattatttgtcaaagtcacactgtttgcttacaaggtatgaaggctttttagacactataatgacggctcttgattcacttgataatatttagaataagccataaaagctgatctctgaacgaacagaccgcttttattggcttttagtgctattactgctgtcataagtggaaaattggcctaatgcaagcaataatgctgtgtcatacttcaaaactgctacttggttttatggtttatttcttctaatgaaagtatggtcgagtatggggaggatctcaccacctcccgagcttcagggcatgatgccacctcagtctaagattcacttaagaaacagggaggggtgtgcttgaggatgggtgggaacttgcttaatgtcacaggtgtgtgcccattttttatacaaatggttgttgagatctatgtgccaggtacaggagacgaaagggcaagacagatctgattaaggtggaactcagtcttaatcagaggaagatgattgagaccctactggccagatttcattagccctctcaatgttttaaatttttgttgagctacaacttacataaaataaagcgcgcaaatcttaagtatatacattgatccgtttttacaaacgtgtacacctatctaaccaccaccccatcaagataaaaaacacttcagcaacatagacagctctcatcatttcccccgcctcccagtcagcagcacctttgcccccaacttcttctattacaattattttgcctgttcttatataaatgggctcatagtgtatattcttttatttatatctaactttatttgtccaacgttttgtctgaaagattcatttacattcttgtgtgtaccggtagttcaaaaattgctttgtagtactccatgacaggactacatatgtgtatgtacccaacctattcttgaggaacatttaggctgttcccagtagttggatattatgactgaagctgatatgaacattttttggttgacataaacactggggaggaagcccagaagtagaaataattgtagaatgggaagacttttagctttaggtggatactgcctagcagttttccagaatggtcccaatttatacatccgtcaagactgtatgagagttcagtcactctgtgctgttgtcagcatttagtgttttcaggtgcaatattgttttaatagatttgaatgcctttattgactacttgcacagaaaatatacttggctctagaatatgtcttttatgtacaactgagcctgtatgatggatatgctagggcatatccaacctggttggaacccaggttttgaaatcagagacatctaagttggtgctctatttctaccaagtaataactaggaggccttaacaaagtcacttatgtttcctatgcctcagattcttcttctataaaggatagcaagccacctcaaatcaaagggttgttgtaaaaacaaatgaaataacaattgtaacgtagagagctagtgtttgacatgtatctggagctcaatgaatagtttctttctcctcttcatagtggtctgggtggtcaaggaaaacagtgaagtggctctgagaaaatccgtctatatgtagatgcctatcagtatctaattttctcccttgtcaagctttctccctttcctaacatcttctcatttgcccaagcctgacttccaaatgacatactagatagattatttcctctgtttcactcactacatgcaatcatgacaacaataagtgccattccatatttttatttagcaagtgcactgtgataaatgctttgcatgtagtgtttcacaagaaccctgcaaagtacatattattattttcattttacagatgggaagaaaccaagactctgagagatcaaacaaatcatccttgaacacatatggagtgggtgatacagctaagatttgaaaccaaatccattcgattccaatggtcatttgattaactacaattctgtatatcacactcgtcagaaagacctctggactttatctccttcacatctctgagtacattgtcattttctcttcatcccctgtaccacacacaaatcttgtgcactttctcagttctcctccactactttcttcttgccaaatgtgtcaccccatcatcacctttcctggcactcttgatgagctcccagtccagacggaatctgggttgaaggctcagatttgcgttgctctcttgcgctacatgctgagtcctatttgcattaagcagctcctccatttctgcatttacagatgcaaacacacaccctggggtgtggaatcaggcttcctgagtagttgccaaggagctggatggcataaatgccatccctcttttccttccatgggctgttctggggcatggcttctccttgcatatcttttggagaagtctcctgggctgcacaactacacctgccaaaccacctgctgtgtcatatcctggttctttgtcaaatggtggccagaagagaaagacatcatattgcttgagatcctgtctttgctccattactgtagttgttttttagggttgctgtaacaaagtacaaccttggtggtttaaaactctcccagttcttgaggccagaagtgtgaagtcagtttcactggagcaaaatcaaggtgtcagcaaggctgcactccctctggagcctctggcagataatctattttttgcctcttccagcttctgggggctgcctgcatttcctgacctgtgactgctgcactccaatctctgtccccatggttgtatcatcatctcctcttctgtgtgtgtcaaatctccctcctcctctcccttaaaaagatgtttgtgattaaatttaggtgccactcatgtgatccatgtaatctctccacgtcaggatccttaactcagtcacatctacgaagaccctttttccttaagaggtaatatgtacaggttccaggaatcaggacctgacattctgggtggccattattcaacctactacatttaccttgtttcttacccttaccaccctaggcatgtaactctcaaataaggcatcaatactttcacccttgcctcaagccctgctttctaggggagctgagctgaagcattatctctacttttgcctgtattgaatgttgggactcagaaaacgatatcctaaaatgaaggtctcagaagcagcctcagaagcaaaggttcttctctgtcctcctttctctcagtctcattctcctctgaggctggccatagaaactagaatacctcttccccaaggcaggtctccaaagccagccataaaacctaaaaacattactcttagtttcccccgcctttctgtgtaaaacccggccatagagacatgatctgacctaacttgtttgactgtaggtcatgaaacacccatcccagagacggtactgccccacacccagaaggaagggacgctgcacagaaagtccaagaagaatctaaacagataggacttgctgggtttccctactcagtctactagcattagatcatatcataccctttttgtgtgatcgtatttctacacagctgtacatagtttgttaaacttacgtataaaaaaatgacaatttcctttgtatctttgggtcttcatgctgaaggatctcatgtacatgttaataaattttgtatgccttttctcctgttaatcagccttttgtgaactgatttttcaaggatgtttcagagggtaaagaggaaattttctcttggcccctacaattttagtgtagttgtcaggatgccagaaggatcatattaaagttcacatctgatcatgttcctcttctgcataaatttcttcaaggtaacctccccagattcgtgtcaatgccctaaattcttggttacaggaaggcattcaggaacctcctgatcttatccattctctctcaacttcattatttgactctcctctgtctaatgggtacgatcataagcttcagaattaaaccccgttttctagaattctgtctttaccattttctaggcaagtaatcgtgaacaggccacttagtttcttgggttctctgacatgcattttccttaaagtctctttaatagtagtggaggtgataaaatgagatcatataagtgtctagcacagggtaaaagctcaaaacaaacaaacaaattgctctagttatgtcaaatcatacacaggaatctaaacgtctgatattttatgtctctcggtatttatgcacgatggttcttctccctgaggaatcctcaccatcattgctttttgccccacctcaagtgaactccttctcgtctttggaattccgatagagaatcccatcctctgcaaagctttctctgattccagcagttcaaaattcttgcacatatgaatcataagtgcaccttgtttacaatgcaaattctttagcttcagccacagaaattctagttcatcataccttgggtgaggcccatgaaatcttcagttttaaaaagcatcttgggtaatttttgattgtacagtaacaccctgtgtactgcacaaggccagtcctggcttaggatggaagtccacctggacagacacattaccagaacaccaggggtgcagtctaggtccctttgcttgttgcatataaagccaatcactgagacaagtacagccagggaagaaggcttttttattcaggtgtttcagctggggaaatgggtcagggaaccaaaatctgttactcaacagattgctcccatctcctgggatgcagtaatcaaaaaacccttctttcctggcagtatttgctgtctcagggattggctttctgtgcagtgagcaatgggacctagaaggaacacctggtgtttcagtaacagacacaccacttaagaagatgtatccaccacatggaatctgatgtgctcccctatcaaattcccaaatgctaatgtgtcttaaacctaccacttaaactttgtaaatccgatcatgttagttacagaagctaatgattttccctatctctcaaatggaaatttaaagtcatatcatggcctgcaaggcctgctatgattgggccctgagcctctggttttagctcttatcactcagcctggttcattctattttgttggctttgaacattccaagcagtctcctgaatcaggaactttgcacttgctattttctatgctggaaatcctttctttctagatctaaacatggttcttgccctcatttcattctgcttctgccaggatgctgccaaataagagaggccttcctcgactaccttgtctatgcccttcttgcttatttgtcaccagacttaccacagacttgttactttacttattgcctcctattcctgactaaaatacaaatatctatgactgtttggtttattccttatgaaggatgaccatagcagtgcctggaaaagagaggtgtaaatatttgtagaattcatgaatctgccaacattctctccccaggatgaaatagtaaaaggggtaataaaagatgactcttataaccattgagtgtccaggcaggcctgtcactcagaataagaaaaaaatggagcaggagactgaaaaaacagttgattacatctcaatcacaagacgttgaggctagtgactcaggaacctcagtatgattctctccaccaataggtcttgggtatattaataataaagtcaagaaaatgcatttatcttgacatcaacagtagcactaggtggttgtgagcataagcagtcctgtggcaggagatgccagtgaatcccagcttcatcaggaatgaagacactgaaatagatttgcgggaaccttgtaaactcatgcagtcctctgattgattgctttttggttggtctgtgttttcaatgcactgtgcctggcagatagtaaatgctcaatagtggctgaatgaatagggcctggactttggagaacctgaaactggatggttattgttcaggctgacgaatactgaaattctccctggatactgtagaattgttcaaagagcaagggccttgaagagaggatttgaatcccacatacagcatcaaattactttgaggtcagtctcagaactagacagaactgggttgaaatcacaaatgtcagcctcccctagcctctgttacctcatctatacaatgagcttggttgtgtccaccacctacctggttcttgggcagattaaagggattcatgctggggtcaggcttttggagctattttcacaataacatttgggtttggatgactgcatttcaaagggtttcaagttagaatcttgatttcatacagagtaacagagaataaagagtatgtaatgcttattttttgtaaaaaaaaaaagagagagaagaaaaagaaaaaggcaaatatggccaaatgttaacatctgttaaatctggatggtgagtacataatgtatttttaagagaatgtgtaaaatgtcaataatcaagtatttaatacatgtgctattaataatcttaagattattaactctgctttacttctgatccctgatctctagttttcccaccaccctactgtcatacagaaggggtttccatgcctttgggtggcagaggtattggctattggttttttaaaatcctggaatgaacttggttttaaacctcagttggactggttttcatgagtgcaactcttaaaactgttacaacgttctagttaaaatttcatgaaagcaagagtcacagtgtatttcatttataggttttatctaattagagagacttaatgaatattaactaccaagaaatgtgttaatagtaattaggacaaggccaagataagtgtacttgctaatccctacgatttatttctgtaaactgctctacaattttatagagtgaagttagccttgttccaagttgtaaactaataaagtttgcatttgagttttcatatgtttccagcaagactctattaaactttctaaaaacaaaagcaaaaacaaaaagagaacctctcactttgaagaatgacaagagattggaacccatttactcacacagcaaagacatggcatcaacctaaatgcccatcaatgatagactggatcaagaaaatgtggtacatatacaccacggaatactatgcagccataaaaaagaataagatcatgtcctttgcaaggactgaatggagccagaggacatcttccttagaaattaacacaggaacagaaaactaaacactgcatgttctcacttataagtgggagctaaacaatgagaacacatggccacagggagggaaacaacacacactggggcctattggagggtgaagggtaggaggagacagaggatcagggaaaataactaatgggtactagtcttaaaacctgggtcatgaaatagtctgtataacaaacccccatgacacaagtttacctatgtaacaaacctgcacatgtacccctgaactgaaaataaaagttaaacaaaaaagagtaaatggcattggtgtaactgattcatgtgcttttgaagtttcattaacaatgttacatgggttaaacttaaatcactgcagttccaaattacctatttttttattttttattttttacttatttttttttaactttttttttcttttattattatactttaagttttagggtacatgtgcacattgtgcaggttagttacatatgtatacatgtgccatgctggtgcactgcacccactaacttgtcatctagcattaggtatacctcccaatgctatccctcccccctccccccaccccacaacagtccccagagtgtgatgttccccttcctgtgtccatgtgttctcattgttcaattcccacctatgagtgagaatatgtggtgtttggttttttgttcttgcgatagtttactgagaatgatgacttccaatttcatccatgtccctacaaaggacatgaactcatcagtttttatggctgcatagtattctatggtgtatatatgccacattttcttaatccagtctatcattgttggacatttgggttggttccaagtctttgctattgtgaataatgccgcaataaaaatacgtgtgcatgtgtctttatagcagcatgatttatagtcctttgggtatatacccagtaatgggatggctgtgtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgtccagtgatgaggagcatttaatcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaatgagatcccatttgtcaattttgtgttttgctgccattgcttttggtgttttggacatgaagtccttgcccatgcctatgtcctgaatggtaatgcctaggttttcttctaggctttttatggttttaggtctaaagtttaagtcttacatccatcttgaattaatttttgtataaggtgtaaggaagggatccagtttcagctttctacatatggctagccagttttcccagcaccgtttattaaatagggaatcctttccccatttcttgtttttgtcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcctttggcttaggattgacttggtgatgcgggctcttttttggttctatatgaactttaaagtagttttttccaattctgtgaagaaagtcattggtagcttgatggggatggcattgaatctgtaaattaccttgggcagtgtggccattttcatgatattgattcttcctacccatgagcatggaatgttcttccatttctttttatcctcttttatttccttgagcagtggtttgtagttctccttgaagaggtccttcacatcccttataagttggattcctaggtattttattctctttgaagcaattgcgaatgagagttctcatgatttggctctctgtttgtctgttgttggtgtataagaatgcttgtgatttttgtacattgattttgtatcctgagactttgctgaagttgcttatcagcttaaggagattttgggctgagacaatggcgttttctagatataaaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctgtgtttatatgctggattacatttattgatttgcatatattgaaccagccttgcatcccagggatgaagcccacttgatcatggtggataaactttttgatgtgctgctggattcattttgccagtattttattgaggatttttgcatcaatgttcattaaggatattggtctaaaattctcttttttggttgtgtctctgcccggctttggtatcagaatgatgctggcctcataaaatgagtgagggaggattccctctttttctattgattggaatagtttcagaaggaatggtaccagttcctccttgtacctctggtagaatttggctgtgaatccgtctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgacatcccctttatcattttttattgcgtctatttgattcttctctctttttttctttattagtcttgctagcagtctatctcttttgttgatcctttcaaaaaaccagctcctggattcattaattttttgaagggttttttgtgtctctatttccttcagttctgctctgattttagttagttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttgcatttgctgaggagaactttacttccaagtatgtggtcaattttggaataggtgtggtgtggtgctgaaaaaaatgtatattctattgatttggggtggagagttctgtagatgtctattaggtccacttgctgcagagctgagttcaattcctgggtatccttgttgactttctgtctcgttgatccgtctaatgttcacagtggggtgttaaagtctcccattattaatgtgtggaagtctaagtctctttgtaggtcactcaggacttgctttatgaatctaggtgctcctgtgttgggtgcatatatatttaggatagttagctcttcttgttgaattgatccctttaccattatgtaatggccttctttgtctgttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttaaatctttatccagtttgccagtctgtgtcttttaattggagcatttagcccatttacatttaaagttaatagtgttatgtgtgtatttgatcctgtcattttgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctcctttgcttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacctagatttggtcttttcacatagtcccatatttcttggagggtttgctcgtttctttttattcttttttctctaaactttccttctcgcttcatttcattcatttcatcttccattgctgataccctttcttccagttgattgcatcggctcctgaggcttctgcattcttcacgtagttctcgagccttggttttcagctccatcagctcctttaagcacttctctctattggttattctagttatacattcttctaaattcttttcaaagttttcaacttctttgcctttggtttgaatgtcctcccgtagctcagagtaatttgatcgtctgaagccttcttctctcagctcgtcaaagtcattctccatccagctttgttccgttgctggtgaggagctgcgttcctttgtaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacgggactctgagctgcaggtctgttggagtaccctgcagtgtaaggtgtcagtgtgcccctgttggggggtgcctcccagttaggctgctcgggggccaggggtcagggacccacttgaggaggcagtctgccccttctcagatctccagctgcgtactgggagaaccactgctctcttcaaagctgtcagacagggacatttaagtctgcagaggttatggctgtctttttgtttgtctgtgccctgcccccagaggtggagcctacagaggcaggcaggcctccttgagctgtggtgggctccacccagttcgagtttccgggctgttttgattacctcagcaagcctgggcaatggcgggcgcccctcccctagcctcgctgccgccttgcagtttgatctcagactgctgtgctagcaatcagtgagactccgtgggcgtaggaccctccgagccaggtgcaggttataatctcgtggtgcgccgttttttaagcttgtcggaaaagcgcagtattcgggtgggagtgacccgattttccaggtgcggtcctcacccctttctttgactaggaaagggaactcgctgaccccttgcgcttcccgagtgaggcaatgcctcgccctgcttcggatggcgcacggtgcgcgcacccactgacctgagcccactgtctggcactccctagtgagatgaacccggtacctcagatggaaatgcagaaatcaccggtcttctgcttcgctcacgctgggagcagtagaccagagatgttcctattcggccatcttggctcctccagagctacttatttttttatgaaggaaaagaatatcattgaaagcagttttaccataaaaagtatttttcacatatttgcatgtttaacatccagggccctggagccagactgtctggggtttgaaatcagctcctccacctaccagctattgacctcaggtaagttacattatctaggactctattttctcatctgtgaaatgggaataataatagcagccaactcatttttttttagacaattcagtgaattcatacacataactctttagaacagtgttatatgaatactgttatcattacgatataacaaatatatcgtattactaatttatcaaagtagagctattagctaccttctccagatggacctagaatcttgtctatagctctgttcttctacttctcacattgtattgtactgtactttttctgtttatttggtcttatctctcatcacattctgagattctcagaagggacaatatgttaatacttagcacagtgctgggaacatcggatccacaaatgacaaacccctggctgtcactttcccctgtggcttcactcataacagatttgctagctttttcccactcagaatcctcttcaacacaaaactcctgtgagtcactgacaacagattagaaaatgacagttcaagatgatatgtcttttcccctcatgtaatagatgctcactaaattttgaataatacattgtctttttaatgctcttctttcaagatgtgctgtctggtgatcttatcttcggcttcctggaagaatgtaggagtctaatattttctgctctcttatctttcgcctcttacttaaattgtaaccaacgttttgcagtggtcctgctttatttctcagattcatccattcattaagcatttctatcatatacaagacacgatggtttcaaagctgaataaatagtctcttccttcaagaaggtaaacatgattattgtataaaactattcctttatgaatactttatgtatttcagtctctcctgttgtactggtagctctgcatctcccttatggtagtgtggcactggacaaactactccatgtctctgaattcaagcttccctttatgaattggagataataataccacatagagttgttgtacagattgagtggtacatcttgtgatttttactcattgataacaattatatttatttgattgtttataatatatagtatctatctattagaatggagtctctgagagccattactatacatatcttgttggccttgatatcttcagctaaatccactatgcctgacacatagtaaactcaattattgtcacttactattgttaagcatgatatcactagtaatactagcaaaggtaaatcaggaaacaatcgtaaagatgaagcttgaattcaagccatgtggatctgactcctttggtttgagaggcattaaaaaaggatagtttataaacttgtaagtattttttatgccaaactattttttatctatcttgcttttggatgagtttttctctatgaaaaataactatttaaactccctaatgattgatgaaaacaattcatttccaaatgttttctcttttttgatgtacacatacttaaaactagatctttgatcacacacacacacatgcacacacactgtttgcagataaagaaaagaattattttcttttcgtggttacacaatgaaattgcaataaaaattgcagttttgttcaaaaatttttctttgaaggtagaattaccttgatagaaatactatataatgaactttcaataatagctttagaatatttatgatttgaaattatctaacaagaaaaacatacatacaattaattactaacaatttaaatgtttcatcttttccaaagaaataaaggctatttgcaggtagtacagtgcagaactttgatttctgtggtttgaagcaaaaaaaaaaaaaaaaaaaaaaaaaagtagcatattacatgacgagaagaaagaaaattcagtattcaccaactgctgctctccctccagctttttacatttctggaagtattcagctcccatcagtccaattccttaatactttctgtcatgtaagtctggtgaagcctacagactcctttcagaataatgttcttaaatgcataaaataaagtacatagtattacaaagaaaaacaattacatacaattatcaaaatatgtaaaaaactgtgatatagttgtatatgtgtgtccttattaatacattaaataagacttagaagtggaataactaatttggggatgagagccaaggatactttgtaatatcagcaacaacagaaattaaatagatatgaaaatatctttgatttctattagtgacaaaatcacaggcgatgctgatcctactattgtgatgttgcctatatttctgattgaaggaaatcttaagttttagttagaggttgtgaaaataaaacatctgtgccttacttgggtgccacagtgatataagatggtgttagcttggtttttgccaccaaataagacatttttttgtaggcctgttcctttccttccattttctctttccagaaaaacattctatttcactagaagtaacaggatttttttaaattacattaatattcctctggatagtcttaggaaaaatataacaatgagtatctgaaccttactgaaaggaaagaaaaaagaccttaggaacctggttatatttattaattggtagaatcaacttaccactttcagtttcatcaccttgtttatttttgtgttacatgttgaagcctaaagagacccttggagccagaaaaaaagagcaaagttatctgatgacagagggagcatacaagcagaagctcaagctatcactcaagagtttgagtgtactttgggcaacagctgggtgtattttaatatttatcaatttttattaaggatacagcttggctttataaagacatggccatgttttaagttgactcatctaagtttcctattctcagtgttttagaaatgtcagttgttcaaaataatactaccctagcatttaaaaactagtgtatagaaatttacagttttctgtagaatgaaaaacttattctttagaataaaaattacattaaattgattttttgaatagtgttctttataaaacattttcttttttgctaatgaaacctgttcaccctaggtcatgaatagaccttgtagtacaagaagtaatgatacttagattcaattctatttcaatttaacacatatttataagcattcactgctgacagacactactgtaggtacgtaggagaatatagaaaggaataagaaaccatatattccctgacagtttcaaaaaagtcagaaaaaaggagaaagagatcccaaaaatgactatgaggaaaaaagtaaaataataatagtagtcattattgggtgtgaagtgctcttcattcattattgctcattctgcaaggtagccgggtcacttagcatgctttcagctgcaaataacagaaaacgtcaactcaaacaggctcaaaaaataaagtaatttatgactcatatatccattttaaaggtagaatggctcgaggattgattaaatcaatggcacaacaccacttttaagaatccagatttttttccatgtcattttaggttagatgtgtggctttttgctcagtctggcttctcttataagatggtttcccaagtttcaagcatcacgtagcaatttgatggtatccaaaataggagactatctttttttgtgaaccatcttaaaggagccaatgatccaaaaacaaagcaaagtaaaacaaccaactcacctctcctgaagcaaacaaaaaccccaaaaacctttactagaagcccctagcagatgggttctcatgtctcattgtccaaaattatttgttgcctaaaataatcaatgatctgttgcctaaaattatcattggcaagggcagtgggaccattattgggttaaaccagtcagaattcttccaacttctgagatgggtgatggagtcaccctggaaatgcatgactgccctgagatgtgtggattcctgaacaaaattgagattgcttaagaagaatggaagaatggaggatggggaagcaaccaaagtagccattatgattttttatttatagctttggaaactgagtttcagtaatgttaagcaattgaccaagattaacatctagtgagtccagatttcaaatataggtatgtgtgattccaaaaactcaaccctttgactgaattattcccaaaggcttacataccataatgaaagcccagacatggtggcttattactgtaatcctagcactttgggaggccgagtgagataatcacttgaggccaggagttcgagactggcctgggaaacatagtgagatcccgtctctacaaaaaagttaaaaatgagccaggcttggtggtgcgcacctgtagtcctattcctaagtacttgggagacttgagcccaagaggttgagcctgcagtgagctgtgattgtgtcattgccctccagcttgagtgacagtgtgagaccctatctcaaaaataaataaacaaataaatatacaaatactacaatgcaaatattttaaagtgctgtatcttttgatctgtgatatcttttgattcatgttgaatgtgttaggcaaagatgttgcattttggtgtaattataataccttattttttatgaagctgaatgtggtttaatagaaatgtgcctcccacttgatctttgccttgtttcccatacttgctcattatattccttcatgaaaacaataaagctaaattatgtgtagaaatagaaccaatcctgacttgcaaaccttactgctttttgtacatgtatttaaaactgtggctaacatgcattaacttgtgaaagacatcaccaggattctgaatctgttttatgtcttagaattcattcaatgcagcagcagttttagtggtagggaaagggtgaaagccttttttatcagtacattttctttactttgtaataagacaaacataaaacgaatgagtcttttacccatatcactaaccatagacatcctttttccatgagcccccaaataagttgtagtttgaaacatgagatgcagtgacatttaatttaaatcctatgttttgtttccctttccaaatcagtttattgtcttactaagtaagagactgaaacagactcttaacatgatactttcttactgttaactatgggttccagagcctaccagaaaatggacctaattttagataaccaaaattcaagaaacactgagccccagtttatagaacccatcacctctcacaccgtgacattggttaacataattttccaaataagataatttaaaaaaaatcatttggttacttaattcacatcagttggaatctaccctacatttctctctgtgtttccagtggaataaaaggcatgatcatttacccagttgcttggaccttgtccttgatgttttcttttcttccattcccacagccaattaccagcaagtcttgacaattctaactttcaacaagttcttaaaacttcttttcttcattcacagtgtcattcctttaactcctgcttgggctactataagcccgactatcagctttcttccaatctgctttttctactcttcagcccacactgtagctggagtggtttttttaaaaggcatatgtaataatggcctctctgtgcttagtgccatttaatgtttcccattgcccttagagtaaactttcatatggctaataaatccagtgtgatctgcctctctggtctagtttattgtcaatatctgatctaatatccccatgctccccaaccgcctcccccaccacacatacgcacatactatggcttaaccaaggtgtgctgattgatgaattaaggaatatattattccttatcaaaatgttcttttgaaatgatagacacctatttctctctgaaccttgcttacttaaaaaaatatttttatgcacagtacactgcttgtcaaatttactattggatgatttaaataagtgtatgaattattttgcctagctcttggtaattagttattgtaaaatgagtccttacaaaaataaagcaaaagaatcaaagagcctatctgtttacttaaataagctggggaaagttcagatagatagagattgtgagatgcttgctctagaccacaaaaagaactggatatcttggtggagattaagagtttagatatttgagccactcaaaggttgtaattagactatacttctgcttaaccctcacgttgtttatttagtttctctggttactaatgacaaatttatataatctctgtagtttcaattggttagacagaaatatgaaggcttattattgcatatgtctgggtaccctgtggagcaatatgtatatttgtgttatcggaattctttgaaatgaaatgcattaaattcttccttcaaggatggaaaaatatttgacttagtttcctcccttatgtaaaacgaggagttaaaatattttcttccttaagcatttgtttattattatttttttccttttgtggggtatgtgttaagaagtcaggtaatttgtaaagtgtcatttgattacctaaagaaaaagcttaaactaaaaagtgttattatcataaactcacaggcttctgaccacagaagtacaattgaatttaattcatgattgaaaagtacagttgatgcataatggctatctgaaaaatgttatgtttgtttatggtttaaagcttttagagagtggtctcttactctttgctaattcctgctacttaaataatcaggggagaaatttttaaaaattctaaatataacaaggaaaatcagggtcacatctaagattgacaatcgggtgctatttgctgaatatgaaaaaacagggctgtgtataatataattttattgttggagagatggtttgaccagataaggatatttgaaaattaaagttagatttggcatctaaatatccttaggtttgcaggtttttgatctgtttattagccatgcaaaaatatattgctgtttcttaatctgatcatagttgattctgccactggagttattttttccccacactttgatgtgatatgttttattttcaagtgcttgtttcacaaagataagcaaacaaaataagatttccacttctctcctccaccagccatgtttttgtttagttagccaacatcaacgggaagatattaaaatgattaatccttataatttgtttgtgtcttaaattactggatattatgggagctgaactccaacttttatctcataaatatgaatgaagcaatattactaagttgtaattcattttgaactatttaatcactgtgatctacagataagttggcttctgaatcttcatctaatttcataactaagtcctctttctcgttaaaatcaccatgactgtgctgaagctcgtgtttagggaatccaactgaatgagtaataggtttaaaaataccccagctatattgacttgcccaaacttttccagtcttctttaattttatttgttgtaatgagtgcagatgaggggctcttggttagccatcttcaagtagatttcaaagcagagtctatgatagaagatgtactggatttaggatcagaatacctggcttgggacctggtcctgttgtttactacctgggtgactttggaccaaattatttaaacttttctgacctttattttcctcatttgtaaaaaagcacggtaatacttctgcacatatattttatgcaactaagctgaggcattgatgtgcaatagattgtaaagtgccatccaaaggtgaaaagtaaggtgtgaggatctcacgtggtgctttgggttagccagattataaggagataccaaaacatatcataatgaattcctttgagatttaaaagcagaaaatgtgaagcagcctgaatatccaaacataggtaattggttacatatattttgttacttcatagaatactatatgtagagccattgaaattatgcagtaaatctatgtttattgccctagaaaggtgttcacatttattcgtgaatcatcaaaacatgctattaaaatattgcataatcatattttattaaaattataaatttgtgcgttatttgtatacacacacaaatataaagcatataagatgtacagtggctatctatgcatgtgggaattgagaataatttttttccattttcatattctaatttttctaaaaaatagataacttacgtaaagccacacaaaagcacatacccctagagacatattaaaaattcccattgaatccagaaatctctgtaatctctgacaactcctgtctctctgatcccttaatatccagtccatggccaaggctcgttggagtcagcgttctcttgggtgccagccctttgttttcattgccctgaaaaccaatatctcaaattcggaattcatgccttctcatttgtggatgcaacaagcttctaactagtcactctggtttcagtctctacccttctagtccatcttcgtaatatcctcaactcacaaatcttttctaaagcacagagctgattctgttatctttaggtcctctctaccttcctgaagccaacctcacatatattttatggcttccctttgtttaataacattcagtttacactcttcaacctaacgttaaaagtccttcataatatagctaagatttatttcacactcccacacacgccctttctccagtcaaacgtagctatcgttctctgaaaagaacataccccagacttttctgcctccataccttgggccatcatattccatcagtttgtattgttactgcctattgaaacactacccatgatttatagcccagccaaattccccatttttcagaattctagatgtgctgcttcctacctctgaatcgcatatcttctttgaaatttatccttccatttattcatgtcattttttagcatctgctttacttcaggggctattgtacctcaaatatagaggtaaacaagccagaaacgcccttgcccttgagtaaacaacaatctaatacttaacatttctcctttatttaaatctattgatttatagataaactttccttacctaccaccttctcttacaacattatacagacgtttattataggcacatcgagtattatttgtgtttgattctctcatttaaactaccacgttatcttacaaattgaagatatccaataaaaatatagttagaagggcatagagacagatagagttagatatgtgtatttttccagcaatgtagttatatacatacatatatattatatatatattagcctttaaccatgttacttttccctgttgagtgttttcaaaaattatatttgattcctaattagtattattgtttcatctctaaaataaaaagaactagttatttctcccagttgtatctaggggaatccaagatgagactgatatttgttaagtaaaactgaagcaaaaagtacattcttctgtcatagaacaagtaatgttacaaaacccatacttggctatttgacctagagttcagtggccagtgagttgctttttaattaacggatgtcagcctacagaatgtagaggtttaaagctataccaaatttggacactccaaggtattcatgtcctataaacacagtatgtctccaagttatgttgctgtttttaaaaaaaagtcaagaaagccgttagtgcaattttctcctcttcttttgttcctaaataaatgattcatttagtaatttcccttggaaaagtgaactccttattatccattaagtacctccgctctttatgttatagtttttcctcatttaaaaaagacgatgttagctattttcttttaagaaaagaggctgggtgataaagattatttacacaaaagttcttttcttctgagacacagctgtaaaaaatttaagttaatattttaaaattaattctgttgtttcaagtgactctttagcatagttgttttagcccaaacctactgagtccattaaaaacaaaacaaaaacactttttaaattttaaggtaaatctgcatgtaaggaattgggtatgttcatatggtttcgtgtatgagagatttcatactgcaaaattccacccacattgtttttgcatgttctattatatttcaaatacagctaaagagcttgtgcttatctgaatcctatggtaaacaggatgtgttgctgatattttattttcccaactgaattataagtttctttattgggcatgggaatctctgtgtattccttgtgtaagtatgtgtcttgcaggaaatgaaaacatttgttgatttcatttacttaattatatattattttgtaaaacgaatgcttcttttacagtaggaatggtttgttttatcaatctgcgtttgcacatattggtctaacaaattagttttaagacaaacgtgaagtgtggaatcttaatttgtggcctgaatatagatttttgatacattcttaattctcaagaagatttatttatataaacttttcatattttatggaatttatattcaagatattgaacataaatattagcagatatattttggtaactctacaggaagtttaattttctatctataatgctgaattttctaaatacaaaaaatgaaatatatttgatacgtgaaagaggagttaaaatgcagattttcttctgttgtctgttgtttgagattagaaatcatgaagcacttttctttactttctgcagggtagctatttcatttcagatccatattggtgtggaaatttagctcaagaagaagaattgcctgatgtcttatttaatactatacttctatgagttgtcctctctactttttcttgaagttatacgctggcaaaactactgtcattgcccttgcttttcatctttgctgcacatttacttctcgacaggcttaaataatggctaaaatggttgaaatgatttatgcctgtagagtgatgtcttcatttgctctgttcacattcctttttttatcttttatttttttttactaatggtctggtgaacacctagtgtaggtgcattttattagcgagtatattcctctaaatgcagttcctaagctgaaagaaatgggccataatcttataaaagtaaagtatctctttgtagaatttactagaaatggaatgtccttattcctgaggcataaaacataagagacttttttttcctctcactataagactgctctttatactaatgttgattaagtgtatcacatcaacagctgttgtgacttgtaggaaaatgaatgattctactgaaaatctctattaaaaggtgtaactttcttgaaatttctagttatctacaattgtcttcttcctattgggactggaggattggttcctggtctctacagattgcttcactgttacttcataaaactgcaattaataatggtgagctaagatcattctggatttgatgtactgccttatcatcattgaacgagagtctctaaatgtgctatttaacaacttatcgggactttgcactgattaattcatctggtcatagtctgaagcctgacatggcatcttgtaggcctttcattccgttgggatcaatctcatcattttatatgaaatgaacttagtacttcataggcttagttggaaagaaattttaaccatcagcagtaggatgtgacactggaatttaatttgttggcctatgagaacacagaagatctcatcttttgctgaactttctaaatataaattaaagttatcagagaatcaaaatgattttgacatttgaacttcagtagaaggccaatacatttaaagtaagtattctccttcctgaaacattcagtgcttcatcaacagcacatatcacgtaagaaaatattattccttgtggagaagagcatgggtcattgctactggctcttagagtagacattatgttggggccacacagcatctattctccctttattctgatgctcgaaccctgaattccctctgaagaagcatctacctctcattgtgtgtagcattatggtgctggcagtcaagttttcttggcttgctaacccaggagtcagactcatggccaaagttattgagctttcttccttgggacttggactcttaaggaggagaataggaggaaaaaaaattatgcggagctaattaattccagaagtggcgatctgaatgtattatatcttgctcttaggctcaccagaactagattagttcctgattctcctgaacctagatttcccttctagattgtgagctactcttgcattttccaataaattacctttttcattaatgtagccagaatcagtatatgttattttcctctcaaaaaccgataaagctcccttttaatattgctgaattttgaaagtaatgtgccactctttgatagttctttattttattttatttttctgaggtggagtcttactctgttgcccaggctgaagtgcagtggtgtgatcctggctcactgcaacctccgcctcctgggttccagagattctcttgcctcagcttcctgagtagctggaattacaggcatgtgccaccatgcctgtgtaattttttgtatttttagtagagatggagtttgaccatgttggccaggttggtctaaaactcctgacctcaagtgatccatcctcctcagcttctcaaggtgctggaattacaggcatgagccatcatgcccagcctgatagttctttagagaataaaatgtagtaggatagagtttactacaatataaactatatctttagtaggcattcccagggttaggagtttattgcaatcccaaatgtcaaccagggtctatgaaaggctctagggcctgcttccagccaagctctctacactcatggaatcccagccttctcttgggtgaagatgtcccagtcactcctgttttctttcacttcttggagcatgacacgttctttcctgccccagtgcctgtatacttgccattccttctaccagaaattttatttaatttccatttctctccccatcaacagatgccatctcatccttcagatctaagcaaaatctcaagacttctcttgtccacatttctcaaaatagaataactcatctcatatattctattgcccagttgacagtttccatggggatacctcagaggcatttcacaagtaacctgctctacccagatctttggctcctcccttttctagccaatttctctctctcacttcaccattcatcattaccatttcacaatttctaaagccgggggtcagcctttgattcctttctttgtatcaccccacactaaggcacaagccagtcctgttggttctaactttgcatagacctaaaattcaattatttctatttcatcttcaaagttgtatcctatcccagttaccatcttttgcatggccaacagcaatactctcctactttatttctgtttcttctctttacctcatgcaatataaatgactgcatatgttaccctgtttagaatctcccgtggcttctaattccaaataggcgaaaaaaatatccagattcccaactgaccaacaaggttctgcattatttccaatttaagcaccttcttttccttctttcccctttttcgtcattcccttttcctttcccttccttcctttctatccagctactctgagctgtactatctttgcacaggctgttctctccaatggaatgcttttcccagatttttgcagcactggctcattcttcttatttaagtctcagctcaaataactttcccacagagagaacttccttgaccactgattctaaaggatagtcctcatgccaatctctatcacaacatcttgtttcaaagcttcgaaacaattacccttgtgaaattatctacttcatggtcttgttttactcatttatatgacttacaagggcatattttcacatctttttttttccgtcggctatgcttaaaaacaaaactactttctgtttggctgttaccttttcttcacccctatttttgttattaggtaacgcactttcatgagttaatgaaaactacagaaataagagctaataattccattacctgtgtttacatagtaaaaagagtctcaagatatgctatttgggaagttaacaatttaaaataagcattagtgtggcttaatatttaaatgagatacaaaaaatatcccgtttagaaatgagaattatctgagtgagagaattagattggattaatatttagttattataataaagcacttaagtacatgagttccttgagggcaggacattttcattttttggcatctttgtttctttgtctcacatgttttctctgcgttcaagaggagccacatcaaatggttgctgagttgaacaaaatgcatatttcagaattctattaatgttcatgatccaaaattattttttgaggaaatgaagtaagttgtcttcacttagaattaaagaaggaaagtccagtgaatttatgaatgtcaataaatgtgggaaagattctcagtttcttcgtcttatttgaacacaaacatgaaagtttaggaatgagatgagatttttctattatgcatttgagattttgcattatattgaaaagggaatttttggaacctggatttttttggacctctaggctcttttctagtattttggattattagtctctaatatgtgttaattctgataaccatgataaccagtgtattcaaggtgccaaaacactgatgatgtaacttttctatgtcaacactaaataagtttagaggcatttcctccaaaattcacctaaataatggagtttatttatttatttatttattgagatggagtcttgctctcttactcaggctggagtgcaatggcgtggtctcagctcactgcaacctccgcctcctagtttcaagtgattctcctgcctcagactcccgagtagctgggattacaggcactcgccaccacacgtggctagcccggctaatttctatatttttagtaaagacggggtttcaccatgttggccaggctggtctcaaactcctgacctcatgatctacccgcctcggcctcccaaagtgctgggattataggcatgagctacctcacccggccaataatcgtttttatatcatcaaagattgaagtcgtcatgtgactgcttacagaaaagaagctatacttaattcaaaataactacagaactctcatctttcacactctttccttcctggcatggatggaaggagagaataaagcttgtttattgcccattccccaccccctattttttttatcattttttttctctctcatgaattttcccatttgggtacaacacaatttaacagtcattggacagcaccaacatctggttagaagattgcaaaactactgctttggtgcattaaaggtacacttggaacttggaatgatttgtttttcccctattggtgacaattgtgaataaaatgtcccactaaaacaattataggtagctagttttctgaaggacaaaaaacttatttcaatactcttagcttcacattttttaggtcatatgattggtgtcttgactttgctcatatgtataaatatgtatgtatatgcatatatatgtacatatatacacattgactttgactttgctcatacaaataaatatgtatatgtatgtgtgtatatatttatatatatagagagagagacaaatagagagatagagagaaaatctgtgccaatgcagcaatgtttatggaaaaccagttttcagaaaattatattaggtttcatttagagatacaccctcctagaacagaagctgcaaactggcagtctgtgggctgaaatagaccccagagcctggtttcatttgtccttggtattttattgttgttgttttggtggtggtgttgttattgttgttgttgttacttaacctttaacaatcaggagatctcacaaagaaatccagatttccagtttctcctgaaaaatcaggagacactataagaaatcgtgtgcacttcaaacgctgacaatgctgtgattttaaactgcaaatggcaacaatttaagggcttccatcccttcatcttgatgtttctcttccgtatcaaatggtgtaagctacaggcactgaaatgcttacccagaatgctccttggcttaatggggtattacctgacatcctattccacctgtaatttccccccccaatttctatgttataacaatttttcctccataaagttttcacatttgggcctattttctccttctctttgatatggctttcattcaggtcatatttttctcgcttcaaggctgctaaatgtagctgtgtgtattagccgtcaccacccccttcccttaacatttcatctgctggctccaccccattttgcacaccagttacatatttacaggctcatatcacacaagccttgcctctgtttcttagttcttgtcctcaggcctccagtgacaacacagaaccaatgtccactacttaacctacagtcagcactcaatcggttttctcacttcattttgcattattccgtatatgaataatcagccaatatgcccatttccctagcactgaaataggcatcttccagcctctgatgcctttgctccctgcatcacctccttctctccacctgtgcaaagagactgactgccttcaagactggacttcctagaccaccttggcccacagtttgcataatgcagctcatcctgcctggtgcatatattttattttattttgaatcagagtcttgctctgttgctcaggctgtagtacagtggtgtgatcatagctcactgcagcctcaacctcccaggctcaagcaatctctggcctcagtctgtctagtagttgggactataggggtatgccattacacccagctaattttatttttttgtttttattttattttttttttgtagagatggtatctcaccactggtctcaaactcctgggttcaagggatcttcccatcttctccaaaagtgctgagattataggcatgagtcactatgctgagcaatgctgcatatttttaaatcatgccttgtttatccgattatcttaaaagagggtttctccaagcatggttttaaaatgaatgattttttgggtctgtcaatggtgtttctcaaataaaatttagtctaattttttgtaacagctctggctgtggctttcctagatctctttgacaccaccactgatgtgaacaggcccatgacccatttggggaaagtcaagggcaattaggagcctctttgccttcctggcaaaagcaagacgattgaatgagatgaatgaataataaggtccttgagtgcaggagagtatttcttttttgtattgttctctgccacacttacaccttgtctctagtctctccaattaataacactgaattgagttggataaatgatatgaatgtttgaagtcgagaagttagaaataatagcagtactcagaatggtgatgatggtagtaactcctgttgcttgcatgttcactctgaaatcaagcagtgcactcagtgctttgtgtcagtgactccagtgaagtgcttgttccaagccgaataaggcattgctgtgattacccacattttaacagtgagcagtgttcagctggagttccagagggaggcagcagagtcactgtcatgtgagatgtaaccactttgttcttaatgagaaaaacacttttttgaacaactgaaagtatctgtattatttttttaagggggagtgagggaggttggaggtcgacacatttaaaattctgattgataactgttgtggaagtcactgtaataaaatggtttaatgaaatgaatagaatttggacctcaaagaccgaggttggagattcaatttgccacttaagagccctgcaaatttgagcaagatgtaaagtctttccaagcctacatcccttaatttgtaaaatggggacagtaccactgcataccactttgttgtaggtattaaaaggaggaatttatataaaatactataaaaagcattgttgctattaccaatggttcaaagtgtgaactaagctctcaaaaaacataactgtattattctgagtaatgcttttaaagagggaaaaaaacagagaagtaatgaaatcacattcccataatctcataaagcaagcattctagtccccagctaggaaattgaggctcagggagataaagtaacatggcacaatcacccagctagtagatggctgagctgagatttagaaaccatgcctgcctgattccaaatgccatgctctttttactgcaccactttgacttttttaaatatatgccaacccatatactttttcttaacattgaaaaaaaagacatttatgtttgaaaactaactcatcctgataattcccaattaagatgttgtcatctagcatctggctcaatttccttttatgaaatatagtaaacataattcgagtgtagcttaaatgaagtgtccaaatgagataaaacaggtcacctgggaaattagattttatagattacaagaattcaatgcctacgctgtacttaatggacacgattctttttttaaagaaaattctttaggaaacaattgattggcctatcaatttcattattatttctgtatgagacatctgtagcacagagtaattaaagtaaaaataaataatatgaacttcaccataagtggtggtgaagaacatctctatcttcatggatttgagattcataagaaaaacacaggggctctttgatgcatgttctactttttttccttctacattgtttttaaaggattctatttaaaagaccttttcaaaaaaagaagttagagaattttcaagcttttaacagaaatgattctggaaatactttttgtctgcatcaactttagtcctgaattagagtctcttaaagagataatgtcctactattaaaattgcttggtggggaattgggcagaaataatcatcttttttctttttaaaataagtatatttttattatttttaattttatgtattattattatttttttgagacagagttttgctcagtcacccaggctggagtgcagtggtgtgatctcggctcactgcaacctctgcctccccagttcaagcgattatcctgcctcagcctcctgagtagctgggactacaggggtgtgccaccacatctgactgatttttgtatttttagtagatacagggtttcatcatgttggccaggctggtcttgatctcctgaccgcaagtgatccacccgcctcggcctcccaaagtgctgggattatagatgtgagccactgcacccggccataggtgtatttttaaattagggttgggggtagggtgagattaaggacaagagtggatgtgagggtatgatgaagttggaggtgttgatttcaacactgtaggaaaacatttttgagcacagatcatgttctgacgagtaacttaaacattttttttctttggaacatgatgaggtggtggttacattcacatgctgtagaatcacacaaactggcattgaatctcagctttggcactttccaattttgtaattttaggcaagttactagaactctttaaggctcaattttcttattggtaaattaaggataataactgcttcacagggttgtcatgatgattcagcaaaatcatcaataaatatcaataaacattgtcaatgttgatgttattgttatcattattttggtgttgtctaattaacatgacatatttattagagtttcctacaaccttataaagcaatttttaagaatgtcaactacttaagtaagagctgtccttttacaatataatagattcattaaatgctgaaaaagacgcagcatacctatttagataaaatatcaaatgttacctttttgacatattaaaagtgatcataaaatcaaaaaattataaaaccgtgccttctagtaaataatcacaggtttagctgtattttcaaaagtgcgcaaatctgtactcattaggagaacatattgatttgtgtgcgtatttcaagcaaccattttacgcatgcggagcccatggccgacagcattctcccctgggaaggtggcttctctaattgcagtgaatggtgattctatttgtagacatattttcctatagcaagcattcctttctgtgattattatttaaaaatacttgtccttaaattatttagtcttcttggctataaaggagaaaaatctacagcactgcaaagacctcacagataatataagtctgagtagaaaatgcatattaagtcttaccaacaaagtaatctatgtttcctgcaatacagggaccacaagaagcattttaataataaagatcctcaaacaaccacttaggccacataagaatttgaaaaaaaaagaaaagagtgaaaatcagaagtactactatttgaacggtcaggacaatttcctccttctcccacactattccttgcttataaacaaaagcaaaattttcacaccaatagaaaatcaagagcaagaagacttaccttctttcaaccaagaaatgttatttttatcattttctaaatgctcagctgttcttacttttatcttttccagctcagtttctgacatctaagtggaaacagaatttgtgatataaaaaattcattaagaacccaaatttataacatcgagttttatatttagaaactactgccatattatgggaaaattttatctctatagtttttcagttcactgtccaatgttaagtcttaacattttattcatttgtgttattttaaaacattgacattgaaaactaaactttatatgatatttctttgcccagcaacaaagattgttacaagaccttacaatttctcaatgtgaaagaataacagattaacaactagccatggatttgtaagaaacaaacaaacattcagtagctgttttagtattttctatagcctatagaaaagcatgctgcaaagtggtatgcaaagagacaaataacaataaaacacaaaagcatcttttcaggaatttattgggtgggaataagaaccttatgacctaaaccaggccaagttgagctccctgaaggtgttgacgagacctattacgaaccttcggtgcagtgcacttgactttcatggcttgctcgcaatgagctctgcttgaatcagcactgcaaggtactcacctgtgtgttccaaagggaggcccaaggtgtgggactggggagcagtgagctgcagcctcccttgtctctggatgtccagcattcctctatcctgacaaaaatgagtgaagaagcaaatacactccctcccggggtggtgctagatttgtattgctgccagaagcatctaacttgcggccgagagttttttttgtgttttttttttaaggtaatataaagcctgtggttgaaaacaataaaaaccttctccaggctagcacttatttaaaatgacattctgcaaaataggaaaaaaataatgaacttttcaactggaccaagtttcttccatccctgccattcattacttcaagttaatattaaaagatgtagaaaaaaatgtattgaaaaatatacacaggctattttggttaaaagaaaagaaagggaaacctttaaagctacactctggaaattcatcctgtagttgatagtttgaaaagtgagtgttttttccacctaatattttataaacaacaagaaaacatttcaagttttttttgatcatctgtagatattccaaagggagtttggaataacattccaaagatgatatgtcattaaattcttaggtaaggataatacagatttttgccagacatggtggctcacgcctgtaatcccagcactttgaggaggctgagacaagaaatggattgcttgaggcaaggagttccagaccagcctgggcaacatagtgagactccatttctacaaaaatttaaattttttttttaaaagttagctgggtgtggatatatgtctataatcctagctatgtgagaggttaaggtgggagaatcccttgagcctaggaggtcggggcagcagtgagccctgattgtgccattgcacttcagcctgggcaacagagcaagacactgtctgaaaggaaaaaaaaaaaaggaaaagaaaaaaggataatactgttttcaatggaagattaaaaacagaaagcataacccttgggtacacatcatgatgaatagcccaccatttctaaaagttgtcatttttctcatcaaggaaaataatatttattttttgtctcaaggtggcttgcctcctccagtgtctttacctggacaattgtccattatcagattcctttatccatttcacctcgtttcctaacttcatttctttatgtacattgctcccactatataatccttaaaaactaccttcatcagccaattttcttactaaaatagttttgtttctcccattattaataagataaatttcagattccttagatgggtaaggaagaccttgactggtcagattctataccacagttttcaaactggggcccacaaagttttaagatttcttgaaggttcctaacattttactccaacctaattgcattgtggctgttccttggagggacttgcttctgttatcaatactcctagaaatgtttccatctccacccctaccttgaaggcttcttcatctctctcacctggagatgatcttacccttctctgatcttacttgggacttttgatatgatcagtctccattctaatcttctgtaaacctttctcatcttcctgacaaaactataacctcctcctccccccagtgcaaccaagggcctagcctctatctcagtattttatgcatctgtctcagtgtttaacatgattgcccacaaattaataatcattagataaactaaaacagcatatcaaaaactgatgacagtattttcctttgttccaaagttgtagaatacatataattaccaaattcccttaatttgtctcttttctatgcatagttacagtgtttgatgtcacttcctcgggcatttggaaacctaatctaatttccttaataatttaatcactgtcttttggaaaagcaaattatctaaactttacatattagtggggccagaaagacatttgaacaacaataatcacagtgatctttaagcaatgagcagagacaacacaagagataaaggaaatttaaggcaaaaatatctagatgagaaaagacaattaagaacctggagagaatgagccagggacacggctgaagctactagtcctcccagtttattttcacttttattttaatatttgaccatatgattatcaatattgttcctcagcagaaatatatatattttaaaattccaagatggatttggatctttgtaaggttacaagtcatgtaatatcttcatgtgctttctaaggcagagaatccattcctacccacaaacctgagatgcttccaggttcattttgaaggctttctaaggttctgtgttcatttttatatacttgtatccttatgtccaactaaacagttttttaaattttctgtcccaagagcaatccactgcttaaatccttgtctgaatttctcactttggagagtatggattctttgattacagttatcctttgataattcttgacttataaatgctttccacttgcctgacttttccaattactatgatataattatttaagtcgaagcattagaatagaatctctgtacaagagtttattctgaagaggaaagatttatgaagatagtgtggtgactaatttggacataatattcaatttggctgatgtattttcaatatgtggtcagtcctaactcttggaatttttctgttgtttttctttatcatttttctctgcttggcctctaactgccatttgattttgcctttgccctttgaacaggcttttgttcttaagagagtatagcattcctcaaattttctatatagaattttcttgcattctgaacagcaacatttttcaaagttagacaaacttactttgaattttattgctgcagtcattccttataagagctgtaggtattaattagcataatattccatttttgtcatccacttcattagaaggatggtaagaacagacaccaagtactttttcctggatcaactttatatcacttgtccttgttggacattaagggtattccataatgatgccaacatttaacccatttattgatccacctagtgatatccttgggccccccaaaattgtcatctgggtaatggagtctggtttggactaagatttagtctcttgagatgggctgggccttggaatgaacaaagtgaacccacagttgatggctgggagtaaagagaatccagtctgatgaactccaggcaagacagactgggaaaccacagagacccaaccaaacgctcaaaagtgacaagccagcctaggacatcaggcaaatctgattagaatccaagaagagtaaatacatctttaaatgattccctgtacaaagagtgttcattgagcccatttaaaataatgaactaaataattaataaccagggatgtggtctcaaggctcaaggtttcttcttaaagtctgctttctttttaaaatggaaataactgcaaatgtacacttctttttataattctgttccctttattttgactcaagcctcagtatccctaattctgaatcaaaatctgatccagaaatataatctttaagggcaaactatccagcagaagataatctttgctaacagagtaatctgcaagattatcacacattttatgttccttttcctgttaaaatagaattaaatgcatgaagctagagctttttgaacaaacaaataatcagttgctatcacgagtccttttgcctttaaaatatcacattatcacttttcagtgtttttaaaacaataaaattatatatataatgtaagaagatgaaattaatcaatgcgtaggtatgtcaccaactcagattactgaatttgaggactatcatttatagagctctctgaaagatttctggattagatcctatacaaatgatataagaaggtgtactactgctttgaaagtatgttttctgctacagaatggaatctctgttgttcagtatactcagttaaaaaatttaaatagccattctaatgaccaatatataccatcaaatattgcacattaaaagaattctttttggaacttttcggccttgatatgaaaatacacatggtataaatcaacactagtctaaggtatcaaaggtaaaggtaaataaaccaagaagaaaattccatatttgtaacataggttctcccaggagaaggttacagctaacaccacaaggcatgcgaattcaaggatttatgagatcttagatctcaccaaaatttaggtatgaaaaataacactcagtgttacaaaatgcattaaattttatctttgtttcatgccaggtcattaaaaagggtgcttatcttgaccaaattatttttatacctgctttttctaactgagaccttggctggcattgagaaatcgtgtaaggataaacatgtgaataacagttgctagtaggtggtgtgttacggatattcttggttcctctgggggttacaatatgcatccttaatatagttcacatagcaaaaatgttgctccacttcatgttatgggtaataggtttataactatataatttcatttacatgctctctcctttgtactattattttcatatatttcacatctacacatgttataatcccgcaagcattgtaagtgtgtgtatatatacacaggcttacaggcatatcttatattattgcattttgctgtattgtgctttgcagatattgcatttgtttcctacaaattgaaggtttgtgtcaaccttgcattagtcaagtctactggcatcatttttttccaacaatatatgttcacttcaggtgtcagtaatttttaccaataaagtatttttaattaagataagtacaatttttttagacataatgctattgtacacttaatagactacaatatagagtaaacataacttttatacaaactgtttttttgtctaaccaaaaaataggtgtgacttactttattgtgatattcactctgttgcagcagtctggaactaaacctgcaatatcttcaaaatatgtgtatctgtatgtatatatatatgtatgtatatatgtatatatatatatggatatacacgcgtgtatagaaacacactgttcacttagctgtcttaaaaaataaattaggaggaaaaaaattcgtttaatgtttactttctaagttaccatttctggttttcttcattacatctagtagacctgaattttcatctcatatcattcctctttagcctaaagaattttcagcacttcttgaaatgtggatatcctggtgacaaaccctcttaagctttcatttgtctaaaaatgtctttagttcactatcatctgtgaaggatatttatgctgaatatagaattctttattgacaggttttttttgttctctctctttctctttttaaaaaacattattcttatcattgttcctctatatctaatgtgtctttttctcctctctggcctctttcactgttttttctttttctttctttcaggaatttgactaggatgtacttagatgtaattttctctgtatttttagtctacttgggttttgctgagattctgggtttggtaagttgatgtttttcaccaaatttagaacacttggcccatcattttttcagatattgtttttctgtcccattctctgtatttctccctctaggattccaattacacatatattagaccacttgatatttttacacagttcatagaggctttgatcatttttttccccagtcccttttctctgttcttcagtttgaataattcctatagatttgtcttcaaggtcactaaccctttcttttgcagttgccaatctaccattaaggcaacctggcatagttttcattttaaatacactttcagtgtgagaattaacattttgtgtgtgtgtgtgtgtgagtgtgtgtgtgtagttcttacttcttagatgatactacctatctcccatacatgatcactatcttttcctttaattccttggtcttatttattatacctagtttaaagtcactttctggcaactccaacatctgggtcttctattgactgcttgttttcttgttagtgggttacattttcttgattcttcaaacatctaatatttttagttgtatgctagacattgtgaatgatacatggtagagagtctggacaatgctgtgttctttttagagggtgttgaattttgtcatagcaagtagttaaattactggtataaccttttgattcttccaggttttattttattttttctgataatgggtcattttcagtctttttgcttagtcttaggatgtagttcatgctttaggacctggtaattgtgtccaaggcatgttattttttaggtgtcaaataaatgcccaaagtgcataaggaaatatctcctctttggttgagccagagtgtctgctagtactgtattaactgtgatacctatgttcagtgctcagtctcacaaaagctactttttgccagatttattcaagtctcatcctttgtatgcacagctgagcccttagccaagactatctgtggtgaaccctgtctcttctctacattatagagtcccctcttctccataaccctacactgcaaattccagccacttcaacaacccaaactcttgtctttgctgccttagctcagcaagtctgccactaaatttgggtttcaccttcctgcactatattaggaaaaggacagtgaagtcgagagctggagcaaacatgtagctcatcttttgtgtttccctactcttaagaatcagtcttgttctgcctgtagtcttaggcttgaaaatagcttcttcatatattttgtctggttttataactatgtatgaataatgcaagtccagtgtattctatcatgaccaaaagcagaagaaatttttgaaattcttttactcctatctttccaatcaatcacacagtagagatagtcttctctctctgtcctcctgtgacgggcagacacagcctagaacaaagagtggctaagctttgagattcaaatttcactttattttaagttttagaaggatagtagtttttaatgtaagtcttttttatgataagtaccaaagacttgagattccatttaagccataaatcatatgataggtaagaatacaaatttgcttaaaagtattctttgagctaaccatcccattaaattaaatttttacaagtcagtgggaaggaaatttggaagggatgtgtgactatggtttagatactggatgtttatttaaaaaaagatttggtatattattgcctcagttaatcctggaaaaaattgggacactaaaatccccagataatctgggaaaatactagaacagaatagactgttgtcgagtttcctagaaatacattagtaaatttcaagacttatagaaaatttctgcatccaacatggtgtccgagtaccagtggtagatggaggcatctagatggaaagatttgagatccatatattgtaaggacacatgtagagaatcccaaacttccttcaagcttgagagaagtgctgaggaccagcaaacaggaataggggtcctgatgattattagagatgccattagtggatactacagacatgatataagctgtaggcaatgcaaggttttagacattgggagaagaagcagtgggaaaagggatcattgcaaaggctagcagaaagtgctctacttaagtgaagaccaccagcaatgacagtgggttaccatgtagtaggtgtgctacccaggagcaaagcaaggggggaattattttgctccaaaaccctcttttttaagctagaaaagactgagagattggatttgcaagtttgttttctaccatcagcagaaatgtggggtcaaatgctaaattaaaatcagttatggaaaaataatggcatcgtatattttgttgatctgaacacatagccttactctatactttcatttcaagtcccctcttttctccaaagacctgcattatgagcttgccaatttagtcagcacctaaacaaccttatttagaattgatttcttcttagaagaggaccatcattactgacagaggttgttcagcaccaccaggccaccatgttccttccccactacagactgtgtccgaaatgggtcattcaagctggccaatccaatcctctcccaaaatttggaattgggatgcaatccattagcatttacctacttaggttaactgtagggtctaagtcagctagggcggcctgtttggaatgcgagaaaatagacaaattttgcatgtgagggaaagcaaagtaggcaacttcattgtgtcagtttccttatctgtaaagtggacataataatggcatctacttcagagttgttggggagggaggcagtgttaaacaagttaatgaaagtaaagagcttggaaaaaaacctgggcaagtcagaaacacccagtaaaggcttagcaattatgtttattatgagtgatttttgattttgcaactttattgaagtataattggagtagaaatgacacaggatccaggctaataaatgacacaaggcatatgctttgatcagttttgacatatctatacattcacaaaatgatcactataatcaagataaacatctgcatcaccccaacatttcctcaaccctttgtaatccagccctccctccatccccattcccaggcaaacactaatctttttgtcttttcctatgaattcaattgcattttctagattgaatataaatggaattatacagtatgtattctttttgcctaaattattttattcagcacaatgatctggagattcatccacactgttgtgtgaatcaatattcacttatttttattgtattccattgtgctaatatactacaattttgtcatccattcccgttaatggatatttgggtggtttccaattgcgaccattacaaatgaagctttatgaacatttgtgtataagtttgtaattttatgtttttatggttttcgtattttcaaattaaaaattttgaagagaaaaattcccaaaataaataaaactgtcattagaaaatgcaattgaaaaaatactcttcattaccctataaaattaattttatcctagaggatcaactttacctttaaaaaactagctgacatccagatagagtttttttagtatttgattactataaggccttcgcttaactaaaatatgctagaaaactctctaaaggggaaaaaaatgacataaaattagagacagtagaccagatactatttcttaccctcccaaaattgtagcgtagagatgaaagaatatatcatcttcttgtaaacgtgaagtattactttgttaaagatattgagcttttagtacatttgcaagctcaatttattttattttacaaacaaattacagaaataacagcatagttttctcactaaaaacctaggagttttggaatatttggatgatagtgactgcagcaatataaaatattgcttatccttcaaaaatttgctttactaagtttatattagaaattactttaaaattatttactaataagaaaacattgatttattggatcctcacagtacagtaccttttgctaaattcttaacaattttgtgaaataattatgtaaactaatagatattattgaccgaggtatgattatgcttaaggcaaagtcctctttaaccaatacaatatgtcagttaaatttatcctaaatcttagcatctgtctttctcttgagggaaggggcatcatttgtctacatgtagtcattttcctcttcatctcctaattgtcaagttctttgtcatcttgactgtgtctttgcttttgtagttccaagatctcctccccaaataggacagacaaccatgctttctttcgtccagtacttgatcttctaccaacatccgcgaaaagtacatttttttgtaacccaggagggaaagaaaaaaatgttatcttgatcagtcttttctctagaccacctctcatgggtcagtcttaaagcaggatatttaaatagattgaacttcaaatatattctcagtataacaggacttttggatccaaaaagaaattctaacatttgatcagctattcacaaatgatgtctttgtatcctttaaagaactataaagcaaataaaaaattgtaagcagttttatttgatcttatctgagataaaataattctttgaagagccatagagactaattagaaaagaatatcagtgtgtccctaaattataaaattagtaaagttaaaaccacacaggacctacacaggtaatgctacagtaatctaagaatacacagttgttaatgttatacaaattctaaggggaaaaatgagatttctggagaagtcgtgagaaaattttagggagcaaagattaagaaaaagaagacagtggttgaatttgggggaaggataagtggagatgataaaagaaatttctcattccacaaattagattgaaaatggcatctctttacttctcagataaataaaaagtacaaagctctttctcttgaattgtgaatctcctctaaaatgcacaggacgtaagaagaagaaaaagaaaagctgtcctttctctcattaatcttgtttgaagttaaggaaaatataaaattaatccgagattttttgtcattatgaaaggtaaaatgaatgtgttcatttcgtactaagtggcaggccttagtgatcccaagttcataccattcaaaggaaaattttctacattgccagctcatttctccgaattgtcaacttctctgagttagtatggtgacaccaggatgttttcttacatcactgtatgcttcctctttgcaaaccttacctaagtgggagagttgcaatggttgcctgatccatgttgtaagctggtacatgcagccatgcaggctgcgcactgcagaactccagggtgtgtgagatggctttgaaacatggcaacttggcaaggctgaactgtttcctagaatttctttccttgtatatttccagctagggagggccacaaaatatatttttgtgggagatttgaaagacaaatgtgacagctgctatattgttttattacattgggaagaagattggggcagccctttctgtagctccttcaccttgttccttttctgctggcataccttattgttgtgaggccacagttcatctgcaactgcccattttcctcctggagtctgcttcagcttctccatctcttgagctcacctggagataagctatcttcaggatgaagggcaccagcttctcctgcaggatgcctacttcataagggctggaggcagggagaactgacacagctccagtccaaactcatgggttctacctcaggctcatggattccagcctgtccatgccatcctccactttacattcattcgtcccttcctgacccccttctttggcagcttgaagccccagaatcagaaagaaagatgacagccctacagggactgtttaaccagctccccaaattgtgtaagttcaaatccctgtaacagacccctttacatctctctatctatctatctatctatctatctatctatctatctatctatcatctatctatctatccacacacacagaaagagagagagagagatctcccagtggttgtatgactgatagagtgcccattcacattgcagttcatacaagtggcaccacccacttgaaagttatgcactgcctgggaatcagatcagcggccctgaaggtctgtattaccatagcttaactagcctgaagaccagaatctttaatttcttgtttgtcattctagtcataggtgagaaatttaactccgtggtcaaatatatttgagaaactgaaatcatcccctccccctgcactgcgatcctaatacatattcacatagtaaaggcttttgtaaagctatgcactaaagtaatctgttcagtcctgctttcatcaaacttatttgactatttctaggtgctgtcgaagtacagagttaatgtaacttaaaattcccatttagtcagtcaaaaattgaatgcaacccttttattgtgatgtgataataagcatgtgatgaaaaacaattcttgctgatgtgcagtgtaattcattccagtacttttcagaagatcgaacaagagaaaggccagtggcagaaactgcgtcctgacataacaaaagcacagcgtaatgcatcatgatatataaacaggtgatagaggaaatatttctcctctcctctctccattccttttctttcttctccatcatgagttggaaggtgaatatgtaaatggccaaaaaaaaaaaaaagaagtgatacgattaggaaaaaaaggcattggatattgaaagctggaaccaggttagccttgagtgaaatgcaggaaaactgggcttagagtggttcttaactccggtgtttacatgcaaatgagatagttccatatgttagttgtggaagggacgattctggcaaaattgtaaaataaggtgatttttgatgctcttggtttctcttggtgatgcaagcagtgattctcagaaagagaactttatgttgcatagtaactgggaaacattactggtatatttggtaaaggaacctggggcattaaccattctgttatgcaggaaacatcctgcacaataaagaactgacctgccccaagtgagttgcttctctgttgagatacactgtaagtatgtacgtgtatttcattttctgttccagtcacctcacccatgcgggctgtgagtgtctcaactaagtgtggatctgattagctgacaaaagttactgcagaaagattggataaggctcaactttcaagtgttcatttacatttcaaaagaggaaataatcaactcaaaagcatctctaattgtgctgtgagagaggaaaatatattaaaacattttattagaacagtaatgtagtcccttatatggtgagaaattttgagacatttacttcctttgccatttgctcatttcaaattctactattactctatctgtccctccacctacaacaccctctttcaaaggaataaaatatgtgtggctaatactgcacctgcataacatcaacctttgccctttataaacagatgtttataaaaacaaagggccagtccttgaagaaaactggtaggtatatcagattgtaaatcacatctctgttagaataaaggaagtcttgtctgaactaccaggctaccattgccacccagcatagcctggatagccctaacataactgataaaccccttctagatctagacaccttttctcggatgaactgtgtttcttcacgtatttacaatccagttgattgttacaactttattttatctcatctttcactctttgtttcctagaaccgctctcagaactctagtaaaattgattttatttcagtcaaagcctgatcttgagatcggcataactgctgagtatttctgactttggggaatttctattctcatttttaatgtgctctctttcctccctccttccctccctttctcctttccttcctctttcccttccttctgccattctttctgtcttccttatttactctcagagtgtaacaattgcaaattggtgcagattcttaatataggctgcaaatgatgggtttgacattccagctatgccacttattaattgtctgattttgggggcaagttattcaaccattctgtgctgtacttttccaatctattaaatgggaattaataataacatccatctcatagtattattgtaggagtaaatgaatactaaatgttaagtggttaaaacaattgctaggacaaagtaaatatttaagtgtgggcagttattattgttgttgtgcagccttctttcccagtctgtggcagtgaactttcattttgacttaacagctctgaggtccatagccctcggcatgaatttcagtccagtggccatctcttatattctgagcagacacttggaatagctaaagaatattacgagagtttttatccttccatgtaggcttcctccctttttccccaaattttgaatatatttttctctcttatatgattacctttcctttatttttgttattcaattaccccataaatagatattctatggacatgagaattacatgatgatagcaagacagtcatggataaggttttatgcctttcaggcatcattgtacatatttgatgatgatggtgatgataatgataatatatatatattttttgagacagagtcacgctttgtcactcatgctggagtgcagtggtgcaatcttgtttcactgcagtctctgccttctgggtttaagaaattctgctgcctaagcctcctgagtagctaggctgacaggcatgtgccaccacacctggctaatctttgattttcagtagagatggggtttcgccatgttgaccaggctggtctcgaactcttcacctcaagtgatccaaccactttggcctcccagagtgctgggattacaggagtgagccactgtgtccagctggatgatgataataattaatactaatattcacatctatcaaatatgttatgaggaacttctgcttctagacacaatggagtaagaagaaccgatttgcttttccaccataaacaacttaaaacaaacaagcatacaaacaaacatataatccacagtaattagacattagacaacaagctgtgcaggacagtgacccctgaggaaggaaaacaagaggaactctatgattgcccagcttgctgcccagagagattttacagggttggggaacctagacagagtctggtagtaggccagagtggaggagacagaactcagaatttggggacgctaaggcaggtagaattcacatgtctgtgtcctgaagagaaggctgcaaggagagcaaacaatcaagtcttcagcaaaatatggctcaatccgtccaagtgaggaaacttcagagtccagggaagactaccagaaaggaaaagggagaaccacagccagagctcacacagggtccagaagaacttgtgtttccaccaggcagaataaaaagacttcaccactgggcatccagtaagtcctcagatatcatcctagtagtgagggaaaattcacctttgaatcagcctaatcgagcttggaaggaagccatgaaaggagccaaaattttccaaataacactgtcccagaaaaaaaggtaaaacatgttgaaaggaataaacaaatcctccagaacaagacaatgtaaagtgacaatgtctgtgtattagtccgttttcacactgctgataaatacacactgagactgggcaatttacaaaagaaagaagtttaatagactcacagttccacatggctggggaggcctcacaattgtggtggaaggtgaaaggcacatcccacatggtggcagacaagagaagagagcttgtgcagggaaactcccctttataaaactatcaaatcttgtgagacttattcactatcacaataatagcatgggaaaggtctgcccccatgatttatatctctcactgtgtcccttccacaacacgtgggaattatgggagctacaattcaagatgagatttgggtggggacacagcccaaccatatcagtctgacatccaatcaaaaattaccacgtacccaaagaagctaaccacacaatctgtagtaattggggagaaaatcaatcattagaaatatacactgaaatgacataggtgatagaattggtagacaggaacctaaagacagcaaatagaactatgtatgtcccaaaaggcagaggaaagcctgggcatgaggagaaacatggaagatctagaaaaacaccaatttgaacttgtagagatgacaatacaatttctaagatgcaaaacaaaaatgagttggataagaaagaacagattaaggactgcagaagaaaatatgagtgaccctggaaaccttgcaataattatccaaaataaaaacacagattttaaaaatgactgaaaaataaggaattgggcatcagtgagtggtgaacaactttaaacagtctaatatatgagtaattgacacccagagagtgatgcagtgaggagacagggaaaaaatacatttgaagaaataatggctgaatcgttttccaaatttgatgaaaattagaaacccacaaattgaagaagctcaatgaaatgcaagcacaagaagcagaaagagaactacaccaaaaattatcaaattacttaaagctcgtactaaacagaaaaatcttaaaagtaacttgagagaaaatgacacattacacagaataaaaaagataaatgacaacagacagtagccatctcatcagaaatcatgcaaactagaagacagttgtgcaacttttttaaatattgaaagaaaagaaatcaaccagctagcaatacagtaccaaattttagtcattcaattacttcatatagttaatcatggtcattcatcatatgaaaataagagtagcagtaaattttctgaaacatttagaattaaggtaaaaaaagtatagaactcaagtgtgacaggagaaactttctgaataaaagtgaaggattaaccatatatctttaataagttcttagtttttaaaagctctattaacatttgcctttatggttctttaaattccaaaaactctaaaatactatctgtgagacaattattggcaaagctcttttgctgctgttacatttcatttttcaaaacacttttgaattggtgaggaatgtgagagaggtgtggagctcagtttatgtctggttgcattaatcaattagtagcaactcaatcatgtatatcaaaactaagtaagaattcgtgcatgattattataaaaatattgtattatagaaaaaattcaggggcttaaattattgaaaatgtaattccacacagaaatttttctgttttaatagaaaatgttcaagtgattacaatatcctggagaaactagaaaacactaccagagaaaaatgagaatatgaattctggcatatttcatgaaattcatttgtagacatattatctgggactaaagaaaaatcacacaatagaatcttaaagattttcctttaaaaaaatttttaaaggcttaaaaaatcattttatctctggtttgcttaattgatgtttctcaaaactttattgaaataaaaggtttctaattgaataagcagaaatattttggttaaagattttcatctttttgttttgtaaattatcagaaaaacacctgtatgtacttcatacacccaccaagtattggtatggtagaatttgaaataatttacaagaaaaagttactagatgtttaaaggttaaaaattcaggaagaaacataatctaagtataaaaagacggccagaaaacttgattccaatgtaaaagactattaactctgtttcaaaaaagaatgaataattttaaataagtgtataaattatctagttaaaattaactgatcacacacctaattcggaaaaaatatataaactttaagagaaactgcaaaagtgaccaaagaaataatcagtaatattaatatctacaaacgtttttctcatttttaaagtcatatttttaaaatcttaatcatgaacttatagttgatctaaacccttcaaaacccacatatctttttctataattagttataaaactttgagaacatatcagtaatctgatgtacatgaaaagtgaaatgagctactaatattaaatggcatattcagacaagctatctttatctatattgtatatctatatttgtctttatataataccacttaatacagttttaggtttcctgaggtcttttataggtaagagacattaccagaaaataatggaaggagaggaaaaactcaatatttgcatatctattcattcaaacattccttcatttatatttccaacataaaaattgttgtttatataccctgcttgataattatgtcctataatattatgctatttgagtcagtgctgttggtttaaaagtaaccaagtgaagtatacgggagaagatgtttttggtttttaattaaatacaaaaataatagtaaattatagtgagtggttatttcaatgtgaaattgcctcacatctcagtaaaacattcaaaatgaatccgaacaaatcatttaaatttgtacacaaaataatataaatagacatttgttatatagaatatgaatgattgaagtgaatgaaaataaattatagacaactcattaaatataattttatacacttataagtgaaaggagaaggcaattacttttaaagtaggacaagtgaacattttacatcttttcaataatttcactttatttatgttgataacaatatgcataaaaaccctgtggtgatattaagcctgagaagattgagatccccaaattgaagcttttctcttcttagacaaaacatgaatccttcaacgtatgagctctaaagattatttaagtgtgcccacaaatctcatcctatttttcagaaatctcttctgtaacattatgtttatttccatcattcttctatatatttttttctctccaatgcatgatttcctgccgatgtcaacccacctacctggcccagtcaaaacttcgtcccgtgaagtaattggcactagtggatgagctactggtgtatcgctagggcttatgtacagcttatcacattctgggactccaaagagagaaatgtgtgttttctgtttctctcttatcagaacaagagttggggccacctgataatcagaccctggattttccacccccacaaatccaatttattcaatctattctaggcttaagcattccacatagctcttgacacctcactgtactttatgatagataaggaagaaaattcaaggaactattgatgaaaataaaacaacaaagtctgcacacacaaatcttgtcagagatgtgcactttcaccatgttaaaatatgattcacctatttaagcttttctaagcagcatgtttacataaatgatagaataaagcacagctgtttttgtttctaaaaattgtcagataatttgcacccctgccctttatctagactattaatgaggtagtaaagaaatcaagttccatttgattctattcacagaagactgtcatattcagataatggcacaattcagaatttatcaagtgccaggagattataaaagttaatggaacaaaatggcattagtgtaagattttggggaaacctcatgagatttggtacagtaacttcacaattaaattactatgtcactactgtatgtgcagacaaagggaagtgtggcattagtgaattcagtattgatagatctgatgaatgatctaaaaatggaaaccgccattgtttagataaacttgaatttttttgagtgtggctttctctttcattgcacaaatattcaaagcaaaggacatggcaatgtaagacaactaagcagatatattagaatgaatttcttctttaactcaaacacacagcattcaaaagagaaacaaatatgtttagggacatgaggactattaccagaagctcacttcagatttgtgttttgtttttctcttcgttagaactctcacataaacaggctgactgttgcaggattagttcacgatgttgaaaggacttccccgctcctggtgttccaggctagtaagccattcctaggttaagtcccttatgaatgactccaagatacctccctccatcctcattctggttgcaagttgcagttcctgtccactcttcttgtggatgtccaagtgtcatctcagaaccagtgcctcaaactgagctcacctcttggaagaagttacttaaaatagatcagtagtagcattagagtgagaattaaatgaggtaatggggcatttagcacagtgtctggcaccaggaaaatttggttttttttttgagatggagtctcgctctgacccccaggctggagtgcagtgtggcacgatctcggctcactacaagctccgcctcccgggttctcgccattctcctacctcagactcccgagtagctgcgactacaggcgcccgccaccacgcccggtggttttgtgtttttagtagagacggggtttcaccgttttagccaggatggtctcgatctcctgacctcgtgatctgcctgcctcggcctcccaaagtgctgggattacaggcgtgagctaccgcgcccagctggcaccaggtaagttcttaacaaatgttagttgatgttactatgagtaataaggtctcctacgtcctctactttaccaatattgttatctttccttgaccattcagcctgaaaaacttaaaagccatttttattcttctctcagtctcactcagactgtcttacttggtcacaaattcctttatgttctgtctttttagaatttttttttctcttgttgctgcagctaccattctttaacctcttgtttccaatattgccggactactagccattccccactcgttcttccttgtggacagagcctgtttcacactttggaggctgaaatgccacatactcatttcccatcctcctttgcacctagaacagaaacatgtgacctgatcctgccaatgagatgtgaggggaatgtctagggagggtatacttccctttaaacgttaaattaaaaaatattaaataataagtaaattaaaataataaaaaatatttaaatattcaaatggttatatacacacacacatgtataaaacatatactttttaaaagacataaatgggaactttcattgttttcttcactggatactgtcttgtctacatgttctgcctggaactaccacactcatacggattctgtgcaagaaaacataaccttttacagaatactaggttgaaagatgaaaaccatccgggccttgattttattttttttcttttcacacttttacatagagcccagcatctaagtacccaaagtggtcttctaattagtctgcaaatttcttctctatttctccaaattaccttacgtattgctgctgtatagcattcctccaacttgcctttatcatgtcttagtcctgcttaaacccctttaacagttttcggtttccatagtaatggtctccaaatggagtggagtgacaggataacccaatgaagcatgtgaagaaactgctagaaactgttaagtacgtgagagaaattaaacttgcccaatttcttacatattggttgacaatgactttctcacttggtttagttatctgatggtcacctattacacaggtggggaatcttcactgaaaatcagttggcaaagcttcctcacttgttcaatggctttcagaatattttgacatatggaaggttgcctgtgcctagttaagcagattgacagattatacagtttaattattttctaaactaactttcaaaagtggctttaagagatttttgttaaggaatcatagttgaagataacatagttatgcaagcagctttctgctatttagggaatgagctctttgtcagcttcatgataagacctaaaaaacaataacctaatcatatttgacatgaatcagccaaaaatatcagaattattaaggagaaaatttaaaatatggatttatttccactattattaattgtgacactatcccttgggaatagaatgccttgagataaaagtatatgtgatatatacatgtaatatatatgtacataatatacaaatgtatgtaatatataaatatatgtatattaggggcacaagctcaaaattatgtttcactagtagggatttaaatgagaaaattagacacttatgacctataggacaatgttttccttcttgctacctagtgaaattctgccccttctttaatatgtaattattataaataagtgcttccctttattgaatgcttaattgtatgtctggcactgtgctaggctctatgcatgataacatttattttgttcaatactcacaacaaccctgtaagctaaatatgactccctcatttttacagttgaagaagctgaaaattgaaaaacttgcccagagctatgttgctaatgaattaaagagctggggttcaggtgatgtttaaaccttaactactatactgaactatctctttagctcatctcaattcccatgttcctctaggattgacaatcaatggacaaacaaaagaaatacatatgtctactatttatttggcacttaattttatccttccttgtgacttttttatttctggatacctgaatttattcatcaaagccaatgtaatgttatgggaaaaaagttgatttgcttccaggttgtcctggaatttcatcgcaaccctcacccataaacctactgctttggggaaaaaaaaaaaacaactctatagttcccttatatgtagaatgggtataaaagacattctttagataagtaaacacgtagcacagtgcttgacacatgagcagtgaattaatgctattttctcacctggtgggtatatttcatctccaaacgcattgcaaattccttgagagcaaagtgtggatgttttactatttcgtttccttcactatattatgtacatagtacatgcactgtatggctagcccttagattcctcaaatatttgtcagtttgttttgttgaagggtttgttatgttaagcagaacaaaacatatttgcttaggttttgtttctttataatataccagcacacaatcatagttttcaagatttttcataaaaattttatctaagttttttttataataccatagacaatatttctaagacagaaagcacacaattataattgaacactctgaagttgagtaactaaagtagctgctttgaaataaagacagcctatttactttgccactgtgggattgtcctgctataattgtgagtgccattgatatactgtaggtgtcttgaacttgtgcccactcctgtctgggtaatttttagtcaatatcctgggttcatatcatgcttgcgaagtattgaagttaaattcaatttaccaccaccaacaacaaaacagttttattatggcattgacaaagggcaaagctgcttattctgatatttaaaaatagtgatctcagtcttcaaactcttcaaaggatagatttgaaatatgatattaatctcaaattaatctttcccattatgctgttatagctgtatcaaaccaggagaccccatcttggaaaaaaaaagagaattcaatggctgtagggaatcacagtccaggccctctgctaatataacaatttcaggctgaagttaggaactggtatcagcagcaagactgaaagttcatcctaaaaaagaacctcatattctaaatgaatagacttccattcaaggtcaaatttatattttaaagaatcactgtacaaaatagcactcagcacccagaaaagtctatgagcttagacatctcctaagcttgcagtttgattcagtaatatatatcatggctttagcttgaaaattgtgagcagtttctttgactctctaagaactacatgttaagttctatgaaagagaacaagtaagcagaccccaggtgttttgaggcaaggactgatttgagggcattatataattttaatatagtttctttggaaattgtatgcttcacaaatactcttttatactggtgattgtaggacaagagtaatcaatgtcgcagtgggtatctctaaagttatacaaggatttacttcctttcctgagatttccgtgtaacacagagttcccctttcccactcaaagacatatctgtcaatcttggaggtttgtgggagaaatttgtgggagtcagaaaaagtcaagcgtcaggaaactaacattttctgttctttggattggtaaggacatctcctacttatgagcagctttttctcttcattagtcttgtaaaacataagtaaaccacagcagtttgatgtctgagatggaccttggtagaataattcagtagttgaacttactagcaacattttattttcatcaatgtccatacttaatgtatcctctctttagagagagagaatcatcatctttcctttttgttagaagagttaaacataatagaaagtttgtgtgtgtgtgtgtgtgtgtgtgtgtgtgtgtgtgtgtgtgtggagagagagagagggagaaaaaattccactgaagaatagagctcctaccaggggttcatctattactagctattccgggaccaccaccaaagaatcaaatattctccctcatgttgcagaaaatcagaatgatttaataataatatctaacttaatattattattattaataataatatctaacttaatattattattattaataataatatctaacttaatattcttattaataataatatctaacttaatattcttattaataataatatctaacttaatattattattaataataatatctaacttaatataatattaataatatgtaacttaataatatataatctaacttaataatatctaacttaatatctaacttaaaactcccttaatagggagttttatgtctcctgctcttaggtagttaattttaaaataattgctctggtggtcccagatttagaaccatacacagagtaccagctcctcttctagtcaaagcttcctgagagtgggctggcaaagttggaatatagctaccctgttaagtgcttgttttccctattgtatattctgcttgatggctacatttcagctgttaattttctctagggaaaagcagcaagcaaagaatatgaataaataaatgctcaacatcttgcatgcccaggattcattataatttcttgcaatgagaatgatagatattttgcaatctttatttagggagatcttgcatcacttggcataatcatatgctaaaactgatagttgaagttgtgtctattcctcctcctagggtatggacttatacgctaacttaaataataatagagcattttataaattgatcataaaaatatgattctctaaatgaaatccactactcatgtactccaagaaaatttacataaaattaaatacaataatgtttatcgctttatcttttatctaataattacttttggttttatattttctctactgatcacattatatgccatagctttaatcttaaacattttatattaaatatttaaaatttaatttccttcccctagtttatttgaaatattttaatttacagatccccaaattctcattaaagaattaaacccttttgattgcagatttcccaatgtgtaaagattatagtcatctgtttttattatttattgaccaaaatttataatacatttcaaatatatttattatataatagattttaaaaagcagtgtgttttaatgagggaaatttgacttcagcatttgaacaagcctgtgctagaatcctagttctctccctcaaaatgtttacttgtgatttgaggcaacacatgtaaactctctgatgccctattttctcataatcataattagatacagatatctttattctttcttttctttttaatattataaattccctttactatattcaaaagcaaacaggaggataatgaaatatagaatcagaagacccagattcaagtccaagttttggtatgctctagatagatgattgtgcagaagagttaacagcaggcaggcaggagaaagaaataaagggtattcaattaggaaaagaggaagtcaaattgtccgtgtttgcagatgacatgattgtatatatagaaaaccccatcatctcagccaaaatctccttaagctcataagcaactccagcaaagtctcagaatacaaaatcaaagtgcaaaaatcacaagcattcctacacaccaataacagacaaacagagagccaaatcatgagtgaactcccattcacaactgcttcaaagggaataaaatacctaggaaacaaacttacaagggatatgaaggacctcttcaaggagaactacaaaccactgctcaaggaaataagagaggacacaaacaaatggaaaaacattccatgctcatggataggaagaaacaatatcatgaaaatggccatactgcccaaggtagtttatagattcaatgacatccccatcaagctaccaatgactttctttgcagaattggaaaaaactactttaaagttcacatggaaccaaaaaagagcctgcattgccaagacaatcctaagccaaaagaacagagctggaggcatcacactacctgacttcaaactatactacaaggctacagtaaccaaaacagcatgctactggtaccaaaacagagatatagaccaatggaacagaacagagccctaagaaataacaccacaagtctataaccatctgatctttgagaatcctgacaaaaacaagcaatggggaaaggatttcctatttaataaatggtgctgggaaaactggctagccatatgtagaaagctgaaactggatcccttccttacaccttatacaaaaattaattcaagatggattaaagacttaaatgttagacctaaaatcataaaaaaccctagaagaaaacctagacagtaccattcaggacataggcatgggcaaggacttcatgactaaaacaccaaaagcaatggcaacaaaagccaaaattgacaaatgggatctaattaaactaaagagcttctgcacagcaaaagaaactaccatcagagtcaacatgcaacctacagaatgggagaatatttttacaatctacccatctgacaaagggctaatatccagaatctacaaagaacttaaacaaatttacaagaaaaaatcaaacaaccccatcagcaagtgggcgaaggatatgaacagatacttctgaaaagaagacatttatgcagccaacagacacatgaaaaaatgttcatcgtcactggccatcagagaaatgcaaatcaaaaccacaacgagataccatctcacaccagttagaatggcgatcattaaaaagtcaggaaacaacaggtgctggagaggatgtggagaaataggaacacttttacaccattggtgggactgcaaactagttcaaccattgtagaagacagtgtggcaattcttcaaggatctagaactggaaataccatttgacccagccatcccattactgggtatatacccaaaggattataaatcatgctgctataaagacacatgcacacacatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattttgggcaaacagaaaaccaaacactgcatattctcactcataggtggggattgaacaatgagaacacttggacacagggtggggaacatcacacactgaggcctgtcgtgggttggggggaggggggagggatagcattaggagatatacctaatgtaaatgatgagttaatgggtgcagcacaccaacatggcacatgtatacatatgtaacaaacctgcatgttgtgcacgtgtatcatagaactaaagtatatatatatataaaaaaagcagggtatccttagaaagccctgcttgaaatgttggcctttggctggaatatgggaacttggatttttggaaggttcctactaccttaactgataagagtagttcactgtacctaaattgttgggacaaacaatatgatttatgctgtatgcctgccttccttcagggaacatgggattttattgtgtgttaggtatatggtgcttatgtaaacagctcccagtaaaacctctggacattgaatatctaatgagctccctggaagacaacattccatacctgttgtcacgattcattattgggggacttaaatgcatactgcattattccactgggagaggactcttggaagcttgcacctggtctcctcctgattttgccccttgcaccttttacttagctgattttgcttgtattgtttcactgtaagaaatcatagtacaactacatcagcatatagttgaatcttgtgagtcctcttggtgaataatcaaagctagggtcatttggtggaccccaacatagtgatcttgaatgagttaataagcctttctgagtctgttccctcttctgtaaaatatgcataatgctgaaaacacctgtctctcagggtggctgtgtaattaaaatgtgattttgtatatcaggctaagtgccatacatatgtgagtcattgtcatcatgtttattgttgttactattttcaccatcatcaccatatccctctttctggtgctttgggatatagtttcttgatggaataagtggggatgggagaggcatccaagtcactccccttcttcagcttggccctgctatgattccataattagcccacaagagaccatggaagagccagaaggatttgcacatgcagtgaccaattctgtcccagtagcatctaggactgtgaggcagaccctgttttttttggcctgctttaaaggcaaccaagaatattgtttttttccaccaatcaaaaccctgattttttcatggtgaaagaaagattgcatagtctcagtaagcacaggtttctatcccaggccagaggatgaatcctagttggtcaaaacaaatcaggataaaataatcttcttccccttgaccactgatggtttaagattgggcaagtgacaatgttctggttaatgagattggagactaagactgatagggagtattttccttcttatataagaagacaaaacctcaagaggcaaagactttttccacttgactattccctccctcttgtcaagaatataaatgtgatgcctggaggtgcagtggtcattttttgtccacgaggacataagccaacaggatattagagcagaagggcagaaagaactttgtccttaatagcattatgcagcagcaaagtatttccttgttaagacacagtgtctagcacacgataggcactccaataaaaaaaaactttaaaaatattgtttattgatattggatatacaaaagaatatttacaatagatcagtaatatgtaaagcctgttgatagatatccctgggaatcaaagaaagtattaaatccaaagtaaatatttgcttacatggttattggagccttgatgtaaaactgtccttgtactctcaatcctcaaatcctcttgttggattactacaaggaaaatgagcactttcacagcaagagtaacaaagcgtagtctgaatatagcttttaatagaaatgccttattctgtttataccatttctggttgtaaaacactattaccattgagtgtttggggtcattttgtttgaggcagaaattaaatagtgatgacagaatgcactgtttttttctttgcaaaaactgaggagagatcacgtggtgtctattataagaaagtttaggtgactcacttcaaacttgtatcttcagtagctgcagtaaacacctgctgtcatatttgacactgcttgttaataagtggaaaattttgaaagcttctgtatcttagcataactgcttagctggcttagaattcatgaataattgatgacaactttgagttgagacatattgatggtgtacaccagtgtagttggctttacactatattcattccaaagtatttgtcttagtgtctgattaccttctgaagaactcaattgccacttttttttcactaaattgattgattaatggctaactgcgagctacattttccaatggaatcccaagtgtcttttaggaattctgctgaagcatataacagggagtttatgagatatacaccctttatttccagaaacatcatcttttgacagaaacattaaaccaatggccaagggacagtcagtattgcctgaagtcattattggtgatgccggcatttccaatgtaaatgtgattatgtttctttttgtctaggtctctttcatctttgaatttctctcccttgccctttttctttggccagtgtttgcatattgtggcagttaagagtaaagaggtggcttgttcctatattatagttgaagtcattcagcattggcaaacatgagtagtaggtactaaaagttagttgtgggtgtaaaatgctctgaagagttacaagtgccaaggaagatagaattggagatgttactcttttaaagaagacagttttgtacttgaagccaattcctcattacatttttaaaataagctttttattttagaattgctttagatttacagaaaaattgggaagacagtacagagttcccaaatatctcacactcgattttccctactattaaaatcttacattaatatggtatatttatcacaattaatgaaccaataatggtatatttttattaaataaaattcatactttattcatgtttcatattttattcatttttttagttttaatattaactaaaggttctttttcggttccaggatgtcatataggatacctcattacctttagtattaataattatgcctcctttggctcctctttactgtgagtgttttcaaatttttcttgcttttgatgactttgacaatttcaaggacttctggttaggtattttgtagaatgtccatcaatggggatttggctgaagattttctcatgagtagattggagttatgagttttgggaggaagaccacagaggcacagtgtgattcttctcacattatatcaagggtatatacttgtagtatggctttttgctgttgacattagccttgatcaccttgataaagggaggtttgtcaagtttccattgtaaaattattattttttccttctttccttactgtactccgcagaagcaagtcactatgcccagcctactcttgaggaatggtcagttgtgctctacctccttgaaggtagattatctaaataaattacttggaattgttctgtacataggatttgttctttctcctccatatatttatgtattcatttatttattcatataaaaccatagatttttgtttcatattttacattataatgtatatatatacattatataatataattttatattattttattttgttgctcaaattgttctatctttggtcattgagagctttttcagttggttcccatgttcctttgacagacctccattactgggggtgttttgagcactgcttctaatttgtagcactaatgatatggacaggagacagggaaatactgggtagaagagagcgattaaccaccaaagaccccaccctcaagcctggaaacttgtggccctaaataagaacaggcattcctgttttcacactgaaaagttgccttttgacctgtcacacctccctatcccatacctgtataaaccccaagcccccagttccataaggagacgaacagaatagcagaagaatggcagaattgcgggccagagaaagagagaagagaaggagtgtctgaacaccaagaggagtttggcttgggatggttggagaggagattggccactggatggtcaaactccagggcaagatcatcttcccactccatcccccttccagttccccatccatcccactgacagccacctccaccactcaatgaaacccctgcattcaccatccttcaagtctgcatgcaacctgattcttcctggacaccagacaaggacctgggtatgaagagggcactgagctggttaacacttaagctatctgcagacaacaaggctaaaagaatgcactctaacacgtgcccatgtgggcttcaggagtcacagacacccacctctggatgctgccatggggccagagccaagggcacactccctggttcctgcacctgcccatctgattgctccccctcctgtaatgggtttgagtgtgaacggctgaacagaggagccacacccctgtcgcaagtcctgcaaggggagtcagagaactctgccgtttcattacaagatgctccaggctactcttctaaatttgctgccccagccctagaataagccatttctccaaggatgtattctgcttccttttattagtgaatgatataaaaaacaaatatctggatgttaattgtattaattattacttggatgtcatcggttctagaccttcttagttggcagagcaaagaaatatatgtgtgtatactaactcatataaatataaatgtatgtgcattctacatgtaacaatctatatctatatgaaattaaatatgagtttataccgatgtctccatctctaatccattaccacagagaccatactaattttctccccttgcttatctctaacctcctgctccaacagagtaatctagttctcaatatttctcaccagttttcatttttccattcctgtgtacatgtcaagtggtttcagaagtgctagcccatattcccataggaactaactttatcaagtggagtctgttcttacatacagttccttttgcccttaatcttacagattccaggtattttcagtgttacttagatcagaacctttctctcccaacactttcaagtgagactgcttcatacatttgtaattcagccagatagttttgtcccattttgcattttatcatttgattctctaacctcctaaataattttttaaatttcatacattaaagctcactctttgtgctgtaaatttctatggcttttaactaacacatagtgtcatctattcaccagtacagtatcataaagaatagctgcactaaaaaatcctttgtgttttagttattgaaccctcccctcatcccctccaaaacctcggcaaccattaatcggtttaccatttccattgttttgcctattccagaatatcatgcaattggaatcatatagtatgtagccttttcagactgttttttttaacttagcgatagcatttaatactgatccatatcttcacatggcttgatagcttattcctttttatcactgaataatattccattatatgcttgtaccacagtttgattatacattcatctattcaagaacatatgagttttgttgattatgaataaggttgcaataaatatttgtgtgcaagtttctacatggacatatgttttcaaatcagtttgataaataccaaggagcacaattgctggatcataggacaaggctttgtttagctttgtagtaaactgccaaactgtggttgaaagtggttgaaccactctgtgttcccactaggactgaagaaaaattccttttgctcttcacgctcaccaataattgatatcattaatttttttggattttagccattatgataggtatggcatttcttattgttgttttaatttgcctttccctaatgataactgatgtgcatcttttcatatgtttatttgacatctgtatatcatctatactgaaatatgtattcagatcttttgctcattgttttttttttttttcacttttggtgttgtatataaaaactcatcacccaacccagggtcacacagattttctcctatagcctttccaagaagttttataattttgcattttacatttaagtgtatgatacattttgattaattgtggttaaggtctgggtttaggtttacttatttgcatataaatatccaactgtttcagcacaactccttttaaactttcctccatactatgtgctttgaaagaagaggaaagagttatcctaaatgtttacttaaggggaaaaatcttctcaaacagaaatacctaaagagaaaatgaaagcttagggaagatgttctaactctttctgagttggtctaggttcttccaaatcctcatctttgatggactaagtaacatttatattttaaaatataatttctaattctaaaattcttacaaaagatgtattacagtttttgttttcaagaacaaaattgggcattacaaatgtaatgttagtattttatatataattgtaatccagtcttagaaaattccttattcaaggatgcagcaccatctctgaggtgttatgctttagcttcgagctgttgactcttttctgatatgcacaagctgatctggcaatgaaactgattctaaaccattatgcaaagacatgcgctgattacccactgatgatatattgattacagatcttagcagaagagaaatagagatcaccacccaacacatgaattgggtcattaggtggattgcaacatgctaaaataagatccacaaacactgacctgcaatgtacggaaatcaatttaatagcaaaccagactaagataacacaggcaagtaaatacatcatcagggtgatttcctgactataagcagtggcaagtacaaaaattccttagtgtggagcaaatatcttagtaggttagattttatttaagcaaagctgcattcattcacttaacttaaatatatgcattgtgtgcaaggcattgcaacaaatcaagggagggcaattaaaagatagaaataaacaaacttggctcttggcttttgccttcttaaatgtattagagtcttcgttcaagccatagtaatttttcggaactggcctaagtagagaagggagtttatattaacaaacacagcagagatggagaagggcccgaggaagtatatgctatgctttatgcttctctgtagcttcagacctaatttttctgctcctctcatcacacactagaatgtggctgcatatttacttattcaacaaatatttatgaatgctcgtgataccaaatattgttctaggtacttggatacagacagcagtgaaaacaagtcaaaaagacctggccctactaagtttataccctagtgtgtggaaacagacagcaagcaatacacatcagaaataagacatatggaaaacgttagggtcgggagcagcggctcactcctgtaatcccagcactttgggaggccaaaatgggtggatcacttgaggccaggaaattgagaccagcttggccaacatggcaaagccccatctctacccaaaatacaaaaattagccaggcgtggtggtatatgcctataatcccagctacttgggagactgaggcatgagaattgcttgaacccaggaggcggaggttacagtgagaccagatcgcgccactacactccagcctgggtgacagagcaagactctgtcttgaaagggaaaaagaaaagaacaatgttaaaaagtggtaagtgctaaaggtataaatgattggaacatactgaaggggactgagtatgctataaatagggtaggggagagaagggaggttgtgattttaaacagaatgtcagaataggcctcattgataggataacacttgcagaaaggcttgaataagaaatgtgagatttgatcatgccagtgcatcggtgaagatggtcatggacagagggaataaccagggcaaaggttctgtattagcccattcaggctgctatagcaaactacacagacttagcttaaacaagttttcacagttgcagaggctggatgcctaaggtctgggtgccagcatgtttgggttcttggtaagggcctgctctcaggtttgcagatggctgtcttcacaccgcatccttacatggcagagagagagagagagagctctagaccctccatccccttataagagccctaatccaatcctaggggctccacccgaaacctaatcacctcccaaaggctcactctccaaatactatcacattggagactaggtttcaacatatgaattttagggggacacaaacatttagtctatagtaggtctcaggttccaattccaggggtattggaacagcatagaagccagcatgcctagagcagagagtgtgataactaagaggtgagaagtgagaagtaacggggacacaggtcacagaggactttgcaggctgttaaaagaactgtgttttttttcccaaggaacatgggagctctgcgagggttttgatcagatgaatgatgtgattcactttcaacactagatcttacggtctgagctatatgaagagagacaatcaatctctctcccttattttttcaggccctgttacccagggagcaggtcaagcatccacccatcaccaaacattttttcccaagatgctgcggcttggtgtgtgatcctggttgctggagcacatttgcttcttcacaggtcatgcacacaagaaatgggggagtggaatggaagaacaggctggccacagtggttcatgcctgtaatcccagcactttgggaggccgaggtgggaggatcacccaaggtcgggatttgagaccagcctggccaacatggtgaaaccccatctctactaaaaatacaaaaattagctgggcacggtggcaggtgcctgtaatcccagctactcgggaggctggggcaggaaaattgcttgaacgcaggaggcagaggttgcagtgagccgaaatcatgccactgcactccagcctaggcaacagagtgaaactcggtcttaaaaaaaaaataaaataatgggaggtcagctttcagaaagtggggagcatttgccagagcatgtaaggcggccagcaacccattatttgttcacctcattacagttagaatctaataggataaaatgtgttcatatatattttctcacctgtattatacttaactataatgaggggtattgataaagtctcaggggttgttgagaggaggaaaaataactttctatgtggtcattaaatgcacttgagcttgaaagacagtttggatttggctatagagagatgaaggtcgggttgggaaaagaggtcatttaatgtacaaggaaacagtatgagcaagaagtcccaaatatttcttccccctggcaggggtaggtacagtactgtagacagtatattatgcataaacagattatgcatgagtttactcaggggactgctagaccactcaacaataatgggtaattgccttagcaaactcatccttctatcacttatgcaccccaacaaacactaaaagaaaaaggtattaagggcaaatgtcaatgtgaagtatgtttttttttgaacatgattgttgcactgagctcttgcacagcactcttctattagaaagtctatagatacattgattaaagaagaaggaaaatttccacttaaacttcttccttttggatacttaacttgaacatgagtgctggtgacacactatgatccaaattctaaaaaagacaccagaggcacttaaacaaaattatctattttaagttaaaaacaaattctgtgggtgactaaaatctccagaatgcaaaaagtgttcctcaaagttattaattgaaaataatctgtttacttgctctaacattttttgatctcccaaatattctataccaaagctacgttttctggctaaagaataacctttttttgcatgtaggtacattgaaattccaaataacaattatcttctattttgaataaaatatgtaaaatgatttactttagaatttattgctaaaattatacagaaattccccctttttaaagtatagtattggtatctaaaatctgagtttgtttcttgatatgtatttaataaattatactggaaacatcatgaaccctttatgatacaattagataagattttcaatgaaagataattccatatataatatttttcattacttcttcacccatattcaaaatttcaaaactaattgtaaatataaaactattttatgtatgtgtcttactagctatttcattcattcattcaaattctaagttccttccttattaaacttatgttctataggaagaagatgaaatgaatataaagcatgcaaataaattagtaaggtaatttcaaatattaagacatgctatgaagaaaataatttaggataatggaatcagaaataccatactgtggacggcctaatttagactgggaagtcagtaacaacatttctaaggaggtgacattgagttgagacttaaatgatgagcaaaagccaatcttgcaaaaatttaggtaaaaagcacttcagacaaggggaatagtcaagataactcctaaatatgaaatgagcttaatgtgttatatggtaggaaagaagccttgagcagtggttctatagtactcataatatgtacctgaaatatatcctatttcagatattatgagtagtttgtgaaacccctttttattaggccaccttataaaatcatatcattgagacagatttgaatttcacagataaagaaatattccctacataaaagagaaaagcataggaagattggccaggtgtagttcatgttaaccattacccgattcaaaaacaaaaggaaggattctaagaaaaagtaagttgatacttaagggataaggaaaacctccaaattttatgaataaatacctggatagagcctgctttctttaataagtattggtggggagaagtgtgggatttttgcaaggttctatagtaaaaaagataaagaacctggtatttggggcagagaagaaaaatatgtttccaaaatatgtattaaaatcaatagaatagttctatttccaggaagatggagatgtaattttccctattcctcttgctaagtacagctaaaccctctaaatattatatatttaaaatgcccaaaaatagggaaagaagaggacagacaggctagaaattatgggagttgagaaacaacatagtagtgaattccctgggatttgtttttacctcatatatcccacactagcagctgaagaaattggtcactcagaaatgctaatgagcacagataaaacaaacaaacaaacaacaacaaaatcccaaaagcctcctctctctaaccaaataaccaagaacgaggcaccctagcaagacaaaaacttttaggcaataatcactcttctctagtcaaacagcatggacaactgtgactctactccaccataacagcaaaggccccttggggactctagacctcctcactgattaggttcgtatttagtcaccccaactgaattgtaggacaatataaatgatttcatctgaacaacagaaaaaaaagagacttttaaaaagtaacaagccctgaggattttgggtataatgaaaaggatataatattcatgtctttggagtcctgataggagagaagaaagatagcagggctgaaaaagtagtcaaagaaataatgaaccaacttctcaatctggcaaaaaaaaaaaaaaaatgatgaacctatacgttcaagaagctaagcaaaccttcaaaaagttaaacacaaataacttcatcccaagagacctcatagccaagttttagtgttctgaaaacttaggagaaagaaaaaaatcttgaaaggagtgaaagagaaatgacaccttactttagtggcaggtaataattaaaaggagagcagatttctcatcagagagaccatggaagctagcaggaaatgacacagcatttttcaatactgaaagaaaagaactagcaacccagaatcctatatccagcaatatatcctataggaatgaaggaaaaatcatgacatcatcagatgaaggaaaataagagaatttgtcaccagaacactaatcctaaaatgcttaaaataagttctctaaacagaaagaaaacaatgaaaattccaaccttggaatgttaggaagaaatgaaaagcatgctaagcaacagtatgggtaaatccaatagattttctttctcttcttaagttttaaaaattatccttgagagttgagcaaaaatctcaacactgtctgatgtgatcttaaatgcatatagaataaatatttcaataatgtataaacacaattttgtagaaatagacaagaatattttaattattttccaaaggaaaaaaaggaggataactaagacaattttgaaaagaatgagtttacccaatttcaagacctattttatagctatagaaatcaaaactgtgtggtattggttgaggaatacatagattaatgaaacagaatagaaaccaaaaatagatccacaaaaatatacgtaactgacttttgacaaagataaataaacaattcaatggaacaaaaagataaattttttcagcaaatgatactagagcaattggacatccataagttaagaaacaaacaaaagaactactaagtttcactttatatttaaaatttatcttataacctatcaatggacttaaatgtagaatacccatttaaaactgggcaaaaaatccttagatttaccatcaaaatcatgatttataaaaggaaaaattgatacattggatctcatctgtgtaaaacaaaaactgttctctgtaaaataataaaacttttctctataaaagaaaaaacttttctcataaaagaataaaaattcaagctacttactgagagagaatgtttgcaaatcacttatctgagaaaggactagcaactagaatatataaagaactcagaaaactgcattaaataaacaaacaattcagtagaaaatgggtaaaagaaataaagaagatgtttcactgagaaggatgtacagatggcaaattatcacaagaaaagagatgcattattcattagtgaaataccaattaaaaccacaatgaaatattactatactacatgtcagaatggctaaaataaaaaaaatagtgacaacactaaatgctgtagaagttctggaaaaccagatcagccatatgttgctgatgagaatgtaaaatagtagagccactctgaaaaacagtttggtagtttccttaaaaacaaaatatgcaattatcatacaactctggaattcttgggcatttatcccagagaaataaaaacttatgttcacacaaaaacctgtgcataaatgtttatagcagcttcattcataataaccccaaaactgaagacaactcagatgtccttcaatgggtgaatggttaaacaaactgtggtacatctattccctggaatacaactcaacaataaaacgtaacaatcttaatcaatttccagggatatatgctaagggataaaagccaatttgaaaggttatctactatgtgactccatggatatgatattctgaaaatgacaaaattatagaaatggagaacagattatggttgccagggattagggagagagtgggagtcaggggtaaggaagtgcagctgtaaaaagaccaagtggtggcttgctatgatgattaaagtgttctgcatcattaatgtatcaatgtaaatatcctggttgtgatactgtgttacagttttgcaagatgttatcaccagaggaagctgcattaaaagtacccttctctatggtatgtcttacaactgcagatgaatctacggttccctcaaaacaaaaaggttagttaaaaaattaacagaagtataatttagcaagtatttgttctatactcaaactttaggaaaaccagctattttagaaaaaaagatgaaagatgagatcaaatgaagagtaaaatgaatactgactgaagcaattcacgaagactggaaatagtttaaagataataaaatgtgactatagaattagaatcatcagaagaagcaataagtaacagaatcaacccttcattcagtaaaaccaggaatgaggaggagcatgacgaaaatggtggtggtgctgaggctgcacctttcagacttctggctgcagggagtgtaactgtgtcactgacccagggcttcagctgctgagctgggaacccagttctgcattatgtgaggctatgcttcccacatgctgcctctagctggacagtgcctgagcatggcaggaaggcccagactcctaaatttggtttgaggactccacaacagccttgtcaaacttctttagactgcatacattctcggatgctttcacccagcgttccttccctctgtccttcactgggcatcagacatgcattgtggtctgattgcctttccagctttatctaggtccttctctgttttctctcacctgggtatttttcttaataaaatccttggacttttaatcacatcttggtttctgcttcttggaagactaaactaactcagatttaccacgactcagcaatagtacactaaagatagagattaaaaacaagggataaattgaaatttaatagttggaaataagctacctacccctggccagtgcaaagaacaccagtaaccaggtgcctaactctcgggtaggagacttcaggtctcttctgaattcatagaacagctgctaagagaagatccccacatactgacgctggagatctggttgagaatacagcatcccatgcaaccaatcagcaaactctactaagtttccaatcaattttctcatcacacattcttacatacaaataaatcaaggaccaccagctgttcaggaaatcttccaacaaggaagagtgatattgaaatgaatacatgcaaagagccaactgaaacatgcacagataaagtaggcataagaaaaaaaaaaccaattagaatcctcattcatacctgacattacttccatgaaacaaaaacagggtgttatttttaaaaataaataaccagagatcaaaagagagctctggagaatcttttaaaatgcttgcaaagaaatcagttttaaaattggaagatgaagtcatagatactttccagaaagtggaaccaaaaatggaaagaaagtgaaaacaggagaggggaaaaaaatctttggagtgagctaaaagtatctttaaaaaagagaagaaagaaaatagacggcaagaaattattaaataagtaatgcaagcgtaacttttcagaacctatagacatactctacagattaaaagtatccactgaacactcagcataaggagtaggagaagtggagaggtaaacggcacactcaggcacattgctgtgaaattccaaacgaaggaactatttcacttgttccttcaacaatcctttgagcatgtaatccaggttttcttatcacattttatttatgattcttcacatattctaaaaaaaagctcatcagaaaacaacctagcaaactaggagagacaaaaagacatacatttgtcataataattaaaatgaagtttaaatcaatatacatcaataggattagttctgaaatgatttgttccttaagtttatatgaatctgaattcctaacacttgattactgatctaacggtaatgactcagtgacattcataaaagcaggtattaatttttattcagtttctgaaaaagtgaaattgttccccttcattaacttttttacaaaatcattggctttttatagattataaaatagtatacattcatttcagaaaacttagaaattatcacacgaaataatataaaagttacctattaccccaaatccagcaatgacaaccattaagattttggcatatgtttttctagttttctttctgtgcctacaaaacaaaaccatcaaattatataatttaaccaactttaatcaacttaggtatactaacaaaaatatttccaaaatgtgctataccctaacctgcctaaataaataaataatcgaatatattttaaaattttcttgataaccctgagttctggttacaagtcccaccagtcatttaatgacattctcaagatccactgagagatgtcagctcctttctctggtcttccatggttcctcactattcttacttttaaaatacttgtccttttgttttttaaacaaaatatttgtattaaaaactcttaaacttttaaaatacctatcctttttgtttttttgtaggttgtgttttcatgaatgagcagaagttaaattgatgtttctttctgccttaagaataccaatcccaggctgtctctctttctaatttgctgtgggctgggaaaccacatagctacctttattgataatcatgacaccacccagagcagtacttacagatggcactttttttgagcactgactttatcccaggcaattactgtgataagtacttttaatcttcataataactgagaaggcaactcaggattagcaaatattaagtaatttgccaaaatgcatacagtaagtcacctacttttgaagtagaattagtagagcctgtaatctagagaagaaaaattatattctgggggttttaaccaactggtgggatggtggtgctattacaaacttggaacgtgcacccccagtggtaggtgagatgattttaggatgcattctaatggattttatgtacaaggacatggacatgaaaataaacaacattgaactgcatagcgagaatctctgtttaattcagcttccgttttcctgattatgtaaaggaaaaagtctcaatgagtgctaatgtgtttttaatattttattaaactcaggaaagcatctttttggcaaaaagagagcaggcctcagatacaaagcttttggtaagcagtggtttctagacagaatttactaacatagtgcttttatcatttatatttagggttaatgcctatttgtaaaatatgttaatgattttccctttatgaatgtgatgtttttaaataaaattttttattttaaaagttgagtggattttcaaaaagtgaaataattacatgttaaaatgagagcacatggacacagagtggggaacaacacacaccagggcctgctgggggctgggaggctaggggaggaaacttagaagatgggtcaatgggtgtagcaaaccaccatggcacatgtatacttatggaacaaaactgcacattctgcacatgtatcccagagcttaaaataaaattttaaaaaaagaaacatttaagaatgaaaataataataataacgtgttcacagggcaaaaaaagcatgaaagtgacacataagtgattcatatgacaaaatgtgtcaaatttatatcccttttattttaaaagtaaagagtattttctattaatgggatatgatttttcctgcctagaaaactgagtataaaggatgatgaagtgctttaaacaaaatggacaacttctccatcttgactcttgttgtgttttgttgtactacttctcttaagattaagtaccagaaggtctggtgtatctgtggtgtacttgagtcagttcgtacagttcccaagaaatgactgttaaatttgcagtggttttgtgagccaattgttaaacatagccattatcaaaaaataaagtatattgacttataatacataaattaccttaaaaaacaaaagtaatacgtatttgaaacttactgtttcctaattattttactacatttttgccattatctttacttttgtgactatgtccactctatctgtaggttgggaacatgacctaatggtgtgctaccatgcagctctttccagctccatgttcagtgacttcatattggtaagttgaaatctactatggcatgagtatttacactacagaaattggcaaaagctatgatttagtgctttttcctcctgaaaagctggccatttaatatttaccagcatatggcacggtataagagttaaaggaatggaacttccatatctctggccaggtgatccctagtgcaatgcttctggttgttggctcatggaaggcctctttgaaaagaaacagatggcaagtaattgagagctcattggccagaagtggcatataggagttgttagtcatgttagaaatgagcattctgtggattggaagctccacctgtcatctcctaaataggggtagaaaatatatcttctgtttttttttcttgtgaaaactgaagccaacttacttttgtttattgcattgctttgtagttaaaatgtatttatttcaataatttcctggcaagaagtattattcttcaaaagtttgattactttcttcaatgatgtgaacttattcttaaaatccatataatgtaaaagaagccaaagtagagagtgatgaaaatgtcagttgtcgtaacagaatttatggctttggttttaatactaggagtgttttgcaaatatcttgtctcttatcttgtgcacacagtggctcttattcagctgagagagaggttaagtgagaaatgagttggctcgccaaggatagatttgttccacccacccccagcccccaacacacatatacactcacacacacatactctgatgttaatttgatttgaaaaaatatcagaaaacatcatcatcaatttctcctcttgcaaaaatgattattcttgcttgactgccctctgctggaattcctgaaatacacactttgcctctacttacagggacaagttgtaggtggtatgtaacttaatgtgagcaatcttttcaagacgtagtatgtgaagaagcccaagtactcaagaatagaaataaaactgagttaagcattaaatgctgtggtcaagtgttgatttaattaaccatgaaaaatagccaggttttgaatggatcaaagaaaacaattatacctaatgggtgaactgaaaacaattgactattactgaaaaagaagaatgctttaattaaactaaaagttatatctaatgttaaatgaggtggttagaaaagctccacaaaaaagctgcttaactgctgagtataatatgagagatcagaaagagcgcttaaatgtttgtaataaaaaatgccaccttattaaaattgtatcactattattttaaactatcgcgagccttttctctgttctgtagctaagccgtcacacttaagactattcatttacttgtttaaaatatttagatttttcatttattgctgataacaatttattgcttattgctgatacagagatagtgcttttttctacttaattagattattttttgttttatttagagagaattattttagagataataatgattgcaatatctcagacctttataatgtactaggttagcatatacttttctccatacttgtaaggctctctggagttagaagaatgcagagcagttgtcaagcaggttgagttggtggcgaattggtgctgtgagactcacacttgaagagtatcacggtggaatattttttactataaagatcaaatccttcatctgaggaatttgagctagtaaatggaacagacttccgtcggcgcatttgctgatcaaagtctaaccctttattttattcaccatctcctttttatgtcattgtctatgtaagaaatgaacaaggggattagagaagaagggagggagggggaagataaagaaaagccaaagatttaatagaaaggagaagagcaaaagatctcccgccaccattttgtttcattcttatgcctcatatggattaaaacatgtaaaattaaactagtaaagtgccaagttttcctaattcaagacacggattctgcatcattgaacgttacaacttaagtatacaataaggacgggaccttcttagaaacaatgttaagtggttatggacattaattcttttgcagtaaaagctgataactatacaagtaagtcacttttcctattgtaaaaatgactgttatatgttttaaactgaggcaccaggggaaagtaacgagattatagaaacttccttacttcaccagactaaacgcactctattccagcaccatctcccagaccagcaaacctacagctatcatatttctttcccatactgatttgaaaggaaaatctgaaggcagactaggatggtagacatagaatttgatttaacattgtgagtgtcataagttgaatgcttaatcattgaatttttgaatgagatataacaattgaacacttctcagagtaagttatgataaaacatcataatataaatggaaaaaaattcatattttggaaaagtttgtatgtgctaagctttttggaattatgcatttatatttcagagtgagaatattaaaatattatttagtctaatataattctaaatgaagaagccctattttattaagggagaaatattagcagagcatacatgtaatgaatagctatcatgttttgcattatgaactatcccgtcactgtgctaattattttaccagcattctaccatttaattttttaaaactctatatgaggtaggtacttaaccatccctgtattacagataagaaaactcagcctcagaggcccaaggtcagagagacacgaagtgctaagatggaaactgtaatcctgggttttctgactttaagggcaaaacccttaaagacgtattgcatcagtgatgtcatcattttctctttgaaaacccctgtagtctccttgtgagtcatcatcctggttgtagacaaggcataagcagaactctgatctctttaagtacttggtaaatgggagttcttgggttcttttaatacattggctaactgaatgcagtcacatccgacatttctagattaccaattttcaaagaattataagaaattagacatactactgaaccactatggaaaggaatttttatcctctttggataaatttctgttgtctctgggccgtcatctttgttcatgtttccagaaacctattctggggaaatgatctgacagacagcctgctcccagagcaacaagccccttccccactctcatctcgctgcagcatctgcattgggcatgagcccggatccatatttacgagacatatgtagacacttttccctttcttggcaaatgcataaatagaatcctaatgtctacatgtaggtactatataaatacaaagttgtgcatactctgtggatgtcatgcatcatttatccatgtatttttagcgtcaccaacacatttacatatgctgtcacgtttcaaactgcacctcaatatagtgcctttttcaacatgaactcggctgcaggcaacatcattcttttaacattttcaccgcaagtgaagatcaaagagcaagaacataaatccaaaaataggagacaaatttaaaataggtaacacttttctgagatgctctgaggatactacaggattacctagagcagaggactgaatcttttgctatataaatagatccatgtaattattttaatgtacctattatgcttggatttcccgagatgaatgtttacaccttggctgttgtctacaggggataaagatatgcaaaccatcatttacaattctgtgttaaatgcctgtaaagtgtggtagaaaaaagggaaggattctttaaatatacttgaagaagtcaaagtctttacttggggaaataacatttggattgactctcggatgataagtggtggtttagattttcttttgtatcaaacatttaaaaagttagaaataagttgacctaacagatcaagtccaagattaaacattagaaattaattgatctaataggtaaagtcaaagatgtttgaatttctcaacagggatcagtctttgggaaaactagaagtagtagataatttgcctttctttcccttgtggagcccagaacacgtatgtctttgaccttatgtttctggtgttctgcatgtatagaaagtctgtttagtaggtttatggtagaaccataccaatagtttttaaagccttttctcttgagaagcagaacaatttattaaatgaaacatttcatggaatactaagtatgaaacagataaaggcagagactgagtctggtagaagtgaggaatagaaaaaaaaagacctacaaagtactttttgacaatccctggacttggtaaaaaagtgtgtatgtgtgtatgtatgtatacacatgtgtatcttttttttacatccctgaattgcttcttacctacatattctgtataaataactgttactaatacaagaagcttactctgatctgtgaaattttggtaacccaggaaagatctgctttttttttttttttttctccagtggctgcttcagtaacaagtgttatgtatgggtttcaacagtgactctcagagtatagaaaacatgttagatggagtttatcaggctcatgtccagtaatattgacagcatggggtctgcgatagagcccaagtatctatctctatggttgacattgcactccaagtaattctgatgcaagggtctataagaggcatggactaacagatagaccatagtaaagacaaaggggaatgaaaaaataaaataatagattgaaaggtaaagaagaatagaaaacagggaaatgaaagcatatggtaattgcagaaagccaacaaaacttgcctagtggcagagaaggaatatacctcaaaataacaaaggccatatacagcaaacccacagctaacatcatactgaatgggcaaaaattgaaagcctttcctttaagaactggaacaagacaaggatgcccactttcaccactcttattcaacatagtctggaaatcctagccagagaatgaggaaagagaaagaaagaagaggcatccaaatggaagaagagaaagtaaattggtccccttcgctgacaacataatcttatacctagaaaaacctaaagactcacacacacaaaaaaaaccctcttaaaactggtaaatgcattcagtaatgtttcagggtacaacatctacagtcaagaatcagtagcatttctatacaccaaaaagaaatagaggaggtaatcccatttacaataactattaaaatagaagaggactatgtatgtgcatgaacattttttgggtgaacatgttaaggttttagtacaaattaacttagatatttgatacagtacttttcaagagtcattttaatttgcaatgtcactagcactgtttgagaatgtccgtttccatgaccctcattagcatgtgtgatttatctttttttaaagctgttttttacagttgtgttattgcattgtctgtgtgtgtgtgtgtgtgtgtgtgtgtgcatgacagagagagagtgtgaattatctgtttatgacgttttccacacatgtattgatattttctttttattttacgtgagcatttaatatagtatgagctgcagatatatttctagcttttttgtctgtttagttgagttatggactcttaaaaaatgtatacatgtttttaattttcttgagatcttatctgttgacattctcattcctccctgccccctttcctcctaatacttaatatttctatcattcctacaatgtacagcatatatagtttatattttgttctttgcacataattcctgcatttatttcagttttatttctacaattaaacctttccagtgcccactagttgtcctttggccatagtttccccaattatctgttaggagaagttaatcctctggcagtttcatcaataaaggttcatgggaaaaataaacctgagttattgattgttcaaaactgtgtgtgtatttgtgcattttaacagccttatccttgaagggcagtttggctggatataaaaatctttggattacactttacttccttgagtatattgtagatgctgctcaacaaagctcttttgttttgttttgtggttaaaagtgtcaatgtgaagaaattcaaggccaactttatttcttccctctttaacaagcggcttgaactttttctcttactaccccaaagattcctttttaaaaattctatctttaaaatgcaagacattcactaagatttgtgttggtgtaagctggttctggctagtgttctgtggtatacagcatgttcttcttttaaggaagttcaagtcttatttattttatccaggacatttttcttgcattaaatctttaccttaatttcctattgttgtaatcttcttttgcaggactctgaaaatgcagatggtacatctccttttcctacattctacaccttttatgtttttaatctgagctttatttccccttactgtagtttgttttctctctatcttccatatctcttactattttttccacagtgcctgttttcccttatattccttctaatttcatgttcgtttctactataaatcccgcatctctttcaatgagatcgtgttatccatttataacgcactcagattgttttgtcacattatttttttttctgggatatcttgatctcacaaatatattttctaaaatgtacatttattaaggttcattctttatgctataaagttctatgggttttcaaaaatacaatgtgtcatatatccaccactgcaatatcatacagaatatttttgccatcctaaaagcactttcttactttctggcatcataaaatgctccatgcttttcttaatacatttcctccctgagtcctgtttctccagggagtcctggttgcttttattggcaaatggtattaaaaaccaatatctgggtactagtatttctcattgccattggagtgtgtatatacacacacatatatatgtgtgtgtatatgtgtgtatatatgtatctatatgtgtatatatgtacacaaacatcccaaatgtacacatatccataaatatttctatatgtcacaatctgtacctatattagactcaatatgaattatgaatttattctaatgtaccaaactctaatgaccacatgtattatcagagcctccccatttcttatctgtaaactcctattccagtagtaagaaacctgactactcctatttggaatccatttacttgttaagtccagtgaacatttatgtttcagaattgttaacctgtacccttgcaggaaacaacttttatcaactagagttctgcagttaggtgtagtttcttttgcctcttgtcttacagaacccactcagttctaaagttactctgagcagtatctttcctcccatcctcttcagtgaggtagttttatacatttgtaatgcactgattgttttgtcactttcttcaattttttgggagatttcttgacctcctattttttaaaatttacatatattaaaattcctcccttgtgctgtaaagttctatgggtacttatatattgattattacagtatcatacagaatatttttgccagcttaaaaattgtttgtgctttaccttttctttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactgcgcccggcctgtgctttaccttttcaatcctccttgtctctcttcaaagacctggaaaactctgatcttatattttgcttttttccaaagtgtgatgtaattggaattatgtagtatatagcctttttgcgttggcttcattaaacttattaacgtatattggtgattcttccatgtctgtttttttgttttgtttcgtttgtgtttttatgttttttttttttttttgcctaatagcttatttctttttatcactgaataatattccacagtatggatacaccactgtttgtttattaattctccaatgaaggacatcttggtggttaccatgttttagcaattgtaaataatctgtcataaaaatttatgtgcaagcttttgtgtggacataactttgcaaatcaattggttaacacaattgctgaatcatatggtaagactgtttttagctttgtaggaagctgctgaactgtttttaaaagtgattgtaccatttttcattcccatgagtaatatagtggagctctgttgctccatttccttttcaggaattgtgctcctattatattttgaattatagccattctaatatatgtgtagtgtttcttttcattgttttaatttgcattttcttagtgacaaatgaggttgagcatatttttatattcttatttgtcatccgtatattttctttactgaggtttccgttcgtacttttgctcatttatcctttgagttccaaaaaaattgtatggatatataattgtacatatttatggagtatctgtggtgttttggcaaattcatacagtaagcaatgattaaatccgggtaattgagatatctttccatcacctcaaacagttatcatttatttgtgttaagaacacaaatcttttcttccaactactttgaagtatacaataaattacggacaactatagtcaccctattgtggtatcaaacactagaacttattctttctatctaattaaatgttttatacccattaatcaatctttttttacccatcttttcccccatctttcctagcctctggtaactatcattctactctctaccttcatgagatgaatttttaaattttttaaaaattttttaattgaaaacatcaacttaaaacaaagagatcaacttttttagcttccacatatgagtgagaacatgtgatatttgtctttctgtgcctggcttttttcatttaacctaatgtcctccaggcttatccatgttgctgcaaatgacaggatttcatcattttttatggctgaattatattccattttgcatgtatactacattttctttattcattcatctgttgatgaacatttaggtggattccatagcttgactattgtgaacagtgatgtattaatcatcggaaagcatatatttctttgacttactgatttcctttcttttggatatataccttgtagtgagattgctggcttacaagatagttctatttttagacttttgaggaaatttcatagtgtttttcataatggctgtactaatttaattcccactaacagtgtactagagtccccctttctccgtatccttgccagtgtctgtcttttgtttgtttttgtttttgtttttcttcttttgtctatttggtaatatttttgcccattttaaaattgggtttttttttttattgttgagtttgaagagttttttatattttggatacaagtcttctatcagatatgttttctgcaaatatttcttccagtgtagaatttatcttttcattttcttaagtgtcttttgcagagcagaaatttttaattttaataatagtaagttctattttaaaaatgttttcttcaggcagtgcttttgttattatatctgaaaactcatcctcaaattcaaagaacatagatttcatccaatgttttcttatttacttcaacagaatccaataagaatactatacagttattagaatgatatttgtgaaggtttttaatgatattaaaaacatttaatgttaaaccaaataatagtaaataaataaaactatatgagcagcatgatgtcaattaagttaaaatgcacagagaaagactgttaggaaatattctaaaacattaacaatgtgacttgcctgagtgaaaaaaatttgtagatggtctttatttgccatctataattttctatagctttcaaatttttaataacaaactcagagcatttagatgtatggtaaattttgagttgatatttgtgtaaaggtaaaatctgtatctaacttttttttgcgtatgggcatccattttctaatgccattgactgaaacattatcctctctctattgaattgcctttgtgtctttgtcaaatattgctttcctgtatttgtgtgggtctaattctgggctctctgttatgttctgttgatttatgtgtttattccttcaccaacaccacactgtcttgatcactgtagttttatagtaagtttgaaatttgggtagtttgagtcctccaactttagtcttcaatattatattggctaccctaggtaatttgcatttctgtatgaactttagaattattgtcaatatctacaaaatatcttgctgtaattttgattgaattgtgttgaaactgtagattgattcttctggtaagaattaacattgagtcttccaatccatgaacacagcacatcttcccatttatgtagattttctttgatttttttaaattaaagttttctatacacagacttgtatgtattttgttagatttatacctcagtattttattttttggtgctattataaatgtctattttaaatataaattatattatttgtaatctttctaactccaattatttgaaagccattgcttttatataggaaagcaattgatttttgtatattaacgctgtatcctacagcttcactatattcacttagttccagaactgttttggtggaatctttgggattttctcgatagacaatcatgtcatctgtgagtaaagacagttttatttcttcccttcatgacttttaatatcagaaaatcaaaaaattctggagcatgacaggaaaaaaattttttaaattctctcaaaatgcttgttgttattaatgataattctttgaaattttctgtaagacaattatgtcatctgccaaccaaagcagtttaattttttttccgtacctgtattacttttatattctttttttttttgccatgttgcactacctaggacttcatctatgatgttgaataagaggaatcagagagaagatgttgcactgttcctgatcttaggggaaaagagcccagtttcttgtaattaagtattgtgttagctacaagtatttgtagattttaaaaaattgatacataatatttgtacatacttatggggtacatgtgatattttgttacattcctagagtgtataacaaaccagtcagggtgtttagggtatccatcacctcaagtatttatcatttctatgtgttgggggcatttcaagtcctctcctctagctattttaaaatatatagtacattgttatgaactatatttataatactctgctgttgaacattagaacttattccttcaatctaactgtagtttgtacccattaaccaacctctctttatccttcccctttcattcccacaactttccagtctcgagaatctatcattcttttctttatctccgtaagataaacttttctagcccctacgtatgagtgagaactcatatctctctgtgcctgacatattttacttaacataatggcttccagttccatccatgttgctgcgaatgacatgatgtcattctttcttatggtcaaatagtattccaccgtatatatacaccgcactttctttatccattcatccatggatggacatttaggctgattccatatctttgctgttgtgaatagtgctgcaataaacatgtggatgtaggtatccctttgatatacggatttcctttcctttggatgaatacccggtgggattgctggatcatatggtagttctatttttaatttttcgagaaatctccatacggttttccgtggtgggttctaattttcagtcccatcaacagtgtataagactactcttttctctacatccttgtcagcatctgttatttttggtcttttagtaatagccattctaattagggtaagatgatatctcattgtgattttgatttgcatttctctgatgattagtgatggtgagcattttttcatatatctgttggccatttgtatatcttcttttgagaaatgtctattcatgccctttgcccactttttaatagagttatttgttttgttttgctttttcttattgggttgtttgagttccttgtatatcctgcatattagtcctttgtcagatagatagtttgcaactactttctttcattcaacaggttgtgtcttcactcttaataatttcctttgctgtgcaggaactttttagtttaatatagtcctatttgtctatttttgtttctcttgcctatgatttagaggtcttagtcataaactttttgcctagaccaatgctcaggggagttttccctaggttttcttctagtatccatatagttttgggtcttaagtttaagtctttaatccattttgagttgatttttgtaaacagtgagagaaatgattccagttttatttttctgcatgttgctatgcaattttcctagtcatttattgaagaggatgtcctttccccaatgtaagtccttgtcagcttttttgaagatcagttagctgtaaatatatgggtttatttctgggttctctattctgttccattggtctttgtgtctatttttataccaataccatgctgtttggactgctacagacttgtaatatatcttgaactcaggtaatgcaatgcttataactttgttctttttgctcaggattgctttgactattccggctcttttttggttccatatgaattttaggattttttttctttttccatgaaaaattacattggtattttgacagggattgccttgaatctgtagattgctttgggttgtatgatcattattgatagtaagtcttccaatccatgagcacaaaatgtttttccatttgtttgtatcctcttcaatttattttatcagtgttttgtagtttttgttatttttctttttttgttgtttttgttttgtagaggtctgccacttccttggttaaatttattcctaggcattttattttttaatagctattgtaaatgtattgccttcttgatttctttttcagctaattattgttgtgtagaaatgctattgatttttttcatatttatttgtgtcctgcaaccttaataaattcatttatcaaatctaagagtttcttcgtggagtcttttggtttttctacatataagttcatgtcatctgcaaagagggacattttggcttcttcttttccagattggttgccttttatttctctctcttgcctgacttctctggctaggacttccagtactaggttaaataagagtggtgaaagtgggcattcttgttttgttccagttctttgaagaaatgctttcatcttttccccattttatgtgatgttacctgtgagtttgtcatttatggcctttattatgttgaggtatgtcacttctgcacctagcctgttgagagtttttgtcataagacagtgttgcatttcataaaatgctttttatgtgtctattgagaatcatcagaaatttttttcttcattatattgatttcttaaatcaagttttgagaatctcgtttcctagtttgctgagagtttttaaatcatgaataggttgaattttatcaaatgctttttctgcatcaattgatatgattccataatttttattccttaatttgttgatgagtggactaagatggttttgttttattttatttcatgtattttatttttatttatatatttatttatttttgatacagagtcttattctgttgcccaggctgaagtacaatggcgtgatcttggctcattgcaacctccatctcacaggttcaagtgattctgctgcctcggcctcctgagtagcagggattacaggcgcctggctcatttttgtattattagtagagacggggtttcaccatgctggccaggctggtctcaaactcctgaccgcagatgatccacctgccttggcctcccaaggtgctgggattacaggtatgagccaccatgcccacactattttttaatgttgagttttgacagctctttacatattctagatgctggtactttttgcatacgtgttccagaaatattttctctcatcctatatcttttctttctagttcctcatcagggtcttgtagaaatcaaaagttttaaattttcatgaacttaaatttatctacttcaacttatgtgtagtatgtttaagtataattctttgtataactcttctagcagttgctctagctgtgtattttatgtacataacttttcacagtctactggtgtcatttttcctattcaagtgaaatttaggtaccttacctccttttaagttctattatttttatccgtttataattgttttaaaatcttcctattcctacatttaaaacttcattaaacaatgttgtaatttttatttcaactgtcaaacataattcagaaatgcaagagtagaaaatgtattacccacattttactttatttgttctttcttccttcttgacattccaatatttcttctcttatcattttctttctgtttataaacctcccattagtcattttttaaaagcatgtcttctgattaaatattctgttttcctttacctaggaatgtcattattttcctttcatttccaaaagatattttcactagatttagaattctggacccagagttctcttcttccagttgtagaaaatattccacttctttctgtccttcatcatttttgatgataaatctgctatcatttgtttttccccataggaaagagttttttcttgctgttttcaagttttcctttgtttttaatttctagaagtttgactgtaatatgtcttggtgtatatttatttaggttttcttgttggggtttactataataagcttcttcaatctgtatgtttatgtcttgtgctacattgagaagttgaatcattatttctttggatactttttccagccccactctctttctcttctggaactctgataacacagaagttagatttctcattatggtccagtacattcttgaagctctgtacattttgttttcaatttcttttcagaatggccagtttctgttgttttaccttcaagttcgattattattttctctgactcctccattttgctatagagcctatttactgagtttttaaattttagttattctgtttttcagtttaaaatttttcatttggttcttctttatatcttatctttctctgtagaaagatatctttcattttttaaaattgttttaagtatgtacataactgcttgttgaagtatttttatgttgatggctttattattattattattattgagatggagctttgctcttgttgcctaggcaggagtgcaatggcgccatctcggctcactgcaacctccgcctcccaggttcaagcgattctcctgtatcagcctctggagtagctgcgattagaagcatgtgccaccacacccagctaattttgtatttttaatagagacagggtttctccatgttggtcaggctggtctcaaactcccgacctcaggggacttgcccacctcagcctcccaaagtgctgagattacaggtgtgagccaacgtgcctggccaatgatggttttaaagtatttgtcagataattataacattgttgttgtctcactgtttgtgtctattgattgtccttttttcattcaagatgagattttccttgttcttggtatgatgagtgattttttattgaaacacaaatatttgaaatactataaacgatgagtcgtctttaaaccttctttttaagctattttctcatgacagccttccagcagcagaaaagaggatggctcgttattgctaggtggggatagaagtccaagtttcttgctttgtattctattgacatttgaggtggtggagtttattattgctactgggtgggagtggcatttttggttccccatgaaatcactgataatactgccttggttgggaaggtgtctagttactgatctccatgtggcctccactgacaccatgaggaagagaagagcctcactgttgactatggggatgaaagtcctggctcccttctctaataccactacagtggggtcattgcgatggtttgtcacagcctgggaatggtggaagtctaggcttcacagttggcatttgctgtcatgactggagctaaggccacacttttttcctgtggtatttggctggagtgcagcagctattatctaaaagtttctgtcttgctaaattgccccaatctgctggtactttggctagagagagtgggcttttgctgtggcttattcatcttaacccttcaacatttctaggttgttattttctccaatattgagtctgatacatatgaggctaaaagggaaacccatggaactcacagggcccgtatgttatatatctatatgtgtgcatgcgtgtaaagtccagagtttttagctgtagtgcatgagaagaatagtgaaaagtacatctatgccatattgctaaaagtggaaggcccctcaattttttgtttttatattctacttctattcttgactcaattcattcacatcgcattttatctctttatttctctgtgtctcccctaaattattgcatttatgctttgtataatgttcttgcatttcccgtgtggtcttagaggtgatagcttcatcacgtttttcaaacgctcaatagtgtttatggttgtaatttttttctgcttcatggcaacattttatgatgtgtgtttttcatctgttgaacagttttttgttgttttttttttttttgccacaagtgttggtgtcatatctttatatcgatgctgttctagaccctcttttattacttgtcatgagtgagttggctatttgcagatttgtgatggtgtgggagttgggagggggtaagggccagggcagttctccaggttcatgacctgaaagctctctcctctgctaccacagggacagatatgcaaatatgtcattcctacaaatatggcatatcaacaggattatttgcatatgccaacttcatctgcttctttgagacacaccaggtttaagagtgtttctattccagtcctgtctactttattttctgccccttattgctcatagatggtataattttttcatcgcagagtgaggctctcaccttcaggaactgtatttttgctgactctctccggtattcactgttttgggccctctcaacaatttcatgtttttattcttttcatatcttcccaatctaaactgttttgggtagttcatatacatgtctctgggttacatttatatcttagcttcattgtaaatggagtttgcagacatttttaaaaatgtctgtcttcttgttgctgtcgtatgatttctaagaggaggtgaaaaaatgctaacatagggagacgttttcatatggaggttttaacctgcatttattgaatacctagtgttccaatctttcattttcatactgcagaagaatcaaaagaagatacatattgtaagatgagacaataaggaacaagttgatagggtttattcaggaataacaattttcaattggctatttagccttcatcaaaatacgttctagagaattcacggaaaatttcctttgagttaactaagcgttgtctccagttcgtccttcaactagttggtgattttgggtaaagtgttttcaaaatttccacttgagacatttatgatatgctggaatgaagttataaatgccatatacactaattgctattacttcccatgaactctaacataatgcttatgttgtaaggcagaactggtatgcttattttagagtttgttttataaggaaagaatcattgtacacatacattggtgctatgtaatttgattgaatccatcagacaccttgtcatagaatgtttttttataggtccttctgtgacaaaatgggactttggcacagagcaagaggtgtcacttatttttcactattgattctaggatttcaacttcacgacctctttcagtaggcaaaataggagcatttacatacttttctcatccagagccaggctctgagttcagcccactattaaagatttgaaaggtatagaaaattatagatggcaaataaagaccacctacaaatttagcacccagaaatgtcatattgttaattttttaaaatatttccttttggtctttttctgtacattttaacttaactggcatcatgctgcccatatcattttatttctttgttttgtttggtttaatattaaatatttttgaatgtcattaaaaatcctcacaaatatcattctaataactgcagaaatattcttattcaaacccactgaagtatataaacctagattacaataaagcaaaggcataccattcttgaatagtaatttaagatatcttataaaaatgcccatcactcaaaacaatagaaataaactgtaatctcaattagaagtataaaagttctttaaaagttgtttggaaagagtgaaatttaaaaggcgaaataatctgaatgtccatgtggaagaataagtgtccaaaatatctaaaaactgtatgaaacagagaaatcatgggagatagttaatttctagaaattaagatcggctataatttagcctgatgctggaaataataaggtattaacatagaaagagacacatatttgtgtggaaagaaatgtaactgtgtatacttagaaaattaagatgtaatgaagatggtactttaattagtagaggaagagtgatttattcatgaaatgtgctttcacaactggctgtccatctggataaacagcaattttggacaccccactccacaagataaatagaaataaattccagatgggtaaaagattaaatttttttaatctaaataaaacctgataagagaatttagaagaatgtttttataacttccatgtaaaggagagtaatttaagcaattcagaaactcagagccataaaagaaaagagaaatctaaattcataaagatattatttttgtggtgaagtataccaaaaacgaagtcacatgacaaatgataggctgcaagaaaaagttacaacacatatggcagaaaaagaatactagctataatattaaaaaatacctacaattaggtgagcaaaaggcaagtgtgccaatagaaaaatgttcaaagaatatgaataggcaattgacaggagaggaaattcaaaaggctaataaacacatgaaggaattctttatttcattaatatcaatgtgatactcctttttgcccatcagactgacaaacatttaataagtactggtggagtacatgaaggagaatacgctcatacattgatggtgggattgtttattggtatacacgttaaaaaggtaatatggaaatatgtatttcaaatgaaaaagtacatcccttctttcccagcaattccccttcagagaatcttttctatcaaagtaaaagcactagtatttagttatatataatttatatataatttagttatatatataagtgtttattttaacatagaatagcacaaaactgcaatcactctgaatgctaataaataggaatacagttaaataatgtctcacccatattaggaaatatcacaccactaataaaaaagagtgatttcaggttttatgaggtgacccataacaatgtctatgatgtgtaatgttgagtgggaaaagctagctgtagagaaatgtctatagaatgattgtacttatataaaaataagcaatgataaaaatgtcctctgcatgggaatttacacttatcaattataggaagaaggatgaggaagggtaaaaacctgtgggtaaataggcttattttagtgagatgaacatgaggtaataaataccagaaaggtagcaaaatggaaatattttgatggtataatgttttgttatatataaactatagaattctattttattataacagtacagttgtatatacttgcagaaccattgaagggttcctgatataaatgaaaacataaatgggcaatatctatcaaaattacttatgcatttacctttaatctggccatctcttttgtaagaatctaccccaaaacacattggtacaagtatgaaatgacatacacataagattatttattgtgacatcatatgcaatgacaaaaatagtaaataacccacttgtagattcttataatgaacagtgaagagaaatgaaggaatgatatatacataaacgcagagtgttctgtaggatattccattaagtgaatgttgtgttctttaggataagtataagtatgttccaaacattgcaggggtatacttacacttttatttatttatttatttatttatttatttatttatttatttatttattttaagacggagtctcactctgtcgcccaggctggagtgcagtggcacgatctcagctcactgcaacctccacctcccaggttcaagccattcttctgcctcagcctcctgagtagctgggattacaggcacgcaccaccacatctggctaatttttgtatttttagtagagaaggtgtttcaccaggttggccaggctggtctcaagcgcctgacctcgtgatccgtctgcctcggcctcccgaagtgtacttacacttttaaaaaaataattgtttaactgaaatccaaattagtaggtatcctgcatttgtatttgctaaatctaacagccttgtttggggagaagactctgaaatggagtttagtgtgcagaatgttgaaaagcagcgctcctgggatcaacacctgtgaaggcaggaaaaggaagcaggattgggcagagggagaattgcactgcgatgaaagcctgagcaacaactttacatgacccatgaggacttctggagctacatttgcttatcagagggtcctctactgggctgaaatgactgggctttgatagcttccctcttcactgctcaatcagtcattggatatggtcaagacaactctctgtggctgaaatgcccttgaaggggctgacagctgaagaccatctgcttatagctttcccagcagcttagcaaaaaattcctttactgaagacgagtctgggcaactaatttccttgtcctttatagagaaaaaaagcaaagtgcaaaaaaaaggaaagcgtgttatgcatgctacctttgattttcaaggtgtaaaatatagtgtatggtatttgttgcctatgtttataaaaataaacgctaagaatatattaaagttaatacaaatgattaataatgttaaaaaagggaataaggcaatggaagtaaaacatctatcagtgtactttgttaaatacttttgatttggggtgtaattttttcatattaataaaagaaaaagttaaagccaaaatgaaaaatgaagccctaaaaagttaaatgaaaataaatacatttatataaagtgctggtggcaaaacaattcaaagaaaaaaaattacatcaagtcattctagagcagtgttttcactgcataaccttaagctggatttatcctcaggtcaaaaatttaagaaccacaaaatattttaagttttgttcttactgatattattgttttgagattaaagtatgtttatgtaggataaaaaatatttttctaatattgttaaacacctgaattttcagcagaagaaaaaagagatacgagtacaaaatcaaagaatctgagtaaaaatcctgtaacatactatttgaattggaaatatcaaaatgactcattttttaaaaataaaaagtcattattttctagttttgtgcactaaaaagccccagaaacaatgacaaaatagttgtcatgtgtgctaagtgttcagaatgtggtctctaaataccattattttcttttttttctttttttattttttaattatactttaagttttagggtacatgtgcacaacgtgcaggttagttacatatgtatacgtgtgccatgttggtgtgctgcacctattaactcgtcatttaacattaggtatatctcctaatgctatccctcccctctcccccctaccccacaacaggccccagtgtgtgatgttccccttcctttgtccaagtgttctcattgttcaattcccacctatgagtgagagtatgcggtgtttggttttttgtccttgcgatagtttgctgagaatgatggtttccagcttcatccatgcccatacaaaggacatgaactcatccttttttatggctgcatagtattccatggtgtatatgtgccacattttcttaatccagtctatcattgatggacatttgggttggttccaagtctttgctattgtgaattgtgctgcaataaacatacgtgtccatgtgtctttatagcagcatgatttatactcctttgggtatatacccagtaatgagactgctgtgtcaaatgaataccattattttctgacagcatcttggagaatttgttgtatggtagagcagtgcagttctcatagcccaatgcagttgtgttaaaaagatgtagaaaccaattcctcactctgaatgttgggaagtaaagcatatttcctgcctttcccctgtgagctgtatttcagggtaaccaaataaagcctagttgatgagggaaaattcttaaagaagaattccagctaataaatgtggaatgagtgacagaaaaattgccattttgcaatcttaatgaactgattccaggcaatggttatcaacagattccaaaacgatggggtgaaagacaaatggacaactgcatatttgcaggttgccaaagaactgtagatagatttaagggccaatttgtaactttacaagagagatattagattgttgcttcatgaaccttcatgtgcccactgataaactgtcatattaataaatgagacaaccagattttatgtgcttcctgatgtgagacactacagagtacatgttgcacatgaaccaagctaaacctgagtcaaaccaagtagctgggtgtaatgaacagattgcaggaagtaaggggagaaaaaaaaacaagttaaatggcactaccaggaagaaaacagacaaatccagaatgaggacattctaagagaaattggagggaacagacccagtttcttcaagccaatagcttttggggagaaaagaacagacaggaaaaaaaggagatttaaaagacatcaacagctaaatcaatttgtttatattgtttgggtcttaaatcacatgaatccactataaaaggacttttcaatggtcatttggggaaatatgatcatggaccatattaaatgatgtctaggaactattgctaatcttgttaggtgtaatactcatattgtgattatgtgggaaaatgtcttcactttttgggaatacatagtgaatatttagaaataaaatagcgtggtgtttaagatttgtctttttaaaagtggtacatgaaatacatatggaagatgtagacaatcttcattctcagtaataggtatataaaggttcagtttcttatttaagcactttagtatgtgtctgcagaacttatataataaaaaagaaaatttatctgagatttgatttgaatacatatatttcttctctctttctctttggcgtgtcgtctcttaattcttaacagtatcttttgagatgctctttaataattccacccaaacatatatccccttcctaactcaagaaactgatctcttaagcactcaggttacatcagtggttctcaaatgggagcaattttgcctcttaggggatattttgcaatatctggagatatttctggttgccacagctggcagctgctactggcatttagtaaatgttgaattaataaataaacgtatgaatgaatgaaaaccagaataatttgtcccaatgaaccaggaaaactttaatggatcatggctctccctggatggctctttcaaaatgtttgtatttttttcaagcagatagcaattctgtacactagtaagctgatacttgtttagtaatttagtttaaaatgagagattgagagtgttgtaaaaattataatacaagtcaaaagctgtttgaaatgctgggattcttagctgtaaagttttatttagtttgtattcttaatttgtagttgccaatcttaacatttttcataacaggtattcaaacagttcatacacatagctcttgaactctattatatgaatgttgaaaccttttcctttgcagactttgagaagggttagtttaagggaaaatttgagacaaagagtattctcaggtttggaagataaaggttgttttgcatattggtttgtttttacttctgagtaaatgaaaatggtttcttcctgtcttttcttattctattcatcttctcttcctctcccacactcatgctctcataggtaacttcccttcataactccttccactaggagattggacatggggaatcccaaagtataaatctctttatgatttaaaatagtttttcatctactttttaggcatttaatgattatactttgagagtcattaactttgtaaaataattaattatatataaaaagacatatcactccttcagtccctagcagggctagtatacatttgttacatttgttgacctttctacttggttaaaagtgtaggtatatttttacaattgttttcccttaaaataaaaataaaaaaaaaaaacaaccttatggtcctccttttagctaacaggtaaaagcaaaaagtcatattagaaaatagctttcattttcgtaaatgctataattagtcatttgaagactaaaactatggccatgaccgctcatgttctttgaggtttccacgcccactttccgtatgaattggggttttaagtcccggtgtcagtgccaatcttaacttagaaattacattcttaccactcagaaattcctcctggagtttcaacaggagaaattattcttcattttccctcccaaaaactgttgtgtaatattgctggcagagaggggatgattggtgccactgcaaagctagctagatttcagtggaggttgaagcagtatctaaatatagcatgtaaaaagccttaggctaactgtagatgaaaagcattctagatatgtaaggtattattgctactaacgcattattattttaactttgctacaagttacaacgagcctataacatctgccctacagtattgcagtgaggcatgctttctgctgtgaatttttcacctctaacaatttgtttttcttgtatcagcactacctgtcaatttttattaagcaaagtaacttgaggcattttgaattttttttaccctggatgtccttggtggggagtgaaatgaccaacaaaaccattggttaaggatgcaatctttgagagccactaaacccaggagcagaaagcaagggctaaaaaaaattacccagggcagaaaacaaatttggaaaaaataatctacaccagtcacactgagtctcaaacatgattcagttgctacctgctgatttaatcaatccttttcagttaaaaaatataaattggagtgtaatatgcatgatgaaaaattttaataaaacatatagggatttttttaatgggaaataaaaatgatctgaaggtgaccactgcacattttaaaacctcctgaaaaagaaaatcaaatgataggaaggcatcaaagcctgtatgcagtcctgcacatttattataatatagaacactttagttcttacttccttggaatcagagaggtaaatatagtcaatccgatgacttgaggccagtctttagttgaggtattttgattttgatcttcaagaagatcaaatagttttgctctcctccggacataaaacttctgtggacataaggggcaaagaaaagggcttgaggcaaattattgtaaatccatttccactgtcattggcaagtagaagcacttgtacccctgaatagcaggggccccgcaacatctataaacaaaagacacaatatgctcatcaataggtcagatgcaaagttcacctttctctgtcagaataaataacaagcttactagaaattaccttctcactgccatctaaaagtggtagacttcagattttctggtaagaattctataaaataaggatttttttcgtctatccaagtgttatccaatagagctttctaggatgatggaaatgttctatatttgtgctgtccagtaaggtagtcactagccagctgtggctattaccacttgagatgtggttaatgtgactgggaagctttctaattttattttatttcagttaattttaatagccacatgtgccagtgctaacatatggaatagaataatctaggcaacaggggaattaattaaacaaaatggtagccagctgaaagccagaatgtgtccatctttctaaggaatgtctaggcccatgaactttgatagacaaggtggtgtagaagaaaaagcacggtgttgtagtttcagcatctgggttccaatcctccttttctctccttctgtaaaataatggtaataatacttaccttgttaattttttcgtgaagattaacagagaaaaatgttcttatgataactaacagtaggtccaccatgtaagaggtactcatcagatattaatacttcctcataatcactataaatatgttaaagattgaagacaaaggccaaaattgggcacagctattagcctcagaacatttcattgttgtaggtgtgtgtggattcctgggaaaccagccaaaatgtggaaacttattcaaaggttggatttattccatttattcattcaatataaattgaaatgtcgggttacatacagcactctgctaggctgtgtgggggtgacaatggggggcaccaagaatattacccatccttgagttgtcatggtgtatagcccaggacagtctgtgattgggtgagttgggaggttgcagcaatagtctgtcaatactgaagattttgactaacggcatgacctacttgatgatggatgtcagactcagagtcccttcataattatctgattagtggcaataactcactatatcacctttttctacattcttgtccattatttattttaagctcctaaagtacagatatgtcatcttaactttacttaaacagtggtagagttgttatgttttttgaaaaattcctgtggatgctggtaaagattaacaagtgtcagataatgcttgaagagcactattaatatctctttccaacagtgtttttccatcctgagttttggactagcaatgtactgcccaggacaaataaggtaggcttttgaacaaacatcccaactcagggtcacaaatctgcaagagctaggagagttcttcgctgtggggaatcacactggctgcttgcctccatgctttgggagcagtatagcataatactgttggcaagagcgttttgaagccttctggaaaacatgagtgaaaatcgcagccttgtgctaacaggtcaacaaatttaatccaagccagacataaaatgacagaagctccgctgattatcaaggtccctggcacaccctagtgtccatctcaaagtcaacagctctacctagctctctgatttcaagaggggagttgggttagaaaccactattattccccatctggtttacgagagacagaaatgagatgactagagacagaaaatgtgctgtccaggttatatctcatttatgaagagatttaacctagtttttaagtatgtaaaatgaaaaaaaataaattcatttgaactttaatgcatagaatatttgataagtgaggaagaaaccaatgaattagagactgcatattgccctctgatatcaacaattctaactagagttactgcagggattagactacgctacagctcatgttaagtttttggcagatggaggatttggaggtgtcagtaaagcccaatgtaattagaaaataatttctgaaatttgaagcagcaatggttattaattgagtcaaatgctaatttcccttataaagttccaggggaggtacatgagggcagttttatttgctagacctttttatttaccttctaacagataatatagggtaaaggaaggtggcttggaagaaaatgtccaaacgagttttacatttaatgaaaaaaaatgacacacaagaaaatccaggcatgaggcagttgatttctctgttgggatgtatttcaggaaaagatggcagtgtgccttccccatcaggacttggtaatcattccactattcatgaacagatgccttggtcagatccccaagtgtaagtgaattcattaaaagatctagggaattgaggtattaattctaaattattacatattatagattttctggaaacaagtagggggacatggcaaggagaggaaatagtagagattatatctaactcttggccagaagttggtctcatgagatcaccaaaagagcactttttagcataagttttaaactctttttaaaaaggatttaagcagttattgtcacagtgtagaaggttgatataaggcaaagtagaatcatgaatgttgcataccatatatggaaaccctagaaataatctattggatggaagagagtgcacaaatcattttcttctttgtatactttataaaagaactcttctgatatcattttttatgaaggagactctgtcctgtagaatgcctgcaatgatggtgtttgtaatagtaagtagttctctaaatatattgtggcatatttttgaaatttaggcttagttgctctctttccagatttttattttttcactcagacaatttggcactggttgatgtgtgggtggatatattttctcacctgcacaattaacttgaagttatttttggaatcgttttcattttcagctattatgattataccatacttggggaaaatgctgttgaatttgagttaagatattctgaatacctaagggcaaaatgtaacaatcaggtcacacagagaacttcaaaatagcaattgaaattgttttatcaaggattaagtttttgattacacaattcttatggatatattcttatggatagttccatcataacactcctacaggggctgtattaaatgttctacctacctctcaaatgatttaatgtcatcacaaataggagttacttgaattgcctacatgaaattttactgtagaacatgattgaaatggattataaaatataccttatttctataataaaatcctggcttaaccattgctacttttgagcctattttttttggtttgttttggttttgtttgtttgttaatctctcaccccctgcactgctgaaacaatgatgtgatgaacgcttttttgacacgttggtcaacaaacaggaaatatcgttcttagtggttgtgcaaaccatttgaggagaagtttaagactctgagaagatgcataatataggcatctgcctgttcacatttttgtggtaaagcaggattgagcaaactgtaacctgtaggccaaatccagcccatcatttgtttttgtaaataacttttaattagaacataggctccttggtctatgtattatctatgtctgcttttacacaaaaataataaagtcgagtgattttcacatagatcatttgggctttgaagcctaaaatattttctatttggttctttacaaaaaagttttccaacccttctctaaaaaaaacagttgtttgtatgtttctttttattttgttcctgaattttcttttttaagaaaaactgtgataaatgctatagattcactataatccaaaagataatccaaccctcttgtccattgctatttctacaatatagtctgcaaaaatctacatgctcacttctcaatttcctttttagttaaggacagccatatgactcagttccagcctttgctatatgaatgaaagatggctgtggaattatgggaaacagccagggtaacatcatcccgtgcttattttcttgccttgaatgtgaacatgatgcctttagttgggggacagctaccttgaatcatgtaggaatgcctgaggaaatagcagagatatcagtgctaatatctttgatttttgttaattgcagtcataagtttctatggtttggatgtggtttgtccccaccaaaacccatgttgaaatttgatccctaatgtggcagtgttgggaggttgggtctagtgggaggtgtttggatcatgggggcaaatctctcatcaataggttaatgccatcccttggggtgagggagttctcactctcaagggagtgaattagttcctgagagagcaggttgttaaaaagaatctggcttcctcagtttctctcttgcttcctctcttgccgtgggacctctttgcacatacccattccctttctgtttcttccatgagttgaagcagcacgaggtcctcaccagatgcagctgcccaaccttgaactttccagccaccagaattgttagcaaaatgaacctctttcctttataaactacccagtctcaggtattctgttatagcaaaagtaaacggactaaaacatacgcctgtgtagtataaaatggtaacttgaaatcttataaatctcaaatttttcttggcaaggaagaagatggggagggagagttgccaaaaactcagtttaaaataaaaatagatggtctgaatattctatataaacatgttgtgctaaattatgactattctctctaaatgggacatagttctcttgatcttctcctaacctctttatcttcattaatctgtttaatatccatttatttttgaggtctatgctctagtctgtaaagatggctgacaacaatttcttccctccctgtttactcacagggtgttgtctatttgccctccacttgtatacaggctggcctttgtgacttgctttgtacagctgatgtgacatcttgagacatctgaggtcaaggccttaagaagactggtcgttttttctggatgctaagagaagaaagtgattcaaggaggagggtgtaatcaacttcatcaagtgctgctgacaagtcaagtaggatgaggaccaggaagtggtcattggaaataccagtgtggatgtcatttgcgatttggtagatagtaatccgagtggagcatttggagcaaaatcctggtttaagtagatttaagaagaaattggaagaaagaaattggagacaatgagtacaaataactctttcttctcttgctagaaatccaagagcaacagagcaatgactgaaggaaggtgctgataaatcacaagagcattttttttcaaggtggtagaaataacatcagcttatctaaatgctgtaatacacttctgaaccttaacctataatttaaagacagtacagacttgttgcaaaaacacgatttctaaaagcaaggttaatccttaccacataatatcttggcaaaaattatcttccttgtgtttcaatttcatcatttgtaatatgaattaaaataaccactttacagaggagttggcctggtaaaatttttttatttaaggttctaagtttgatagttctcattgttccatattctttcatttgcaacttggtagaaaatatcaaaattgattccaagcaataatgattttgataaatgtattaggccattcttgcattgctgtaaagaaaatacctgagactggataatttatgaaaagagaggtttaattggctcatggttctgcaggctgtccaggaagcatagcagcatctggttttggggaggcctcaagaagcttccaatcatggcagaaggcaaaggaggagcaggcacatcacatggcaaaagcaggagcaagagagaaagaggatgggggaggattaccacacatttaaatgaccagatcttgtgagaactcattcagtatcacaaaggcagcactatgccatgagggatccatccccatgacccacatacctccccaccagtccccacctccatcacctccaccatcagggcttaggattcaacatgagattttggcagggacatatatccaaactatgtcaataaatacaatttttttcacagaaaatagtaaggtataaaatttaaaaataaatctttagtcttgtaactttccaaaacattggagggatgtataagttaaaaagtgaaagagggtgtatgtgtaggagattaaaacattataaacaaaaatttgtaagtgtttgttgcctattatattccagccagatattttgttgacaaattcatgttaagttgaccctattgtgtcattagaatttatgaaaaatatgttaccacatttcatcatggccagaccatatgttgggaagagtgactagtggtaatttacagagaaaagacaaagaactgtggcatcagaatcccttcaccttcgcagctgagactatatgccctaggaattacatatgtttatgctgttgctattttgcttaagatcatctctgaaaactagtttagaaaagcaaatctctgttgctcttatgacaaaaatgtagatgtgaagtgtaatgcaggaatggataaatgagtagaatattttggacttaaaaggctcaaatgattggagtaaatatttataatcattttgatgcagtctttacaatcatgccctttatggcataatatttggttgtattttgtatacaatttcaggttcatttcatgttggcacctattttctgggttctcaagggtacaacatgtgttttagccaggtgccagtaatatttttatatggtctctttctcggtacttgtaggaaaattattcttgtaattggaaggcagaaatagtctgtagtccaattatatgtgcataattgtttgtgttcactataaccaatgtttgattgtcagtagtatagagggcaatgtcttggtttcttcctattttaataattaattacatttccttctatgaaagggaggtgggaataaagcttcatgtttttgtcagactcatttgtttcaatctcctggtgttaaacaaaatgcatctgttgaaaaagaatgggaatttagttatacagttaaacttgctctttattttcattatatgaaggcaaacttactgacgcatcatggcaatatctatagtaggaatttgatgaattttgtataaaataaagatgtcttctcacttctgaatagattcatgcaacaatatttacaagatttgttgcttgacccttattaaatgccaaatactcacatgttatgtcacgagaactctactatctgtttttatggtgagacaagcccatctgctcacaaatggccgccttcctgtgtccaacaatagaaggggatgggtaccccgcctagccctagactaattggaaattgatataattttgttctttgaccttcttttttcttttcgaaaacttaaacaggtctgaaaaccatttaagtaacatagtccataactgttcatagtaatcataataatgattctgatttttagatatttactctgtgacaaacactgcacaaagtttttacatgatttatttcattcacatctcaccacccatcccccaggaagtaagcactattttatctcaatgaatttgaggctcacagaggttatgtaacttgaccaggatcacataggaagttgcagaaggcacaagcctggctttacctgactccaaagcccctgcaagtaaacaatgtgcaggtggccccctctcaaggaaagattcagtaatgacagacctcaggactttgcagcctcgtagttgattgctctgcttatttataaggctcaccctaggcaaggcctgctttagaagatagtggttctgtctccaccactagccccacagagtcactctaaagaatgtttgcagtaaggctgaagagttaaaatgggggctctagcatcagtcaggcttctgtgcgaattcagcctctaccatcgactttgcgaccccgactaaaagacttaattctggcatccccatctataaagtagaaataatgacaatattgacccgccagggttgttgaaggatgaaatgggataaaacttgtgataattttcacttagtacttggtactacctttgactcaggccaggtaatgatgttgccataccaggcagattaagattgaacaaggagagttcaaccagcagaaggcacgggcagtaaggggtggcagagaaaaagaagttttggagccaggcagattttaattcgcattgcaaagctatttttgcacattttgggatctccaatgaatattttgttcagaaaaagcaattcctatctctttctgaagaaatatgatcagagcagaaatggaatatggactaattagaatgtttttgattaaaagcttaaatgtctgaatatgatcatgatgctttcttcagtagtatgccattttatggcctttactataatattttgtgtaactgtttatgttcacttattattggcacatgttttctgcattctcaaaagctggtacaccagtgtttaattcacatcacaaaactcaacttgcaatgtttttgcctttgggcaagtccgtaaaactctatgagcctccattttctcacataaaattgggctattaatatgagacagtatatataaagtgctttgtacgatgcttaacacctcagttgatttcaacaaatggtggttattttactacttttcataaaatctctatcacttgtttatgaattcattcaacgagtggtttgggtgctcttacatgccatgagcaatgctacagcttggggagataatccctgcactggtagcacttgctttctggaggaggagacaaatgaataaaccaatagaataaaagaactacagaaggtttgtgataaaagcttctagaaaaacaagctgtgaaagagaattcagtgttcatctctgaagaaatgagactaaggctgaagtttgaaggatggcaaggagttggccaggcaaaaagtgtaggaaacatcaggtgcaaaggtctggaggtggaaataaacttcactgttctgtctccaagcagagcaaactcataaggcagaggtaggggcggagctcagacaggtggtctggggctggccagagcagggtttgctgaagagttggacttcttactctacatacatggaaggatcatttatgcattttacgttgggaagtggcatgattcgatttttaaaaagacgactttggcagctatgtagagaatggatgagagggaggcatgcgcacaagtgtcagacaagaggctctttccagtgagcccaggtgaagggtagtagtgccttgagttccagcagtagcagtacaatggacaggaactgttgagagctctttcaaggttaaactaacaggactccctgccagattggctctgggagtggtgaaggagcagcagccactgaatcaacacaaagactcatttctgatcacaggttttgctaccgatagaagagatggctattgattatcgtgtgagagaaatgcccgactgaaagtcaagtgtgttgggtcaacttggatgtgtgaagagtgggggtggtttggtgatcttatttgggtggatcctggcatttttctagtattgtctaggtaatagctcacaatttccctttgcgtggccttgacatgccatattggagccaaaaggaaaaatgtttgtccctatatgcacttactgacacctcctcccacagtttgggccaagcggacaaagttaagagaagctctacaatgaaaaatcatgatgacacggcagttaccagggaccgaagagagggaataatggagagttactcttgaatatacactgagctgcagtttgggaatatgaaaaatttctagacatggatgggtaatggttgtgcagcagtgtgcctgtacttattgccactgaactgtacgtttaacaatgattaaaatggtaaattgtacgttacatatatttcaccacaataaataatgcaagaaaaaactatacgtaaaatcacgtccaaacttttcagacatcgacatcaatccttataaacccacccatcatgggacacaaaagctgctggggtccaggaaccaagagctgattgaaaaataatgattctcgttgcacaaaatgcagcattgtaaaacaaacagccagcaacagccagtctgtacttaatattttgatattttgttcataattagtttttgtccattactttctattttttgaaatcatgcattaaaatattttttatcttgaaagctgagtttggtgctctcttaaattttgtgccaaaggcacaaaatgtatttccaagtatcacctgtttgtttctggtttgagaaccatcccccaactgcttagcagctttgctgtggaccaagcatctctcagaaacataccttttttcaggcccaccctggggaatgagacgccctggtccctgttgcttttgagcctctctaatcctgccaaaggtctctattgtccgctccattccactcttctcccctcctgcagaatgcaagtcaaggtagggaggaataagaacccactcactgcatctgagttctcctctcctctccttctctctctctctcttttttttttttttttttgtgttgttgttgttgctattgtgcactcctgtgcctctaaactgcccataagagatgtttacttctactctgtgtggcaagaaactggcattagcccagtttatgctttggattctgtgcagtaaaactcctttatttttcccataaagtgcctagtttttgcctaaattcaaaactattttgttgaaagcactttggctttccggttattactcctgccacagttttacaaaatctactcagaaatctacttgagggcttgttgtaaactttttgtgacaaccccaaccctggcaaagcagctactggttggggaagaataatgggtttaaggaatgtggagtggcagggacagtcacgtaatatatctaatatcatcatccaaccaggtaagattaaataagctcatggtgaagtataaagtaccctgggttaggagtcaatgctctaagttctagctgtgattacccccaagaagggccaagtgcttcatgaagagattgcattgtctggtacttaaaggcacgagcttggaaaccagacaacctgggtctgaacctcagctcatccaacccttcctatgagaaacttggtgtgaattcatgcctctaagccagttttctctttttaaaacttcaataataattataatccccagcttacaaggcatctagctcatgagaacactaagttcatccaagcccttttcttcacctttaaaatttgatctctagcaccaaggattaaacatgaggatgaaggtctgggcacagtgactggcacataataagtgttcaataaatgatgactcttattttctccatatatgaaagaaaaaagaatatcttccatggctgaattatagtttgttagaagactgatgcaatgttataaatatgaaatattacaatatgaaatactattaacatacacaataaagggctaggtcaatgtaagggattcttctacaatgattttcaaatatcattcagtgactagtaatcaattgtaaagcactcaagaaatcaaatcctttaatgttcttcagtcatgcctaatgtcctgtgattattgcaggggtccacaagcccttttggtaataattcatgtgtttacccattcagcaaatatttgaggaccacacactatgtaacatacatgattctgacattgttctagggatacagcagtaagttaaaaagccaaaatattttaactttagataaagtaactgtgaaatatctataaccaaccaaattaaggtttcatgtgggcagctgaatacatgattctagagtgtagaaagagggaaatctgtcttggaaatgtaaattcaggggaaatcagagagtatatgttacataaggcaagctataagccatcttaaaatttaatcctaatcttttccagttccaaaacgctgatttatttttttcttacaaggagcaggaatgcaaagacatcatctccagttattgtgttgggaagacagtgttggggaagtgttggggaagacagagtttgagaaggaaagcaaaagtcacttaggagatctcagaaagataatcaaaggaaaattttactacttgtttatctttctaaaatgtaagttagttttcaagtgaaaagtacattttataaacttggcaaatgcttagtgggtcctttatttggactgtggatccttatataaattcagaaaacaacaaaaaacagtttcagattgttatatgtactctttaatagctaatgtaataaagaaggaaacagcaatcaccccaagttctatcactaaaagatcatgactattataaaattgagatattttctcagcttccttttcatatgtgatagctatcattttaatcaatatttgaatattactatatattaagttttgagctccattctgggatcgctagtatgtcaaagattcttcataggttcctcaatcttcttctttttgtttttttgggacggggtctcacttcatcacccaggctgaagtgcagtggcaccatcttggctcacttcaacctctggctcccaggcccaggtgatccttccactcagtctcccaagtagctgggaccacaggcacacgtcactatgcctggttaattttgtaatattctgtagaaaaaggatttttaacatttggtgaatgtttgactaaggggacatacaatgttctgttgaagactgaagttgtgtccactttcggattaacaatatgtgtgtgtgatttcggattaacaatatgtgtatatataagtgtgtgtgtgtatgtgtgtatgatttcatttttatttcatctaatttccttagaaaaaaatcctaaaagtaaaattactagatcaaaaggtataaatatcttaatatgtatgatctaattaccttcagaaacatgctgccaatttacactctcaacatcaggaaaagagaagtcatctcagtatccacactaaaacattggttattacttgctgatatattagacaaactataacactatcctttatttgtacattttattatgaaaaatgttaaatgtgcttattaattctgactgtcttagcttttctaacatcctagcaaatattaataatgttatcttttcatttatagtagttatgtattctattttttctcactgaatcatcttgaatttccaaaacaattttgaataataatggtcacagtggccagtgtctagaagcaaaatttctggaagcaaatctatagtatgcagcaattccatcagagcaacttgggagaaaattacatgagttataaagcagatattgaaagaaaaatataaaattatacatgtctatgggtggtttaaatatgtttgccacttgaaaagaaacagcaatatttactcatattggctttattctagacttatttttgctgatctcctttgagaatgaataaggtttcctgtatatttttggactaaagtaaattaaagacttttcatccaaaatggattcaaaataattttgtggatcatatcttaacatgtatttctagctgtctccacaatttagaaaaactggtttcttaaacaaatcagcataaaaatttctaaagcactgtattcttttttaacaacccaaataaacatagcacattcttattactaattttgttctgaacagcacacatctttgtgttctttaactaaactatgtgtttgaccagtttaagtagatagaagatattctgaagctctttttcatattaaaatagttcattataaaatagcttttatatgacctgaagttgctcttcataatttttggaatcctaaagatgtcctgtaaattttgtacttcatccctccaaatttgactttcacttcatcaaccagatagggagtgtgtggtagaaaatgtaaatgctcgatgttcttctgagaaacacataaatatagatttgttggaattactacagctatctgtcagcctcatggcttttggagccaaaattccctaattccaaaattatgagcatgtgacaaaatgtggttttatattgctagaactttcatatatgcaagttaatagactgaaaaaatggacttgggctaatgagaaggatatcttaattcatcctttagcaatcatttgaaaatgtaactcttagattcattctgttttagagctagaagcatctgaaagcaaatacatgaatcttgcgtttttagtcagagaaatttacaatggaaatggagacagaaatgtttttactgggagtaagcagccaccccatatttcctcccctcctcttttctccttttgctggttggcaagcccacctactcatattccacaacatcctcgttgtttatttccgttttagaggcagactttgtaataggacacactagtgggcaaattccagttgtatactcctaagcaaattgtttaaatgatctgaatccaaatttcctcatctgttaaatggggtagaaattgggaagaggtgggtcacaaaagtatgaaattcattgggttatcatgtcaataaactgtatttaagagcctgatacaatgccagtggacatgaccgtattttatagagagagttgattatgctttacagtgtgattttccccaggatgcaatgtagaccaactagaggttttgaaattaaatgaaaaccccaacaaatatatctgttgatatcattttcataaaatgattacataaaaaacactttcatgggccagacatggtggctcatgcctgtaagcccagcactttgggaggccaaggcagttggatcacctgaggtcaggagtttgagaccagcctggccaacatggtgaaaccccatctctactgaaaatacaaagaaaaatcagctggatgtggtggtgtgtgcctgtagttccagctactctactcgggaggcagcggcaggagaatcacttgaacccgggaggcagaggttgcagtgagctgaaatctcgtgacagagcaagactctgactcaaaaaaaaaaaacaaaaaaaaaacaaaaaaacccaccaaaccaaaacaacaccaacaacaaaaatacttttgtgtatatcagtttttctcattaatgtactgcatgcagctctaatatggggtagatttttttaagtaaggtaagaagggtgtgtgattatattgtgtgaaaatagtggcatattatttttgctttcataatactatttttatttcaatatatattcaacatataattggaacatgaaactctggattttgtgatgatagtgaattttctgttaaaatacatgtaatcaagaaaaaggggaccaatcaaaaacaaccagtaaataatagtagacattgcacacaaatatggtgccatggtttggtttgtccccaacaaaattgatgttgaattttgaccctgaagatattagaagatggggcctagtgggaggtgtttgggtcatgcaggtggatccctcatgaacggatcaatgccctccctcaagggtgagtgagttcttgctcatgctagagcaggttgttaaaaagatctggtttcgttgggtcctctttcttgcttcctctctcaccatgtgatctctgcacacatctgctccccttccactttctgccatgagttgaggcagtgtaaggctctcaccagacgcagctgcccaattgtgaaccatccagaatcatgagccaaataaacatcttttctttattaatttcccagcctcaggtattttgttatagcaatactaaatggactcagacatgtggcaagaattagaggtggttgttggctaggcaaggtggctcatgcctgtaatcccagcactttggagcgtgaggtgggtggatcacttgaggccaagagtttgagaccagcctggccaacatggtgaaatactgtctctactaaaaatcacaaaaattagccaggtgtggtggtgtgcacctgtaattccagctactcaggaggctgaggcaaaagaatctcttgaacctgggaggtagaggttgtagtgagccgagatcacaccactgcactccagcctgggtgacagagcaagaccctgtctcaaaaaataataataaataaaagaaagaaagaatacaaaagtagaggtggttgtcattcagaatctcaaaaggaatttataatcattttatagtacagtttaagactaatgtcaatgttatccactaatataatattacatactgctctattagtctttattccttttgttttcctttttcatttccttcattcttgtttgcactagtaatttatataatagatattttgttttttctcatggacaaaggtttatctctcattacaaattagactccacattaacagaggttttctggataatgtttcatatcattacataataaagatagaagagttaaagtgaagagctacaactccttttgtagattagccaataacttgggcaaatactgaatttaacaaggatgaagaaattctacatgatccaagaatgcaagtttcaatttaggcctctaccttactcttacataaggcaattactagcatttaaggttaaagtcacatgaatgttctttggataaaatacaatccctggtaatttgaatgaaataattcagtgattattttctcgaaataatatgaaaatgaagtataagtacaaatcaatttattttttaagaaaaaattattcattgccaatttccaatactactttttccataatattgttttatttttttctggatattttttctatttattttcactttttgcaattcaaaaacattattgaaagtgtggttaagatttagtctaaggatctattccttgctaaaagaaatatacctttttagcttaggtttcctttttggaaaagctcaaagcaattttattagcaaaaattttccttttgcctaaggcaaaaactagtgaaattatgccatatgaaagagattattaaatattttattttgctttttgaaaaagtcatgagcaaacatttacaaggttcttctttatactgaagtttatttttataaacctttactaaagaagtgcttgtcctcttcctaatcacatttctttagtatgtcttcaggacttactaaaattcaacagataattaagcagccctgtttttccaggttacttaaaagtgtgaccctgtatgctctgtggaaatcctgctttattatgtccttgtctttcagtattgtccatagtctcaaatctgttctgtagagttaaaatgtatattgacatagaaagccttctaggggaatgtgtggttgttagcagagtcttggttcttttagaatttcagttgttatttaatccggagcaatagaactaggtttgtggaataataaaacatatatttcttactgaaacaccatctgaaaatacacatccttccataaattgagtggttcagttggtattttttcctgtttgatacgtgagaataagggaattgacatatgaatgcctacaatatgcatgcacagttttaggggccttataaatgttttcttaattaaattttcacaacatcttaatgtggatgctacattgtttcatgaagttcatcattcatggattaagttggtgtatttttttaaaggttttaaaaatatattttaacaaaattagtaaaatatagtacatagtctcttaggaaaatgtatttcaaaattataaatcatgggctaggtgtagtggcttacgcctataatcccaacactttaggaggctgaggtgggcggaccacctgaggtcaggagttcaagaccagcctggccaacatggtaaaacctcacctctactaaaaatacaaaaattagctgagtgtgatggcattcacttgtaatcccagctactcaagaggctaaggcaggagtatcactcaaacccaggaggcggaggttgcaatgagccgagattgtaccactgcactccagcatgagtgagagagcaagactccatctcaaaaaattacaaaatacatatatatgtatatatatatctctctctaccatttatataccacatatgtgtgtatatatattatatatatatcatgtgtatgatagatatattttcttaatcaatatcatagtagctgagacttccatatagtctgtatggtctgtatgctttatagtcacagatgcccatttaataaataatttcttttgctacttcagtgtgttagtttagggaggtgcagaaaaagagactgtgtggataacattattattttgcataatgagcaatgaaatcaaatgatggtcttaaagagtttgtgtgcccacccattcctaccctgccctgtgcagacaaaaacatatttgacttgtcctgcctcagtttacagcagggaagccaaagaggagaggcccagtcaaaattttctgtgaggagacaaaacaaacacccaaagccaggggataggggccaaaacaaatttggaaacaggcacaaaaatggattaacgtgaaaagagtggatgacaggtgtacaagagatggatgttcatgtttgagagtcttagtggttcaaaactgaccctagataatgcacctatcttcaggtagttctaggactttgggttatcttatactgtagatcgcagattggcaaactatgactcgcagtctcaatctgcgttgcgatcttttgtgtaaataaagtttgattggaacacgtgctcattcatttacttattttctatggcccctttcacactagagtgacagagttgagtgattgtgagagactctctaggccacaaagtctaaaatattcacaacagagttcttcatataaattgttttctgactcctcctgtatagaaatcttataataggatactaaatgtcctcatttgtatcttctgatcacagatatagatataaagttagatgtacacaaatatgtgtatacataatgtatacagataagtatgtatatgtgtgatacttatgatccttatgtttgataaaaaatccttcttgatccagaatagatattattatctctatcaaattttactttaaggatctaaatactacttacaagtcttgacaaataggttataattttcaaaatacaaagtccatgtttcagtgtagtctcagatattttttcatcaattttcaaaatactgattatatggaatctttaaaatgtgttgtgaataggtttttgattctgtttaaaatatctagtgattaaaaattttactgttattaaatttaagctaatttagcatgacattgtcatggatattatgtagtttcttatgatcattataatggtgctaatgatatgcatatcattagcatcattattacaatgtttgctcatattctttttgggggattagttgatatttaaggtcacacaattatgaaaaaactcattatccacgatttggagaccaaggaatgttgtgtatcaaatttagcctatataaaacattaatggacattatattgacctggattcatgtagacatctttccatatggcagttttgatcttgtcaagattcagagatacccggtagacacagaagaccagatgggaaggagctacactgacttgatataattaatcttcttgggattcaagcataagaataaaaattatggtaaggattatatataatgtgaatgagtttagagtcctcatattaagtaggtatgactctcttctgcttctgagcatgatggagtagtgataacagatttgcatccctgtcataaacaaccagcatttaaaaaatatcataagaaataacatcagataaaatgcagcacaagactataatccctgaaagaaggcaaacaaagaagcaagccctacgactgccctgggtttctatccgaggcactttctggacagcactgtatttctacactgcaaagcacaacaatctccctgagttgaggagtcagagcccagagtttggcaagctggaagccactagagtatgatggaataatggagagaatggaacttaagagaaagaatctccaaaaatctgcaaagtgtcatattgagtctttagcacactactgtttatgtgtaggatgagagtccatgaggccagcaaaaccaaaacaaagcaaaacaaataacaacaacaaaaaacatcagtgaaagaagaactacctgatggctaaaagtggaacaattcccagagctctcataggctgggagatactcaagtttgaaccaactagagtgacatgactctaaacaatggggcatttggtagataccaaataagggtcaccacataatagtaggtgtgctaaacaaaaccctacatgaaagcttatcctagaccttccctaccaaaattttaaaattaggctgaaagcctaaagcttcactgatggccaaaaaataaaataaaataaattatcaacactttttaaagaaagaaaaatcctggcatttaacaatatctaaaaattgaaatatctaatcacaaattactacacacccatagtatagtagaagaagcaggaaaatgtgacccatgaccagaaggaaaggtttttatgactatgttaaatgacttaaaggaaactatgagcataatagacaaaaaataagtcataaatagacaaccaaatggaacttctagagatgaaaatctaaaaactaaaataacagattcacagaatgggcttaataggagattagaccctgcagagaagtaatcgataagcttgaagacatagtaatagaatagaaattatccaattttaagaacaaaaagcttgaagataataaacagagactcagtgacttgtgggacaacagcaggcagtcgaatctgcatgtagctggactccggaaggagagggtagagtagaagacagaaaaagtatttaaagaaataatggccaaaatttgttcacgttttatgagactataagcccacaaagcagggaagttcaatgaataatgtgtaggataaaaataaaactatatcaaggtacattacaatcaagtttttgaaaattaatgataagaagaaaaaatcttaaccaatgcctgagaaaaaggcatattcaatacagggagtctattgtaaaacatggtgactatatttagtaacaatgtattgcattcttgaaaattgctgaaagaataaatgttaagtgttctcatcacacaaaaaaaatgtaaactaatgcttatgttaattagttttattcagccattccccagtgtacacatatttcaaaacatcatgttgcacatgataaatacatccaatttttatttgtcatttaaaataaacaaatacaaggaaacaaaagtaagaactactactaacttttcatcagaaataattctaaccagaagacaatggaaaaacctcatttaagtgctgaaagaaaaataagtacaattaacttagaattccatatcctatgaaaatattctttacaaaatgaaagtactataggttttagacaaaatctgagagaatttgtgctaacagacctatacttcaagaaatgttaaaggagcccagacatggtaatatatggaaaaatttaaaagaatttgatttcttggttttaaacattttttaaaaagatagttgactgcataaagtaaaaatagcaaccatatattaggaagcttatagcatatatagaaataaaatttatggcaacaagagcacaaaggatgatagaagagaaatggaaagttttatattatacatgatgcaatatttcaatgtaggcaatgatcagttgaagatgcatgtggtaatcctagaacaatcattaaaatataaagcaaataaatgtaacttaaaaagctaatgggctgatggaggagattaattggaattctaagaaggaacaaccacctaaaaaaggcagtaaaagaggtaaaagagagacaatagttgagacaggtagaaaacaatgagtgagatgataggctatgtaacactgaaacattaaacgtaaataatcatatgtattagtctgttttcgtgctgctgataaagacacactcaagactgggaagaaaaagaggtttaattggacttacagttccacatggccagggaggcctcagaatcatggtgggaggcgaaaggcacttcttacatgttgttggcaagagaaaatgaggaagatgcaaaagggaaaaccctgatataaccatcagatcttgtgagacttattcactgccatgagaacagtatgggggaaccacccccatgactcaaattatcccccaccaggtccctcccacaacacatgggaattatgggagtacaattcaagatgagatttgagtgagaacacatccaagccataattttctaccccttgtccctccaaatctcatgtcctcacatttcaaaaccaatcatactttcccaacagtcccccaaagtcttaactcatttcagcattaacccaaaattccacagtccaaagtctcatctgagacaaggaaagacccttccgcctatgagactgtgaaattaaaagcaagctggttacttcctagatacaatggggatacaggtattggtaaatacagcctttccaaatgagagaaattggccaaaacaaaggagtatagggcccatacaagtccaaaatttcctgtggggcagtcaaattttaaagcttcaaaatgatctcctttgactccatgtctcacatccaggttatgctgatggaagaggtgggttcccatggtcttgggcagctctgcccctgtggctttccagggtacagcttcgctcccagctgccttgagtgctttgggctggcattgagtgtttgcagcttttccaggtgaatggtgcaagctgtaggtggatctaccattctgcagtctggaggatggtggccgtcttctcacagctccactaggtggtgccccagcagggggcagagccccagtgggagctctgaccccacatttcccttctgcactgccctagcagagtttctccatgagtgccctgcccctgcagcaaacttctgcctgggcatctaagcatgtccatacttcttctgaagtctaggcagaggttcccaaaccccagttcttgacttctgtgaactcgcaggctcaccaccacatggaagctgccaacgcttgaggcttgcaccctctgaagccacggcccaagctctaggttggtctctttcaaccacggctgaagcagctgggacacatggcaccaagtccctaggctgcacacagcacagggaccctgggccctgcccatgaaaccattttctcctaggcctgtgggccagcgatgggaggcgctgccatgaagacctctaacatgccctggagacattttcccaatgtcttggggattaacattcagctcctcgttgcttatgcaaatatctgcaaccagcttgaatttttcctcagaaaatggatttttcttttctatcacattgtcaggctgcacattttctgaacttttatgctctgctttccttataaaaccgaatacctttaacagcacccaagccacctctttaatgtttttctccttagaaatttcttctgccagatatcctaaatcatctctctcaagttcagagttccacaaatctctagggcaggggcaaaatgctgccagtctctgctaaaacataacaagagtcaccttttctccagttcccaacaagttcctcatctccatctgaggtcacctcagcctggaccttattgtccatatcactatcagggttttggtcaaagccattcaatgagtctctagtaagttccaaattttcccacattttcctgtcttctcctgagccccccaaactgttccaaactctgcctgttacccagttccaaagtcgcttccacattttcaggtatcttttcagcaatgcccctctctactggtaccaatttactatatttatctgttttcacgctgctgaaaaagacatacctgagactaggaagaaaaggtggtttaattgggcttacaattccacctggctggggaagcctcagaatcatagcaggaggcaaaagcacttcttacatggtggtggcaagagaaaatgaggaaggtgcaaaagcggaaacccctgacaaaaccatcagatctactgagacttattcactaccatgagaacagcatgagggaaaccacccccatgattcaaattatctcccacctggtgtctcccgtaacacatgggaattataggagtacaactcaagatgagatttgggtggggacatagccaaactataccatcatacaattgagaaatttgccatgggactgtattctgatgactcaacataatcattgataccaaccattattttattttgtgacatttccccaaaaatatatttcatttaataaattgataacattccatcaggatatgagaatttggaaatgacattttaattttctttgagattaatttcataaaatatgactaaatagaaaaacttatcacacaacgttttttgcatacagatcaaaagtcacttaagagagagaagaaaagcctcagaagacaaaggctttgcttaaaaaaaaaaaaagaattagagaaaaactttaaatgtgtaaagtgttgatcatggaatgtgtagacatgtattttggttgcaacactggctccaagtaattataaggccttatccatgtcatttaacctctcccatgcttggtttcctcttctgtaaaatgagaggtggtctgcgtcatcaaggctctttggaaccaaagatcaaattaaggcacaattgatatagtaataaggccaatattgtaaaaatgtactcctgcttttattatccttgttggtgttggaaattagaaaaagaaagtctcagagtgcaagatagatagatttgttcttttattcattttcatgtatttttttaaaaataatttcaacttttagatcgaaggggtacatgtcccgctttgttacatgggtatattttatgatactgaggtttggggtatgactgatcccatcatccaggtagtgagcataatacccaacagtttttcaaccccctagccccacccaccctgccaactttccactttagtagtccccagtctactgttgccatgagatagagttatttaaacctgttgttattatgtcctttagaaccttgacttttgatccacaagcctcaggcttctgaactgaaaaatcttttccccctaaactattctccatctggactttgaatatctagttacctctccatttgcctcatgctgtcggcatccatgttgccttccttcccagaccctgcttgtgaatccgttctacaatctgtcttccactaggctacatgccctattttagaaaaccaggtatagtgttcattctgtagctgcagaagtgaagatgacaccttgattctggtgccttgactgtcagtcacctctactctctaatcattgctcttgggcttttcatcccctaagacattgtttaaaagacaaatataataagacattgatagtctacactaaggatatcaagtacgtggtctatttttaatgtgcatttagaacatgacttccaggaggcctaaatataagtttacttgagaagggaaaaaagggtttcagaaacaaacaagttagagaaacactggattaatgaaggctaaatatatttctttactgcaagatttttttaaaaccttcattatggcaatgagaattataaagtggcaataaaattcaatctccacaattttataatttgttactatcgcttaaatttgattaggctatagcttaaaacaaagcagcataatgaacttaagaaattataatttaaccctctgcctactgccgtaaatagaaatgaaaagtatttatcatgaaattgattatggaagttattactagggcttgcttttagcaggacaatgcacagcaatgaccttccaaaaatattgtctcttttcactgaaacccataagaaattggcatcttttactttatgctttcaatctatttgtgctgttaccacctattgggctgtatattttctgagggccggagcactgtctcattcattattatatccaagaagccaagtgcattgacattgtttagcacaaccgaccatccttttatttacccctaccccgcgcaattagacttcaattcttttgaagaccatcattgatctacgtaaaatagcacaggtacagcctgtaaaggagatctaaaagtagcactttaaagccaacagagacaagaattttgccaagttatcttgactaaaagggaggtagatttaggattcattttcaaatgaagtttttatattctctttgtcagatacagttagctttagatagcttagatttcagtctttctggaagtaaggattttaaataagtgaagtagttcttgatttgtggacagaaatttcattttacaggagagtcttgaacatttcagtacagaactttcatccacctacagcaacatagttaggtgagaaacattcagcatatccacttataatagcagaatcaacaactattttttcattgtttatttctagacatttaaattttttggttcttgtgatgttaactgggtatcacaatgatatggtttggctgtgtccccacccaaatctcatcttgaattgtagctcccatgatccctatgtgttgtgggaggaacccagtgggaggtaattgaatcatgggggcaggttttcttgtggtgttctcgtgatagtgagtaagtctcacaagaactgatggttttataaatggcagttcccctgcatgcactgtcttgccagccgccatttaagaagtgcctttgcacctcctttgccttctgctatgattgtgaggtctccccagccatgtgaaactgtgagtccattaaacctctctttctttataaattactcagtcgtgggtatttcttcataggagtatgaaaatgggctcatacacacagcatatgtataatgatgagaatgattttttcttatgctttaataatgatgaaaaatgtatatacacatgaaacatgtaacaaaaactacttcaactgtttagaaccaagaaggacatttcctcctggtttagactaatttttaatgatctcacaacccattctattcacttttcaatttcctttcatgttaatgaggggaagcttttaaaggactaattcaatgctgatgaaagtaaaagcagttaaacttcatgaattgaatatgtaaaaacatattaaccattatggacttgtcttaccaaagtgatcagacagacttccttaaatgtgatgtagtgtaggggtcaaacccccacattatgtcatatgtacatcctagtataagcacatgaggccaacaaccttcttgaaattatatgcttaatattttcttaatgcatagtacatttaacaaaatatttaattattaaaatagttttcaaaacaaataaaagactaaaatgcctagatgcttacagtttctttaaactttggaaaaagtgtaagtatgcaaagtgatcaagtcaaaagaacaaagagttgtcagtttactaagtggttgctttgctcacaggatatcgaatggtgcagaagtgtttgctaaaagttgaagtataagtaagtcatgctttctgggttatgatgaggacatcagtagcacagatcaacagcacattcatggtattttaacacgatatttccttttcctgctttgatgtcaaagcaatgcactgctgtcgcttagcagggataagatggaaatagttggtagattagagtctacttagaagcccaaggggcttcatttctataactagaattggtgacatcttgaataaaatcgggtactcaacttagtaggctaaagttgttcttaagatattgccaacattcttgtgcctcaagtctgtcagcgattacaataataattattctaattctcagcttgaccaactacaagttaaggtatttcaagtcaaaaatgatgcctagcaagcagactttaagaatggcggcaacttcaactaaacagttattttgttgttgttgttttttgtttttgtttttgtttcttcttagcacagaaccggcaattcttaagaaaataaccttaaaagaagtcttaaaacctgtatttccttacttaaggaaactagaaataaagaaatcacaataccaaacaagtgaaggaaatgtcaaatatcttgtgtgctctgaagcttctaacttgaaacgcctcttttaggtactataatttgagatacctacaaacagaaattctttagccttctttagtaatctgctccagtgttcaatctttatttttcctatatgtcaagctgaactctctattgcctcaatggccgtttaggctatgtttcagtctagacaaacatttctgtgtttagttccacataaaaaattttctgaaattgctctttgtgtaatagctcaagtggattcatgcaaagtcaccctgaaaaggaccaggagaaggaaatcagcacccagctgaagtgctgtattgtaagcctgtcctacagaagccaaattaattgtagaagcagaaaatgtacgcagagtaatcaaaatacaacatcaaatatattaaaattacataaaaagaaactgaaggctggaattcccccaagagggcacaactacatatttgtcctcaagacattgctgagacaaaagagacccaaatacttcttacaaaacattttgtggagattctgcttgctatgcatattctatatattttcagaaattgtgtgtataaatagcatgtcaaaaaagggcactatttagggaaaataataggcattcattaaaatatggacaatagaaaatgaagtttcttcatgtttctaaaattagaggaagacgattcaataataaatagctctgccattattagtttgcagtcccttttgttaattgcaccttttgttacctttacagtctgtctaaacagtgtgcttgaaggctcaatattgttttctagctagtccttttaaaaactgttctgaagcatatcaggcaaacagaaagtaggagaagggagtatgtagtcttttgtagaaaagagcttaataaatagaatatgagaataattattgatacctgtcctacatttatcttagataacttggttctattgagaggcctctgaaaatctctagtttctgatcattaagcagtttgtaaagtcttgtgtgaggcacaaattttgacaagtataaaactgatttgctctggttcacaacatgtaaaaacccattatcatgggtcatttcagctcatcccatgacatggtattgagaaacaacctctggcccatttcttactatattcataaagcttaaaatataatgagatgctagactttatcaaaatgattagtttattaattttagagtaagaggaaaataactaaaaagtaacaaatataaaaatgaaatgtatgttttcataaataaccaacctattacagtatcgcaataaaaggcatcccctgcaaaggtggctatacctgcacttagtaagactgtcacttactgtgtgatcttcagtaagttaatactcttcctgatctaaacagtgaaggtaactaataactggttttcccatgaagttatgagagaatcaaaatcagagtccaaaatacaactagaaatagttggctaaactattttagagaccatatgaacattaggtatttaatgtgaccttagttagatcacgtaatctttctggatctgttttctcatttgtaaaatgaacctcatatagttcatttataaaatggacctcatctaattcatttataaagtgaacctcatctacctcatctgacaacttttagtattaaaagatgaaatcatttaaattgaagtctatgaaaatacttactttttcaaagaaatttctaaagtaaatataatttttggttaagagcattttcaaatcagttaaaaattcatggtccaaatggctgaaactaaacaaccgcaactttatagcagaggagaagaggagaggaaaaaagatccatgcatatagagaaaagctgaaaagaattggaaagagggagagaaactatagcaattactgtcaactgtaaaatgagggggggtcccaagggggaaaatacaggaaataacacccctgttgacttctgccaacaagacccccttccattgtgtaaaacaaaggtgagtgaagtgtggctggtaatatttaagatattatgaattcattttgtagacaaaatttagactgggatgaggactcatctgtcatcttcgcatcttctgtcaagcgcatgttgcccttggcaatgggtctgctgttactaattttgtttttgtttagaagcttgcttttcctctttggttctctgagttgctgtgaataaaaaaaaaatttaatcacaaaggaaaaatgtctttgattgatttctgatggtggctctgacaccgttgtacttaatgtcggtgccaacctgattgtttgatgtttattacataggtgagtgggaggagctccccctcctttttttgttgctgctattgttataagactggatctggtttttaatcagagctggagggaaaaagcagtagttattagcctgtgacaattgggaagacccagttttgtttttaggctttcaatatggtaatatgttctaacaattgtcaggtgaggtcaatctcctaatcaaatttcaaattttctttagccttgaaaaatttttagatgctccttttgagatatgggatgcaatcttttgaagagtaacattagaatactccaatcctgcctggaattctcctagctaattaccaaatgttctgagcaagaatcatgttgttaaatgttggacaccgagctaccctttaattatgtaatcttacaaatgaccttttaaaacaatcttttagtttacatttcacatttttttgctgttgagtttggattctgtgtacagcaaaatgtctatctcgttctcctatcactattttgatgtaaagacagaggaagatctattttaaattattcataagctttagatagaaacctaagcaaattaaaatgtaggccaatatagaggagaatgataatgggcatataagtatttgtagctactgtagcttccattgggacaatcataaaattaatttcataccttgcacagtaatttcaatgggaacaatttctcagttcgtggtcaaacttgtttccaacattgatggagatgagcactagagaaagtattgaattttctttctaattagctttttcttatgaaatagcttcttaataatttcccttcatgtccagtacataaaggtatctattccttttaaactgtatgtgaatttaatttatatgccaatgatgtttaatgcattgtcttgtctgcatctcattactgtcattaataagcgctggagtacatctagttacaaggttaattgggacaaatccggactcttttttactgtaaatatgctatatcttagcagtgtattactcacggatgggtggtaaaaattatggtattttacactgcattgctccttctgttgtcaaccaaatcaatctaaatacaatctggagtgattttctgcatacattgtctaaactttggacagaaattttgctgttgtttttttaaccagccacataatttcatggctgatttaaatataattgcaactcatctctgtgggatgtagtctctcctcttcaccccaccctcatcttaaactgtttaaagggatctatatcaccagcatgaacccctttaaatttagtgaaatttataagaattttccataaaaaagaataagtattttagttgtaatgttagatattacccatgtacatttccactgattgtagaagctaacaggagctaatagatttttttcactgtccctggagtaagccattgctcagggtctctgcatttgagaatgatactctatacccagggcaggaatagagaaaaacatctggcatagactctaccctcttcccctccaacttccatgacagacatcactaatcagctaagaccgcttttctgttgagcccggacctcagaatcatcttctacgcaatgttccaggtggaacattgtgtagaagccaactggaacaaagccttcagatagcttggcacaggagtaaaacccaacacgctttcctgaatagagaaattttacccctcagagtattttacccctttaccaatgtcaatcatcattaggtttggtcagcctactgcctagaaccgtcatcagtcaggtaaaattgacttaggtgtcattttaaattgatatcattcattaacttaaagagccatagacagaacaagatgttaaaccatccttgtatggaagtgttccttaaattatctttccctaggacaatgatcatgtgaggctatcttatccaactttctctgtacaatggtacttggaatttttctttaatttagagctttgatttagattcttcaggactttttggttccaagtgacagatttgaattggctcaattaaaaatggaaatgtatttcaccaggcacttaaaaaatccaagaatgatcagaacttcagacataggtggatccaggagctcagctacgagtatcatctttcctcctctctgtgtctttctctactactttctctgagttagcttccttttaaagaagcttatttttttttgtggtcccaaagacccagtaactcaaggtcttcatgattatagacactttgatcatggaaagagagagattctgtctctctcctacaaaaggattctgattggctcttcttgatcacagacccactcccaggttacaggtcacctgggttaaagccaggctgggtcttatgccccttctttatattgcaagtcctgaaaggcatgtggtgaacagctccctcatcctgatggggtagggtcaaaactcagaagaaatagacgctttgctagccacaagaagagggaagagacactgtgggagctttgcctcattttgtgaatccaggttaggtcatccctgaagtttctgtcccaggacctcagcaccagagtggccacattattggatcaataatctgaccactaatctcaagtatttctgtctttgatcatgctgactagtgttgacttctgaaggagcctctacttttccctttcagaaggagcagggaacaaatttcagaggagcagtgtacaatgaagatagtttcctcccataagtaacgtaatgtctgttcaagcccaatccacctaatattgaaaaacttaatctagaaaactccaggtaaacaaagtcacctttgtgtattcaccacttcaggttactctctgttcattttaaatttctcctcttcttcctcctttttcctagggtggtcaggtacttatgtattatctcggaatggggtggatgtcagggcatctgtcttctggctcagcttgcttactcttgcctttgctgaaatccagcccatcctgagtttccagtataaataccctgccatcctggcattggctgcggcatctgcacatcccaatggcattgatggacagtctgccactttatcttctcccattagacactacaattccaacagtcatctctcagccaatgtctctgtcaccctcaggagatggggaaattcagctcctcttccagccacctgcccactcctccttttagggttttaacctagaaaaagggcagagtacaagcccattctctgaaacccagcagtgtataattctcttcctttcttttcaattgttcctctctgttccagacaagccttatctgggaaagaggtagtgagctatcattcttctcttaattgcaagtcaaaaatattatcttttttgaatatcagaaggctctaatggaactcaaaatccaagggtttgatgtttgctttctttcctttcctttcctttcctttcctttcctttcctttcctttcctttccttccttccttctctctctctctctctctctctttctttctttctttccttctttctttctttcttctttctttcacagggatctcactctttcacccaggctggagtgcagtggcatgatctctgctcactgcaatctctgcctcctagtgttaaacgaccttcccgcctcagcctcctgagtaactgggactacaggtgtttgccaccacgcatggctaattattgcgtttttttttcttttgaagagatagggttttgccatgtggcccaggctggtctcgaactcctgggctcaggcgatccacccgcctcagcctgccaaagtgctgagattacagacatgagccactgcgcctggccagatttgatgttttctttggactatttaatttctccattaagtcaatgatgttatgcatggggggaagaggtctcacttaagacctccaaattttatcctcctgcatagttattgttcccaaatggttccctttatgtttgatcagtctttgaggtaagttctgtgattagatatttctatatctgctaatacaacactgattggaatgagggcttgagaaagtcaattccagggcataggttatctaagaaataaaaacagactcccaaacatgtggaaaccccactacaattatgctatctgaaaatggtttgtttgtttttgagactgagtcccgctctgtcacccaggctgaagtgtagtggtgcaatttcggctcactgcaagctccgcctcccgggttcacgccattctcctgcctcagcctcccgagtagctgagactacgggtgcctgccaccacacccggctaattttttatattttcagtagagatggggtttcaccgtgttagccaggatggtctcgatctcctgacctcgtgatcttcctgccttggcctcccaaagtgctgggattacaggcatgagccaccacgcccagcaaaatagttttatacatagagttttttgtcttggttaattgacatattcttcattgaagaaaaggattaacaatttcccaaaaactctttgagagataagcaggtaaggctgaagagaggcatggactgtgtgaagagccttcctggtgaaaggtccctgaattttctggctcagtgtccatgtccttggatagtagaggtgaatttacttataataaactggtaatagaactattagctgtctcacaggtcctcttaggtacctggtgggttttcttgtatttataatttcatggctctttccactgagtgtcatggaactcattaagcccaaaccaggaaaatcatacatgtagttgcttccaaactcaccacaaagtcaaaggagctcacattttcaagagaaagaaaaatttgttttcagaaatgtgctggtagctcatggtaccataatatgattctgctctgaataaaatggggaaagtgactgtctcatagtgtctattttccaagaattaatgtacgagaaccactatcatcataaaataccattaatagtaaatactgtacagttgagtataatatgcacttatttcaatttacatgcaatcttaatgattagaaaaaacagacttttcctaaagggtatttgaacatctctgacctagtaatattgtagttaacttgcttgggctttttattttgatgggattattattcctgcttgcatttaggatacagtttgaatgctctagattcagagataaaatccaggaggagattgtgggaagttggacagagattgttggtttattttcctcattgagcaaagatgctaacatttctcccaatgtatttgagctgaaagtatacaagattaagtgtaggtgtatgccagtgatggagaacctagaacaaggatcataaattcgaaagtgtagagtggctctacagataacctaaaagcatgaacagagccagatgtaagataacagttttgctttattttttttttattctgtgcatgccaatttattgctgtctaaattatgaaaagtgttaaaatatttagagaaataataactacaactttcatttatgtctaaaggccccaggattatatacatataattccatctcatttaattttttcagtctttcctcccctaaacaagaaaagatcttccaaagaaatgggcaaagttacttgctcagttacagttagtaaaggcatttcttagtataatataagtgtcttttttatgctagctatgctagctgactctcggcataaggaaaaacaataaaaaacaaaaagctgcatatgctgaaatttaaaaaattgtattcatctgacaaacagctttagatctggaaatacatttcatgagtaacttatagataggctataattatttgataattaatgctctcaaattaatccctttcctaaagaacctctagtggttcttatgctccaattgatatagaaaagctagatcttaggaggatttctttctaaattcagagaatgttcatccatgcaggcttccaagagcctacaaataaaatctaatcaggtctgaaagcaatcaggtccagccaatcagaaatcgagctgtggggcagaaaatcagaatttaaataaaagttgcaattagaacccacagaactggcatgacactcgtttaagttcttagtgctcagagacagtatgaaaattatctccacagtaggaataagaagcgctggtgaagatttttgcctcctgatagaatattgaaaattatcttcatcagtgggttaattggcttaattttccttcagatggtaactttcaaatgcttggtcttaattagcatgggtaaatgagaaatgtaggtgattcacacttttcagttttcttgtgccctagagatttccattcctttcccttaagatatttgaaatggctgagggctacgttgattaaaataaattaggctggtattttataccagtgaaaatgtagatggaattgactaatgtctggtccattaaaaaatgcaacccacaagtaacatgaaggtgagagatagtgtgaactacttacgaggaaccttgtatttactgtgctaaaaattttaagaccataatttttcaatattttgttagatgaggtatgatgttcaactaagaatggtaaaaaaaaaatcagaggcactttacatatttaataagaggtgtatatgggaaaatgaatattaaaagagaggacagaggcataaaatgaaaaaaattgttattcttaggtgattttcttcaagtctgttttactccataactcccccaccaacttcaccttcacctctaacaaagagttgaaatcagcatcaaatattttgtttttagaatctaagaagagtgttatgtttattaactaacgtacattaggtaatttctttgcttttaccatattaatattttattataaacaacgtattacttgtctctgatttaaaaaaatctttcagataatgaaatttgaactagaatactactatagtacgttgtgagttacttggcactaatttattgtgtaatactgcctgaattcaaaaaaatcaaattgtatccacattgtactgtgcaccttgtatagttttgtaaacatctaaaaaaattaagactttctcatttttttctgttagattcacctatgaaaaccctagtaagggtcatcataaagccaagaatttaagaaagtttaaaactgaaacaatttttgaaatttagttaatacagtgcagaatgtagtgtttttcttctggtggcacccatataaataaaaaaaagcaccaaaatgatactcattttctaaaattacatgtaaaagcaagcaactgcaatgatatctttgaaaataatatgcacctggagtcaaaatatagtaaaatcatctaatatgattatctcattgatactcagattttaacacatccttgggtaaaccatattataataaaaattttaataaaatgtatgttttgtatatttataataaaattcacagagtcacttataatgaagttgtaaaaaacattaggggcagggaaaggatatatcattacatgaaaaaaacaagttaccaaaattatatacataatgtttactaaaaattgcttgtttaataaatagatatgtgtacatgaaaaaggggagaagcacagactgagaaagatgagacaaatagtaagaaagagccagaaagggaataaactgatacttacatgttaacaatgttaccagtggggctggggattacaagtatattttgtattctttgtgcttttctgtaatttacaaattttctagaacaaatgtgtttccttttaaatcaggtaaaatgttgtaagaatggtccctttctttgccttttcttggaggaatagaatcaaggtggttttattacctgtaagaattttgattctagaaatattgctgcattcttccaggtaggcatgccaagcacttaggcatggagatcacattttaccttctacctaatagcgtctgcgtttccagattgctccccaaataaaaacaagcattgaacttccaatcagtgatgataatttaatttctctctcagctataagtaccagaaaacagtcaggcaatcagtgagaaaaaacgtgttctcctggtttatttttacattaagtaattaacattttcctctttaactaacatgaggtctaaaaagtataggctcagctgacctaattgtgtaggacttcttggaactctgtatgtttgggggttaggaagaacagaatggaggagtgaggtctttaaataaaacctggaaatgtttataagtgttcttcataatacagaaactctaagactgatttgtgtcataaaataatgtcaacaatttggaaatgggcaaaagagattactaggtatcttcagtggagtgtgggtcatcgtttagcagatctttctggtctggaattatcagattctacagggatgtgcacctttgttggtctattgtctaggtgattttataactctatagtgatagaagttaagtagcaatcattttttatcataatgaagcaaattaattttgtccagtagagatacaattgatttccattgtgtagaaaagattaccttaaatgatgtcaatattcaaaactctatgtacatgtttgtgtggcttttttaaactgaaaatctcctttgaataagttttaatattccactggttatctcattaattaattaaatacttcttgattcatattaatttctcacttacataaaagctatgtgcttaattttttgaaaaattatcttaataactgaaatatattatattggggttataacatgcagatcagagccaaagtgatccacagaactctggtgttctatagaggtaatttaggaatctttaaaatatttaatttggatttcacttttaaacacatttttacacattttttcaaatgataatgaaaaacaacaaatgtactaaaatatgttaaataccaagtttttttttaatttcacactggatgacactgacacattaactgtggtttccattgaatgactttataacatgtaaaaattatggatttgagaccataaaataaatcaattcaaataaaatacggcttttatttgcataatggagtgatacataaaaggtcattaagaatataaaaaattctacttaaaaaaggactgttctagattaggttcacctttaatcactgcagattcaatgtaggtaaagcaggctttgtctattgacattttgatctataattctttgttgtagggagctgtcttgtgcgttgtaggatgttcagcagaatccctggcttctacccactacatgccagtagcaccccctctccagttgtgacaactgcaaaatgtctccagacattgtacctcgagggatagaattgcccccagttgagaacaatgaaactaaaaggatgaagaagaaagaggaggaggaggagaaaaagaaggagggagaggaagggaaaagcggaagagaaagagaaggagaaggaagaggaggaagaagggaggaagaagaaaaggggaagaagtggaaagagaagaaggaacatttataggaggcaatttgacttaacagggcactatactatgtgtcaagcgatcagtgttctgaccactgtttcccagtttctccaataagcaatgataatgtgtcacatcatttaatttccttggttctcagctttttcatttgtcgaataagaatattagacttaatgatctcaaatctactttttagcattgctattctctattaggtggagcacaaaagaaattgaacgaagaaactccctgatctgccttcaaattttgcaaatatcctctcttaaccagcagactgacaacctatttcaagttgtctatttttttattatttatttatttatttatttatttattgagtcggagtctcactctgtcgcccaggctggagtgcagtggcgtgatcttggctcactgcaagatccgcctcccaggttcacaccattctcctgcctcagcctccctagtagctgggactacaggtgcccgccaccacgcccagctattttttttcttttttttagtagagacggggtttcaccatgttagccaggatggtctcgatctactgacctcatgatccgcccgcctcccaaagtgctgggattacaggcatgagccaccgtgcccaagttgtctattttctacacaatggatggaaatgcctgggaataataatttattaattatggtaaaagactaaaaattagttccttttctttgagacccctgtaaggactcaggaagagtatcactaaaattttgttgcacattatttgaaaggaaacatttctagtaattctcttggggccacatgcaacagagataaacatttttgaagttatctttttaccatctgcagccaaggctcttaaaactcagtgatagtgtcagaaacctatgtcattctaaatgtatagctcctgttgaaaacttaacagaagcaatattgattggaaggaaagacccagaaaaggtagcacatgtgatgttttcctacttagtaactgcttccttaaaccttcataaatcactcagtaatccagtaatattgagttcttttattaaacataaaatgacatgacaaataattagaaacttggcaagcctattgttctatgtcatccaataggctgtttctcagggcatcctttgatcctgaccatttgtctgacagtgaacaaaccaaatgtgacagcttgaatgaagttcctgtccccagattccttaaactcaacagagcatatatttcattagaaacaatagtatattgcaaacaaccactatgactgaagcagagattggaagaggaactataaacactaaatcattttgaggagacaacctatcctgatcaagagtttctcccattgaaatggtacttcaaagtatgcaaggattcccgggttgaggattctgcagcacttaaacttttacactaaacatgaaaaagtaggggatttggttctggattttctcctgcttcttcctcctcctcttcttccttctcttcttcattcttcttcccctaaacaagagtagcaaggtagcctgaaaattcctcttcctgtaatagcctttccaatatcagagtcatttccatgccagtagacacaagttttagccattcccaaaccaacactgtcacaagatagtggagttttttgtatgctctgaacaacatagatcccttgtctaggattattgacatctttgaagattcaactatagaaaggatgaaagttaaactttgaaagagaaagttgaacctgcctagcatctggatcatacagaagcgtgctcagtctgagttgaaaaactgagctcatttctggatcactttcacatttaacatttcttaaataagctctacttaggttgtccaaggtaattagagaataaaatgttacttttgtttaaaaggcatatacaataaagatattgatagtttgtgaatagtttaaattcttcagaaagtcactccatcattcactcaatctgccctcagtttaagacaagaatgaatattgtgactcatgtagttaattttaaaatgtgatcagatttaagagatgggttgggaaagcctgctaacattcacatttctattaaggtgacacagcatacaacatctgcaacggtagacaggattttctacattcagagttgatcttctaggcattcattgttgtagtcatctgctcattcaattgttcaattgtgttttgttagtagtttctactaactgatacttgtatagaattttaaggtttataaggtgtatttcttccatgttatctcacttaggcaaaagcactgaactaaatgttctggtaataccatgaggattacctaaaaggtgatcctcttaaaaatgtccaaaagggccgggcgcggtggctcacgcctgtaatcccagcactttgggaggctgagatgggcggatcacgaggtcaggagatcgagaccatcctggctgacacggtgaaaccccgtctctactaaaaatacaaaaattagccgggcatggtggcgcgcgcctgtagtcccagctacttgggaggctgaggcaggagaatggcatgaacccgggaggcggagcttgcagtgagtcgagatcgcgccactgcgctccagcctgggcgacagagcgaaactccgtctcaaaaaaaaaaaaaaaaaaatgtccaaaagatctctctaattagtgcaaattgtaatggcctgccattggaaatagttgcggagtctcttgctttcagtgttaattaacttcaaggaaatctttatcaactgacatggaatcttagatttttggaagattgaaggatataatattaatatttagaaccagttgtatttctatatactaacaatggacagtcaggaaatgaaattctaaataaataattttatgttagttacaatagtacaaaatatattaaaatactgtagcgtaaagttggcaaaatatgtgagaagccatcacattgaaaactataaaatactgcggaaagaaattaaagaaaatttaaaggaatgaagatatatattttggctcatgagtcagaaaactcaataatgttaagaaatcaattctctccaaattgatctaaagattggatgcaatccatttataatgttaacagactttttgtagaaattgaaaaattaattataaaattcacatggaaatgcaaacggcctagaatagccaaaaaaatttttttgaagaagaaagagttagaaggctaatactacccgatttcaagaatcaataatcaaaatgttatagaattggcttcaagatagacatgtaaaacaatagaaaataataaagtccacaaatacatgcacatttagataaattactgatttctgataacggagcaaagacaatgcagtgggaaaagtgctttggcaaatgatactgaaacaatgggatatctatatataaaaaagaacttggaatccaatgactaatgctaatgcgagtgttgtattctaaaaatgtgatttctttcttctgactttggtatcttatataggacgctagcatagaattttgtgaaggatttgaaatgtccaaaatatctctctaattagtgcaaattataaagtcctggcattggaaatagttgtggagtgtatctctaaacagtgatctatctaaaagtgggtttatttgtgtacttgattgttttttattgatttatatgtctatcttgaagccaattctgtaactattttgttatctttcttccaatgatgattcattcactcagcaaatacttactcagtaattatacaatgtcaaagactggagctacagtgatgactaggttaaaaagatcattgcccttatggaactttagatagaataagtgatagaaacatattaattaagtcaattttggctttaattgccattgcttttggtgtattagtcatgaagtctttgcccgtgcctatggcctgaatggtattgcctaggttttcttctaaggtttttttttatggttttaggtcttacatttaagtctttaatccatcttgagttaatttttgtataaggtataagaaaggggtccagtttcagttttctgcatatggctagccagttttcccaacaccatttattaaatagggaattctttctccattgcttgtttgtatcaggattctcaaagatcagatggttgcagatgtgtggtgttatttctgaggcctctattctattccattggtctatatatctgttttggtaccagtacgatgtggttttggttaccatagctttgtagtatattttgaagtcaggtagcatgatgcctccagctttgttctttttgcttaggattgtcttggctatacaggctcttttttggttccatatgaaatttaaagtagtttttttctaattctatgaagaaagtcagtggtagcttgatggggatagcattgaatctataaattactttgggcaatatggccattttcatgatattgattcttcctatccatgagcattcaatgttttaccatttgtttgtgtcctctcttatttccttcagcagtggtttgtagttctctttgaagaggtccttcacatcccttggaagttggattcctaggtattttattctctttgtagcaattgtgaatgggagttcactcatgatttggctctctgtctactactggtgtataggaatgcttgtgatttttttgcacattgatttttgtatcctgagactttgctgaagttgcttataagcttaaggagattttgggctgagaccatggggttttctaaatataaaatcatgtcatctgcaaacagagacaacttgaattcctttcttcctatttgaatacactttatttgtttatcttgcctgattgccctggccagaacttccaatactatgttgaataggagtggtgagagagggcatccttgtcttgtgccagttttgaaggggaatgcttccagcttttgcccattcagtatgatattggatgtgggtttatcataaatatctcttgttattttgagatacgttccatcagtacctagtttattgagagtttttagcatgaagcggtgttgaatttgatcgaaggccttttctgcatctattgagataatcatgtggtttttgtcactggttctgtttatgtgatggattacgtttattgatttgcagatgttcaaccagccttgcataccagggatgaagctggcttgatcgtggtgaataagctttttgatgtgctgctggattcggtatgccactatcatcacaatgatagttatgtaatgaaaattataatacgttcaacggaaaattacaagttgttatgagagcatgtgacttgagatcaatctagtagaaggagtaacatggagcagtctagaaaggtttctttgaaaaagagacattgagcttgaggcctgaatgggagtagccaggaaaagagtatgcagaagaccatatctggaatccctgagttggtgaagccaaagaagaagcacaaaccttaaattataggcatctaactttgaaattactcgaagaagcaatattttaccattatttttactattgttatcagcaccaatcgagtctctacccactgggcataaattgagacaagatcaagatatttaaaaatatttttcaacccatcagattaatcaagaatttggttgatgtatactataggatatagtttagcatttgtgcctcaattgcaatatagttataatttattctcagccttagtttttatacattttcattctgagaaaattccaccaggatttggaagataccttatttaattcaatactgggctctcattcagttactttttttcacctgagaaattaatatatttcaactattcagtggttggatatggagagatgatcactgaattttccttcaagctcctggtttcttagagaattatttggacactctgttgagttattatttgatggaaggagtagaaattcactcaaaaaagcttacatgagaccataaaaacttacgagagtatatggaggcctcagaaaagctcaaaatgctttcaactttgaagaaatatcacttttcagtgaaaatggagccctcactaagttgtttattctttttctgtttcaaattttacatttttaagataataatagtggtaaaaatatagcttctctatagaagttcatcaatttctctagttttgggtgaaaaagaaatctgtgagatcctttgtcaggtataacctgtgtttatgtctgacactttagaacactgcatggttctcttctgggatatttagttttgtgtatattaatatagaatgaaactctctcaggataggaatctctaaaagtaatagaaatataataaaatattttaatctgtctctaaaaaaattagtttggaaacaaaggattaccctcattgtacagtagagtacatttgaatttatgtaaatatattttattgtgctggcctctgggcatttttattcagctataattaacacacaattcacagatcttaagtcttccgtttaatgatttttgacaattgtataagctcatataatgatcactctaaacaagatatagaatatttcccagaaagtgtcctcatgaccttttccatccaatttcccttgtgaaattattatctaatttctatcacaatggattagttatatatatttggatttcatataaatggatcacacagcatgtatttttcaggttctgatttctttcgcttaacaaaatatttttgagacttttgcatgacaagcagttcattcaacttttattgctgagaagtattacatttcaaacatataccacaatgtatttattaacaaattgagcatattttgtttctgctttttaactattaataataatgctgctataaagatgtacatgtaggtctttgtatgaacatatgtttttattccaaaccactgagtaggattgcttggtcatcagctgagaatgtttataagaaacagccaaaccgaggaatttgtatcattttacatttccaccagcaatgtatgagagttccagtttctctatattctcaacaatttttttttaatattagcctttcttatggatgtgaagtgttaactcattgtggatttttttcatgtacctattgactgttaatatctcttcttttgtgaggtatatgttagtcctttcctccatgtttattaggccatccatcttttattaatttttaggagttctttatatatctagatgcaattcatttgtcaaatatatatatatatatactatcaaatgtatgtattgtgttttcaatctgttgcctgtttactcattttcttaagctatctcttaattaataaactatattttcatagcagttttaagcttaaagaaaaattgagcagaaagtacagaatgttcccatatagatgccccccacctgccacatccttacacagtttctcctatttctaacaccttgtgttagtatggtccatttgttaaaactgatgagccaatattgatgcattattgttaaataaagttcatggtttacattagggttcattctttgcactgtacatttgtaagttttgacaaatgtacaatgacatgtgcccaccattacagtattatatagaatggtttcactgccctaaaaataccccgtgctccacctattcatccctccctctttcacccagaatccctcataaccacttatctttttactgtctctgtagcttttgcctttttcagtatgtcataaagttgggatcatacagtatgtagttttttcagattgacttttttcattcagcaatatgcatttaagattcccctatgtcttttaatgacttgatagcttatttccttttattactgaataatataccattatagctatatattatactacagtttgtctgtccattcatctattgaaggatatcttagctactttcaattatgaataaagctgctataaacatctgtgtgcacatttctatgtggatataagttttcaactcctttgggcaaataccaaggagcatatttgctggattatataataagggtatgtttagtttggtaagaagttgctaagctgtcttccaaagtggctgtttcattttgcattcctacaagaaatgagtaagagttcctgttgcctcacatccttgctagcatttgatgttaacagtgttttggatttcagtcattctaataggtgtgcactggtattttgttttgatttgcaattccctgatagtattcaatggtgagtaatatttcatatgcttttttgctatctgtatctgcattgttggcggggtgactgtttagatcttttgcctgttttttaatcagattgtttactttcttgttgttgagttttaaaagttctttttatattttggatacttgtcctttatcagatacatatttggaaagatttttccaagtctgtgctttgtcctttcattctaatagctgtcttttgcagagaagttttaaaattttaatgaagtataatgtatcagttttttctttcatggattatgcttttcatattgtatctaaaaaaaatcaacaaacccaaggtcacctagatttccccccatgttatgtaatagttttatagttttgcctgtaagtcttgagttaattttgagttactttttatgaaagatgtaagatctgtgtctagattcttgggatttttttggatgtagatagttgatagttccagcaccatttgttgaagctctgtcctttcttcatttaatactttgttcctttgtcaaagatcggttgactatatttatgcaggtaagctactaagctccctattctgttccattcatctgttcatctattctttcactaataccacactttcttgattgacgtagctttataagcaattcttgaagctgggttataaccgtcctctgaatttgttgtccttcaatatttgggtctattggcctttccatgtaaactttagaatcatttgttgatagacacaaaataatttgcttacattttgtttgggattacattgaatctgtagatcagattgggaaagactgacattttggcaatattgagacttcttatccatatatatggagtattttttcttatatttagctcttttttatttccttcatcaaagttttatagttttcctcatagagatcttaaatatacttgttagatttatatctaagtatttaattttgtgttaatataaatgttatgctttaaacttcaaattctatgtgttcattattggcatataagaaagcaattgatttttgtacattaatcttattccctgcaaacttgctgtaatcacttattagttccaggaagttttttgttgattgggattttctatatgtagacaactgtgtcatctgtgaataaagacatttttttttccttcccaaactatgtatgttttatttcctttcctatcttattggatcagccaggacttctagtactatgttaaataaaattggtgagaatttcactcgcgtccatgtgaagagaccaccaaacaagttttgtgtgagcaataaagctgtttattccacctgggtgcaggtgcgctgagtccaaaaagagagtcagcaaagggagataggggtggggccgttttataagatttgcgtaggtaaaggaaaattacagtcaaaggggggttgttctctggcggacaggagtgggggtcacaaggtgctcagtaggggagctcttgagccaggatgagccaggagaaggaatttcacaagacaatgtcatcagttaaggcaggaacaggccattttcacttcttttgtgggggaatgtcatcagttaaggcaggaaccggccatatggatgtgtatgtgcaggtcacaggggatatgatggcttagcttgggctcagtggcctgatattcttgtcttcttatattaataagaaaaataaaacaaaatagtggtaaagtgttgggatggcgaaaattttgggggatggtatggagagataatgggcgatgtttctcagggctgctttgggcaggattaggggcggcgtgggaacctagagggggagagattaagctgaaggaagattttgtggtaaggggtgattattgtggggtggttagagaaacatttgtcatgtagaattatttgtgatggcctggatatggttttgtatggaatgaaaaactaaacggaataagagaaggagaaatacaggtattaaaggactaagaattgggaggacccaggacatctaattagagagtgcctaaggagattcagcatagtcctgccagcaaagattatttatttactttaagagttaacagtggcagtttggggatagcaccaggagatatcagctgtgatggcttggataaacagtgtaaaccggcagtgtaaacaagagcagggcatgtatgagtagttgagaacggtgaataggagtatgactagacagaagatagtagggatgacaagtttttttgggcacagtccaagttggtctggtgtctggaatgagactggggcttaataaataggagcatcaatacaggagctcaaatgggctgtaccttgtagaattccaaggacaggcctgaattctgagaagggaaactggtaaaagtactgtccagtccttttcaagttggtggctgagcttggtgaggtgtgtttttaaaagaccattagtccgttctacttttcctgaagactgaggactgtaagggataaaaaggtttcactgaataccaagagcctgaaaaactgcttggctgatttgactaataaaggccgatctactatcagactgcatagaggtgggaaggccaaaccgagtaattgtgtctgacagaagggaagaaatgactatggtggccttcttagaccctgtgggaaaggcctctacctatccagtgaaagtgtctacctagaccaagaggtattttagtttcctgactcagggcatgttgagtaaagctaatttgccagtcctgggtgggggcaaatccctgagcttgatgtgtagggaagggaaggggcctcaataacccttgagaagtagtagaatagcagatggaacactgagaagttatttccttgaggatagatttccacaacggaaaggaaatgagaggttctaagaggcgggctagtggcttgtactatagcatagcctgcctttgctggtgtgtggccattaagcctggtggaactgccatcaataaaccaagcgtgatcagggtgaggaacaggaaagaaggaaatatggggaaatggggtgaatgtcaggtggatcagagagatacagtcataggggtcaggtgtggtatcaggaataatgcgggaggccagattgaagtccgggccaggaacaatgataattgtgggagacttaacaaagagtgagtacagctgaaggagccggggagcagaaagtatatgtgtcaggtgtgaggaagaaaatagattttggaaattatgagagctgtagagagtgagttgagcatagtttgtgattttaagggcctctaaaagtattagggcagcagcagccactgcacggagacctgaaggccatcctaaaacagtaaggtcaagatgtttggacaaaaaggctacaggacgcaatcccagtccttgtgtaagaattccgactgcacagccctgcacttcagctgtgtgtaatgaaaagtgttgggatgagtcagggagagctaaggtgggggcagtctctaaagctgtcttcaaggaatggaaacaggagtggggaaaggatttaggatctatggggtcagctaggtttccttttgtgagtttatataatggttttgttaggatggcaaaaccaggtatccaaaggcaaaagtatccaaccatgctcaggaagaaaaggagttgttgttttgtagaagggattggggtttgggagattagccagacacgatcagcagggagagcacgtgtgtttttatgagaattatgcggagataggtaacagatgaggaagtaatttgggcttgactgaaataatgggggccgtctgtgaagctatgcggcagtacagcctaggtaattagctgagcttgatgggtgtcaggtcagtccaggtgaaagcaaagagaggctgggatggagggtgcaaaggaatagtaaagaaagcatgtttgagatccagaacagaataatggattgtggagggaggtattgaggataggagagtatatgggtttggcaccatggggtggataggcaaaacaatttggttgattaggcatagatcctgaactaacttgtaaggcttgtctggttttaggacagataaaatgggggaattgtaaggagagtttataggctttaaaaggccatgctgtagcaggtgagtgataacaggctttaatcctttcaaagcatgctgtgggatgggatattgccattaagttgggtaagggtgattaggttttaatgagatggtaaggggtgcatgatcggtcaccaaggagggagtagaggtatcttatacttgtgggttaaggtgggggcatacaagaggaggatgcaaaggaggctttggattgggaagaagggcggcaatgagatgtagctgtagtccaggaatagtcagggaagcagataatttagttaaagtgtctcagcctaataagggaactgggcaggtggggataattaaaaaggactgctaaaaagagtattgtctaagttgacaccagagttggggagttttaagaggtttagaagcctggctttcagtactcacaacagttatggaggcaagggaaacaggcccttgaaaagaaggtaatgtggagtgggtagcctctgtattgattaagaaggggacggacttaccttctactgtgagagttacctaaagctcagtgtctgagatggtctacggggcttctgaggcaatcgggcagcgtcaggcttcagccgctaagccaagaagatctgggaaggagtcagtcagccttgggccagagtttcaggggctctgggagtggctgccaggtgagttgaacagaccaatttccagtggggtcctgcacagatgggacacagcttaggaggaatcctgggctgtgggcattccttggtctagtggccagatttctggcacttgtagcaagctcctgggggaggcagttctgggggaacgcctggctgctgcggttcaggtgtttggaagttcttgtgtgctggagatgtggctggggtttgtctcacagtggaggcaaggaattgcaactcagaaatatgttgctacttggctgcctctactttattattgtacaccttgaaggtgaggttaattaagtcctgttgtggggtttgagggccagaatttaatttttggagtttcatttaatgtccggagcagattgggtaataaaatgtatattgagaataagatgaccttttgaccttttagggtctagggctgtaaagtgtctcagggttgctgtcaaacgagccatgaactgggctggatttttatatttgatgaaacagagcctaaatgctatctgatttgggataaagaaaaaggagcattaaccttgactatgcctttagctccaggcacctttttaagagtaaattgctgggcatgtgggggagggctagtcacggaacaaagctgtaagccggacagggtgtgaggagggtggggtgataaaaggattatagggtggaggagcagaggttgaagaagaattaggacctagctcagcctggcgaggaggggagcggtcagatgggtctgtagaaaagaaagattagaaagactcagggatgcttggggttgggattgaggggacaggtgggagggaaagaacgaagatttgggacgagttgcattggtaacagagactagggagggacaatgtgtaaaagaatgcctggacgtcaggctcctcagaccatttgcctattttatgacaataattatttagatcttgtaggatggaaaaattgaaagtgccattttccagctatttggaactactgtcgagtttgtattggggtcaagcggtgttgcagaagaaaataagatgcttagattttaggtcaggtgagatttgaagaggttttaagatcttaagaacaccggctaagggagaagaaggaggaatggaaggtagaatcttgcccatagtgaaggaggcaagcccagagaaaagagagtagagacatggagaagggaggttggagcacagaaataacggatcagggtgcagagataagaggtcagggttcctgcccctctcccagaaaagtgggacttgccgctaagggtgaaggagaaggggttgaagcattcttgcccctcctccagaaaagcagtacttgccgctacgggtgaaggaccaaggcaggtgtccctgcatggtctgacacctctgaacctgtgtgaataatcagagaggcattcctgcaatgattaaacaccaagggaaggccaccttccctagtccgtgactggcgccggagtttctgggtccacagataaaacgtgtctcgtttgtctctaccagaaaataaaaggaattgaaattaagagaagggagagactgaagtgtggcaccaagattgagaggagaaagaggttgagggatagtgagagaggttggagaagggagtaaaaagaggccacttaccggatttaaaattggtgagatgttccttgggctggttggtctgaggaccagaggttgtaggtggatctttctcatggagcaaagagcaggaggacaggggattgatctcccaagggaggtcccccagtctgaatcacggcaccaaattttactcacgtccatgtgaagagaccaccaaacaggctttgtgttagcaataaagctgtttatttcacctgggtgcaggtgcgctgagtccaaaaatagagtcagcaaagggagatagggatggggccattttataagatttgggtaggtaaaggaaaattacagtcaaagggggggggttgttctctggcgggcaggagtgggggtcacaaggtgctcagtaggggagctcttgagccaggatgagccaggagaaggaatttcacaagacaatgtcatcagttaaggcaggaacaggccattttcacttcttttgtggtggaatgtcatcagttaaggcaggaaccggccatatggatgtgtatgtgcaggtcacaggggatatgatggcttagcttgggctcagaggcctgacagagaagggacatccttgccttattcctgattttagcagaaaagcatttagtttctcaccactaagtatgatgtcagatataggactttttacagatgctcatcagttgaggaagctcctctctacttctagtttgctgagattattttttttttttacccttttcagcaccagaggctagaaagtcagggttttgttttgtttttttttttaaaatattctatcctcttaggttggtgcaaaagtaactgtggtttttgccattaaagatattaaatttttgtcataaaattatttttaatggcaaaaactgtaattacttttgcaccaacctaacaataggttgcacttcttcatatttatttgaagtggtgttgaactttgtaaaaagattttctacatgtactgatactatataattttttttcttagcctattgatttggtggattgtacacatcaattttcaaataagttatcttttgatgagcagaaattttatttttgatgaagtttcattgtttcttttttctttcctcttatggtttttgtgttccatctagccttctttttaatgggattctatttcatcacaagatgatgaaatactaagtaggttaggatttttaacaatagtatcttggagtgataaaattattcagggaatagggggagcaaggtggctgaatagaagcctctagtgatcaccttccctcaccccataggaacacaatttgcacaaatatccacgtaagaaagcaccttcataagaaaaaaataatgtgagcaatcacagtacctggttttaacatcatagcaaggaaggaggtactgaagagggtagaaaagacaagagaagacattcttgaattactgacgctattcttcccccaaccccagcagcagccacatgatatggagagagaatctgtacatgtaggggagagagagcacagtaattgtaggactttgcagtagaacatggtgctccttgtcacaacggaaagcaacacagggcacaattcaaccagcgcccacagaagaagcatttagaccagccctagcccaaggggaatcatccatcctagcagtcagaaactgagttccagctagtcccgccattataggctaaagtgtcctgggttataaataaacatgaaagacagtctaggtcacaaagactgcaattcctgggcaaagcctggtgcttggcttagctcagagcaagtggactttgggtactcatgacctaatgagacaccagctgggactgcaaagggagtccttgcatcacctctccctcaatcccaggcagcacagctcacaggtccaggagaaactccttccttctgcttgagaagaggaggggaagagtaaagaggactttgtcttgcaacttggaaacccactcagccagtaaaatagggcaccaggaagattcctgagacccctattccaggtcctggcttccagatggcatttctaggcacaccatggaccagaaggatacctgctgccttgaagggaaggacctagtcctggcaggattcgtgacctgctgattaaaggtcccttgggccctaaataatcagcagtgggtaccagggccttgggtgagactcaaagccatgctaacttcaggtatgacccagcaccttcccagctatggtgctatgaggagagacccattctgattgaggaaaggagagagaagagtaaaaggttcatggtcttgcagcttcaacaccagctcagccacagtggggtagaatactaagtgggcttctaggttttccaatttcagaccttagctcctggatggcatttcttgactttccctgagttagaggggagcctacttccctgaagggaaagacccaggcttggcagcattaaccacaagatgactgaagaaaccttgggccttgaatgatcattattggtagccaggcagtactcattgcaggattagggtggtggtggccatggggagagagtccttctgcttgaggaaagaagagagaaacgtggaaggaacatttcttgtggctttggtgccagctcaagtgcagtagaaaaaagcaccaagtaggttcctaaggttcctgactccaggccctggctcctggatggcatttctggacccactctgagctaggggtagctcgctgccctgaagggaaggatacactcctggctggactcatcatctactgactaaaaagcacttgggccttaagtaaacgttggcggtagcaaggcagttgtcgccacaggccttgggtaagacccagtgctgtaatggcttcaggtctgacccagtgctgtcccagtggtagtggccacagggttgcttgtgtcacccttcctctagctccaatcagctcagcagtaagagagagactccatttatttggggaaatgtaagagaagagaacaacagtctctgcccgataatccaggcagttctctcagatcttactcaaaaccaccaaggcaatacctctacaagactgcaagatttagacaattactgggcttggggtgcctcctaatgcagagacagctacagtgaccaaagacttaggtcacaacactcaattccctttgaataattgggaagccttcctgagttgtgtgggtacaagcaagcccagacagctaagactacaataaatacccaactctttaatgctcagacattgacaaacatctacaagcatcaagaccattcaggaaaacatgacctcatcaaatgaattaaataaggcactaaagaccaatctcagagtgacaaggatatgtaacatttcagagagggtaattgaaatagttttgaggaagctcaacaaaattcaagataacatagagaaggaattcagaatcctatcagataaatctaacaaagagattgaaataattttttaaatcaagcaaaaattttggagataaagaattcaacagacaaactgaagaacgcatcagcgtcaacagcagaatggatcaagcgaagaattagtgagcttgaagtcagagttgaaaacacagtcaaaggatacaaaagagaaagaataaaaaagaatgaaacgtgcctacaagatctggaagatagtctcaaaagggcaaatctaagagttgttggacctgaagagaaggtagaaagaaaaatccgaatagaaagtttatccaaagggataacagagaactttctaaatctagggaaagatattcatgttagagtacaagaaggttatagaacaccaagcagatttaacctaagtaagactacctcaagacatttagtaatcgaactcccaaaagtcaaggattaagaaaggatcctaaaagcaccagaagaaaataaacaacatacaaacacattccaatacatctggcagcagacttctctgtggaaaacttacaggccaggagagagtggcatgacatatttaaagtgttgaagaaaaaaaaaaccaaaacttttattcaagaatagtatatcccagaaaaaaatattcttcaaacatgaaggaaaaataaagactttcccagacaaacaatagctgagggatttcatcaatactaaagctgtcatccaagaaatgctaaaccgagttcctcaatctgaaagaaaaggacatcaacaagcaataagaaatcatctgaagggacaaaactcactggtaatagtaagtacacaaacacagaaaattttgacactgtaattttgtgtaaactacttatatcttgagcagaaagactaaaagatgaatctaacaaaaataacaactttttaagatataaatagtatcagatataaataaaaacaacaaaaatttagaaagcagaggcataaagttagagtttttttcagttttctctttgcttgtttgtttgtttttacaatcagtgttaagttgtcatcagtttaaaataatgagttactagttgtttgcaagcctcgtggtaacctcaaatcaaaaaacctacaacagatacataaagaaaattaaaaacaagaaattaaaacataccaccagagaaaatcaccttcataagaaggaagacaggaaggaagggaggttggatggaagagaagaccacaaaacaaccagaaaacaaataacaaaatggcaataataaatccttacttatcaataataacattgaatgtaaatggactaaagtctgcaatcaaacaaagtggctgaatggattttaaaaatgtgtgcaatgatctgttggttacaagaaacactcttgaaatataaagacccacatagactaaaaaaaaaggatggaaaaaaatatgatattccatgtcaatggaaaccaaaaaagagcaagaatagccatacttatatcagacaaaatatatttcaagacaaaagctataaaaagagacaaattcattatgtaatgataaaggggtctatcagcagaagaataaaacaattgtaaatatatacatacacaacactggaggacagatatataaagcaaatatcattagagctaaagagagaaatagatcccaaaacaataatagctggagatttatttatttatttatttatttatttatttatttatttattttttattgttatactttaagttttagggtacatgtgcacattgtgcaggacagttacatacgtatacatgtgccatgctggtgtgctgcacccactaactcatcatctagcattaggtatatctcccagtgctatccctcccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatggtttccaatttcatccatgtccctaaaaaggacacgaaatcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttctagtcctttgggtatatacccagtaatgggatggctgtgtcaaatggtatttctagttctagatccctgaggaatcgccacactgacttccacaatggttgaactagtttacagtcccaccaacagggtaaaagtgttcctatttctccacatcctctccagcacctgttgtttcctgactttttaatgattgccattctaactggtgtgagatggtatctccttgtggttttgatttgcatttctctgatggccagtgatggtgagcattttttcatgtgttttttggctgcataaatgccctcttttgagaagtgtctgttcatgtcctttgcccactttttgatggggttgtttgtttttttcttgtaaatgtttttgagtgcattgtagattctggatattagccctttgtcagatgagtacattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccatcttgaattgattttttgtataaggtgtaaggaagggatccagtttcagctttctacatatgactagccagttttcccagcaccatttattaaatagggaatcctttccccattgcttgcttttctcaggtttgtcaaagatcagatagttgtagatatgaggcgttatttctgagggctctgttctgctccattgatctatatctctgttttggtaccagtaccatgctgttttgtttactgtaaacttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcattatggccaattttcacgatattgattcttcctacccatgagcatggaatgttcttccatttgtttgtatcctcttttatttccttgagcagcggtttatagttctccttgaagaggtccttcacatcccttgtaagttggattcctaggtattttattctctttgaagcaattgtgaatgggagttcactcatgatttggctctctgtttgtctgttgttggtgtgtaggaatgcttgtgatttttgcacattgattttgtatcctgagactttgctgaagttgcttatcagcttaaggagattttgggctgagacagtggggttgcctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccggttttcaaagggaatgcttccagtttttgcccattcagtatgatattggctgtgggtttgtcatagatagctcttattattttgaaatgtgtcccatcaatacctaatttattgagagtttttagcatgaaaggttgttgaattttgtcaaaggccttttctgcatctattgagataatcgtgtggtttttttctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcctggcgttggtatcagaatcatgctggcctcataaaatgagttagagaggattccctctttttctattgattggaatagtttcagaaggaatggtaccagttccgccttgtacctctggcagaattcggctgtgaattcatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcatagaggtttttgtagaattctctgatggtagtttgtattcctgtgggatcagtggtgacatcccctttatcattttttattgtgtctatttgattcttctctctttttttctttattattcttgctagcggtctatcaattttgttgatcctttcaaaaaaacagctcctggattcatttattttttgaagggtttttttgtgtctctatttcctactgttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctcgtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatgtctgttcttttacatttgctggggagagctttacttccaagtatgtggtcaattttggaataggtgtggtgtggtgctgaataaaatgtatattctgttgatttggggtggagagttctgtagatgtctattaggtccgcttggtgcagagctgagttcaattcctggatatccttgttgactttctgtctcgttgatctgtccattgttgacagtggggtgttaaagtctcccattattaatgtgtggaagtctaagtctctttgtaggtcactcaggacttgctttatgaatctgggtgctcctgtattgggtgcatatatatttaggatagttagctcttcttgatgaattgatccctttaccattatgtaatggccttctttgtctgttttgatctttgttggtttaaagtctgttttatcagagactaggattgcaacccctgcctttttttgtttttcatttgcttggtagatcttcctccatccttttattttgagcctgtgtgtgtctccgcacgtgagatgggtttcctgaatacagcacactaatgggtcttgactctttatccaatttgccagtctgtgtcttttaattggagcatttagtccatttacatttaaagttaatagtgttatgtgtgaatttgatcctgtcattatgatgttagctggtgattttgctgattagttgatgcagtttcttcctaatctcgatggtctttacaatttggcatgattttgcagcggctggtaccggttgttcctttccatgtttagtgtttccttcaggagctcttttagggcaggcctggtggtgacaaaatctctcagcatttgcttgtctgaaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccaacctttctctctggctgcccttaacattttttccttcatttcaactttggtgaatctgacaattatgtgtcttggagttgctcttctcgaggagtatctttgtggcgttctctgtatttcctgaatctaaacgttggactgccttgctagattggggaagttctcctggagaatatcctgcagagtgttttccaacttggtttcattctccccatcactttcaggtacatcaatcagacctagatttggtcttttcacatagtcccatatttcttggagggtttgctcgtttctttttattcttttttctctaaactttcctttttgcttcatttcattcatttcatcttccatggctgataccctttcttccagttgatcgcatcagctcctgaggcttctgcattcttcacgtagttctcgagccttggttttcagctccatcagctcctttaagcacttctctctattggttattctagttatacattcttctaaatttttttcaaagttttcaacttctttgcctttggtttgaatgtcctcccatagctcagagtaatttgatcatctgaagccttcttctcttagctcggcaaagtcattctccatccagctttgttccgttgctggtgaggagctgcgttcctttggaggaggagaggcgctctgctttttagagtttccagtttttctgttctgttttttccccatctttgtggttttatctacttttggtctttgatgatggtgatgtacagttgggtttttggtgtggatgtcctttctgtttgttagttttccttctaacagacaggaccctcagctgcaggtctgttggagtaccctgcagtgtgaggtgtcagtgtgcccctgctggaggttgcctcccagttaggctgctcagcggtcaggggtcagggacccacttgaggaggcagtctgcccgttctcagatctccaatagctggagatttaagcaccccactttcagcactggacagatcatacagacagaaaatcagcacagaaacattggacttaatctgcactatagaccaaatggacctagtagatatttagtgaacatttcatccaatggctacagaatacacattcttcttctcagcacataaatcactttcaaaaatagatcatatgttaggccacaaaacaagtcttcagaaaaatttttaaaaagaagaaataatattaagcatcttctctgactgcaatggaatttacctagaaatcaataacaagaggaaaactgaaaactataaaatcacatggaaatgaaataatatgctcttgaatgaccggtaggtaatgaagaaattaagaagggagttgaaacattttttgatacaaatgaaagtagaaatacaacattccaaaacctgtgggatacagcaaaagcagtcccaagaggaaagtttatagcaataaatacatcgaaataatatatcaaaaaggtaaaaaaatccaataaacaacttaatgacgcaactaaaagcacaagaacatgctaaatccaaaattagtagaaaaaaacaaataatgaagatcagagcgcaaatgaataaaattgaaataaaaaaagagaaaagatcaatgaaattaaaagttggctttagaaaagattaaaaaaaattgacaaagctttagccagactaaaaaaaaaacccaaaataaataaataagagattttcttttatttgtatagatacttgattttatttctcttggatagacacttcagagtggaattattggtttctgtggtgagtttatgtttaattttttcagaagccatcaaactattttccaaagtaggtgtaccattctccatccccatcggcaaatttccaattgcttcatattgtctcgaacactctttattgtccatcttttctattttagccatcctagtgtatcgagtagtaactcattgtggttttactttgcatttctccagtgagcaacgacatccaacatctgttcatatgcttgttaaacattcttatatcttcttggtgaaatatttatttgtttagtccatttttaaattgcattgtttgttttcttatatattgagttataagagttctttatatgttctaaattcaggtcctttgttagatacatgatttgcaagtactttctttttttatatatatattttcttttttttaaattatactttaagctctagggtacatgtgcaaaacgtgcaggtttgttacatatttatacatgtgccatgttggtgtgctgtacccattaactagtcatttatgttaggtatatctcctaatggtatcctgccccctcccccgaccccacaacaggccccggtgtgtgatgttccccttcctgtgtccaagtgttctcattgttcaattcccacctatgagtgagaacatgcagttttggttttttgtccttgcgatagtttgctgagaatgatggtttccagcttcatccatgtccatacaaatgacatgaactcatcattttttatggctgcgtagtattccatggtgtatatatgccacattttcttaatccagtctatcattgatggacttttggatcagttccaagtctttgctattgtgaatagtgccacaataaacatatgtgtgcatgtgtcattatagtaccatgatttacaatcctttgggtatatacccagtaatgggatggctgggtcaaatggtatttctagttctagatccttgaggaattgccacactttcttccacgatggttgaactagtttacagtcccaccaacagtgtaaaaatgttcctatttctccacatcctctccagcacctgttgtttcctgactttttaatgatcgccattctaaatggtgtgagatggtatctcactgtggttttgatttgcatttctctgatggacagtggtgatggatattttttcatgtatctgttggctgcataaatgtcttcttttgagaagtgtctgttcatgtccttcgcccactttgtgatgggtttgtttgtttttttttgtaaatttgtttgagttctttgtagattctggatattagccctttgtcagatgagtacattgcaaaaattttctcccattctgtaggttgcctgttcactctgatggtagtttattttgctgtgcagaagctctttagtttaattagatcccatttgtcaattttggcttttgttgccattgcttttggtgttttagtcatgaagtccttgcccattcctatgtcctgaatggtattgcctaggttttcttctagggtttttatggttttaggtctaacatgtaagtctttaatccatctcgaattgatttttgtataaggtgtaaggaagggatccagtttcagctttctacgtatgacgagccagttttcccagcaccatttattaaatagggaatcctttccccattgcttgtttttatcaggtttgtgaagggtcagatggttgtagatgtgtggtattatttctgagggctctgttctgttccattggtctatatccctattttggtgccagtaccatgctgttttggttactatagccttgtagtatagtttgaagttacgtagcgtgatgcctccagctttgttctttttgcttaggattgtcttggaaatgcggggccttttttggttccatatgaactttaaagtagttttttccaattctgtgaagagtcctttgtagcttgaaggggatggcactgaatctatcaattaccttgtgcagtatggccattttcatgatattgattcttcctatccatgagcatggaatgttcttccatttgtttgtgtcctcttttattttgttgagcagtggtttatagttctccttgaagaggtccttcacatcccttgtaagttggattcctaggtattttattctctttgaagcaattgtgaatgggaattcactcatgatttggctctctgtttgtctgttattggtgtataagaatgcttgcaatttttgcacgttgattttgtatcctgagactttgctgaagttgcttatgagcttaaggagattttgggctgagactatggggttttctaaatatgcaatcacatcatctgcaaacagggaaaatttgacttcctcttttcctaattgaatatgctttatttctttcccctgcctgatttccctggccagaacctccaacactatgttgaataggagtggtgagagagggcatccctgtcttgtgccagttttcaaagggaatgcttccagtttttgcccattcagtatgatattggctgtgggtttgtcatagatagctcttcttattttgagaaacgtcccatcaatacctaatttattgagagtttttagcatgaagggctgttgacttttgtcaaaggcctttttttcaatctattgagataatcatgtagtttttgtttttggttctgtttatatgctggattatgtttattgatatgcatatgttgaaccagccttgcatcccagggatgaagcccacttgatcatggtggataagctttttgatgtgctgctggattcagtttgccagtattttattgaggatttttgcatcgctgttcatcagggatattggtctaaaattctctttttttgttgtgtctctgtcaggctttggtattaggatggtgctggcctcataaaatgagttagggaggattccctctttttctattgattggaatattttcagaatgaatggtaccatctcctccttgtacctctggtagaattcggctgtgaatccgtctggtcctggactttttttggttggcaggctattaattattgcctcaatttcagatcctgttattggtctattcagagattcaatttcttcctggtttagtcttgggagggtgtatgtgttgaggaatttatccatttcttctagattttctagtttatttgcatagaggtgtttacagtattctctgatggtagtttgtatttctgtgggattggtggtgatatcccctttatcattttttattgcatctatttgattcatctctcttttcttctttattattcttgctagcagtctatcagttttgttgatcttttcaaaaatccagctcctggattcattgattttttgaagggttttttgtgcctctatttccttcagttctgctctgatcttagttatttcttgccttctgctagcttttgaatgtgtttgctcttgcttctctagttcttttaattgtgatgttagggtgtcaattttacatctttgctgctttctcttgtgggcatttaatgttataaatttccctctacacattgctttaaatgtgtcccacagattctggcatgttgtgtctttgttctcattggtttcaaagaatatctttatttctgccttcatttcgttatgtacccagtagtcattcaggagcaggttgttcagtttccatgtagttgagcggttttgagtgagtttcttaatcctgagttttagtttgattgcactgtggtctgagagatagtttgttataatttctgttcttttacatttgctgaagagtgctttacttccaactatgtggtcaactttggaaggtgtgatatgatgctgagaagaatgtatattctattgatttggggtggagagttctgtagatatctattaggtgcacttggtgcagagctgagttcaattcctggatatccttgttaactttctgtctcgtggatctgtctaacattgacagtggggtgttaaagtctcccattattattgtgtgggagtctaagtctctttgtaggtctctaaggacttgctttatgaatctgggtgcgcttgtattgggtgcatgtatgtttaagatagttagctcttcttgttgaattgatccctttaccattctgtaatggccttctttgtctcttctgatcttttttggtttaaagtctgttttatcaaagactagggttgcaacccctgtctttttttgttttccatttgcttggtagatcttcctccatccctttattttgagcctatgtgtgtctcaatcagagattttttttaaaaaggagacgttataactgatactgtagaaattccaaggattattagaggcaacaatgagcaagtatatgacaataaactggaaaacctagaagaaatggataatttcctagaggcatacagttttccaagattgaaaaatgaagaaataaaaaacctgaatagaccaataacaactaatatgattgaagccataataaaaggtctcccagcaaagaaaagcccaggacccgacggcttcactgttgaattttaccaaacattttaaagaagaactactaccaatcttactcaaattggtctgaaaaatagaggaggaaggaatacttccaaattcattctacacagcaattattaccctggtactaaaaccagacacctcaaaaaaacaaaactacaggccaatatccctgaggaatgttgctgcaaacatcctccacaaaacactagcgaatcaaattcaacaacacattagaaagattattcatcatgaccaagtgggatttatctcagggatgcaaatatgttttaatatatgcaattcaatcaatgtgctatttcatatcaacatcatgaagaacaaaaaccatgtaatcatttcaattgatgctgaaaaaacatttgataaaattcaacatcctttcatgactaaaataaaaaccttcaaaaaactgggtataaaaataacatacctcaacccagtaatatgtataataagtatacacaacctacccacagctggtatgctgaatgaggaaaacctgaaagcctttcctctaagatatggaacaagacaaggatgctcatcttcaccattgttactcaacaaagtactgaaagtcctatctacagcaatcagacaaaagaaagaaataaaaggcatccaaattggaaaggaagacctaagtatccttgttgtattagttcgtttccatgctgctgataaagacatagccaagactgggtaacttataaataaaaagaggtttaatggactcacagtttcacatggctgggatgcctcacaatcatggcagaaggtgaaaggtacatctcacacagcagcagaaaagagagaaaatgagaaccaaacaaaaggggtttccccttataaaactatcagatgtaataagacttattcactaccatgagaacagtatggggaaaactgccccatgattcaattatctcccatcaggtccctcacacagcacctgggaattatgagagctacaattcaagatgagatttgggtgaggacacagacaaaccatatgacttgtttacagatgatacgatcttacttttggaaaaatccaaagactctatcaaaaaactgagaattaatcaacagtaaagttgcaggatacaaaatcaacaaacaaaaatcagtagcatttctaaatgctaacagcaaacaatctgaaaaagaaatcaagacagtgatcacatttgtaacacttacaagtaaaataaaatacttgggaataaaaaaccaaagaggtgacagatctctacaatgaaacctataaaatattgatgcaagaaattgtaaagaacacacaaaaaatggaaatatattccatgtttatggactggaagaatgaatattgttaaaatgtccatactccccaaagcaatctatggatttaatgcaatccttatgaaaataatgatgtcattcttcaaagaaagaaaaaaaaaatcctaaaatttatatggaatcacaaaaggcccagaatagctaaagctatactatgcaaaaaaaaaaaaaaaaaaaagaaagaaaaaaagaaagaaagaaagaaagaaaagaaaagaaaagaaaaaaaaactggcagagtaacattacctgacttcaaattatactacagaactattgtaagcaaaacagcatggcactggcataaaaacagacacatagaccactggaacagaatggataacccagaagtaaatccatacacctccagtgaactcattttcaacaaaggtgccaggaaaacacattagggaaaagagagtctcttcaatgaatagtgctgggaaaactggacattcagtagcagaagagtgaaactagactctatctctggccatcaaatcaaaatcaaatccaaatggattaaagacttaaatgtaagacatgaaactatgaaactgttgaaagaaaacattgaggaaactcttcataaaactggtctggacaaaaatttcttgagtaatactccaaaagcacaggcaaccaaagcaaaaatggacaaatggattacatctatttaaaaagcttctgcacagcaaggaacacaatcaataaagtaaagagacaacccatagaatggaagaaaatatctacaaattacccatctgacaaaggattaataacaaaacaatgtaagaggaactcaactcaatagggaaaataatctaataatctaactttgaaactggtaaaagatctgaatagacatttctcaaaagaagataaacaaatgacaaaaaaagcaggcatatgaaagagtgctcaacatcactggtcatcggagaaatgcaaatcaaatcttcaatgacctatcatctcaccccagttaaaagggcttttatcgaaaagacaggcagtaacaaatgctggtgaggacatggagaaaaaggaaccctcatacgctgttagtgggaagtaaattagtacagccaccatggaaaacagtatagagtttcctcaaaagtttaaaaattttattaccatgtgatcctgcaatccgactgctaggtatataccccaaataaataaaatcagtatatcaaagagatatatgcatccctatgtttactgaagcactgttaacaacagctaagatttgtaagcaacctaactgtccatcaacagatgaatggatatagaaaatgcaatatatatacacagtggtatactattcagccattaaaaaagaatgatatcctgccatttgcaacaccatgaatggaactggaggacattatgttaagtggaaaaagccacagaaagacgaacttcagatgttctcacttatttgtgggagcttaatactaaaaaaattgaactcatggagacagagaatagaataatggttactagatgctggaaaatgtagtagggtgggaaggagggttagtggagatggttgatgggtacaaaatatagttagacacaacgagtaagatctagtgtttgatagcacaacagggtaattacagtccacaatagtttattgtacattttaaaataactgacagagtataattggaatgtttgtaacacaaagaaatggtaaatacttgaggtgatggatacactgtttactctgatgtgattatgcattgtatccctgtatcaaaatatttcatataccccataaatatatatacacactatgtacccataaatataaaaaataattttaaaaattatgcagaatgaattttcatataaaccactacaacaaacaactataactgaaaagaaacagaacactgacattaaactatagaaagtccaccaaagtaataagtgaatttttagctcattgatccttcacagttcactttagtttatcacgtcagcctgtctgagaagatgagtagacctgaaacccagcctgccctccacacagcaggcagcagccctagaggtggggaaactattttctaaccaactaaagatgctatctgtcatgtaaactttctggtgagattgcattagccattaaggagtttatccaagtcttttaaaaaaagcctgttgcatgggtatgtcttctgtaaatctcacattcaaaaccaatgcagatcacagtacttacggtgtacttgttttgaaaatgtgaattgtttcaacatgaatcacatactaaagaacaatctgggtgaaacacaaattttacatttgcttatgtgtgattttgtctgcaagaaacactaggtgaattcagccaccgaagtaaactcagttgcctagagagacacaaaaggcacgcacaagcacacctcaaacatgtaattcagttcaccatgtgtgttatgcactacagccacccagagccagtgttagaactttccattcaatttcacataaccctttttctaccacttcacaataactcacaagctatatgatgaaagaaagaacaatggttatgaatgcaattggttgcctatagatctacctaatctcacttcccaaaagaacctggatgttcaggagtaataaaagaatattcgataaataataccatatattacagtggtatttttgcaaataatgaaacaagaataatatgataataattattttggctgggagcaaaaaaaggaacctataagacttttgtgtaaattatgctttttaagagaatcatttctctggaatttgatcttactctgaaaataggagagttacactaaatggtttctgatttcctcttagctttacataagaatagcatttagatatgtgtaaataattaggaattctatcaaattagaaccaggttatgtttctgtcacactgctactgcttacatgctgcttagactcttcctctctctactggattcctgccatcatctcctgtttccatgcatatcttctgacagcctatactcaagacaacacgttcttaaaatgattctcttaaagtacaagttcgatgagttcatgctccttctcagcaccctgcaatagccctccatctcacagtagaaagccaacagccttacattgcttcgcgtccttcttacctctctgatggcaactccatatcccttacccttccttccccacttcattccagcacttactgaccctcctacagacaaacctgattccacattttctgtgcgctggctatttcctctgcttggaacatcatctcttcagatactgatatggtttggttctgtgtccccatccaaatctcatcttgaattgtacttccataattcccacatgttgtgggagggacctggtaggagataatttgaattatgggggtgatttctccaatactgttctcctggtagtgaataagtctcatgagatctcatggtttcatcaggggtttccacttttgcaccttccttattttctcttgctgctgccatgtaagaagtgcctttcacctctcaccatgattctgagaacctccccagccaagtggaagtgtaagtccaattaaacctctttttcttcccagtcttgggtatgtctttatcagcagtgtgaaaacagactaatacagtaaattggtaccagtagagtggagcattgctgaacagatacccgaaaatgtggaagcactttggaactgggtaataggcaaaggttggaacagtttggaaggcacagaagtagacaggaaaatatggggaaatttggaacttgctagagacttgttgaatggctttcacaagaatattgataatgatatggacaatgaaatccaggttgaggtggtcgcagatggagatgaggaacttgttgggagctggagcagaggtgactcttgttatgttttagcaaagagactggcagcattttgcccccaccctagaggtttgtggactttgaacttgagagagaagatttagggtatctggcagaagaaatttttaaacagcaaaacgttcaaaaggtggcttgggtgctgttaaaggcattcagttttaacagggaagcagagcataaaagtttggaaaatttgcagcctgagaatgtgatagaaaagaaaatcccatttttttaggagaaattcaagctggctgcagatatttggagaagtgcagctatttgggtaagtatagatacttggataacgaggagctgaatgttaatccccaagacaatgtctccagggcatgttagagacctttgcagtagcctctcccatcacagacccggaggtctagaaggaaaaaatggtttcgtgggcagggcccagtttctccatgctgtgtgcagtctagggacttggtgccgtgcatcccagctgctccagccatggctgaaaggggccaatgcagagctcatgtcatggcttcagagggtgcaagccccaagccttggcagattctgcatgctgttgagcctgtgggtgtacagaagtcaagaactggggtttggcaacctctgcctagatttcagaagacgcatggaaatgcctggatgcccaggcagaagtttgctgcaggggcggggctctcatggacaacctctgctagggcagtgcagaaggtaaatgtgggttggagcccccacacagagtccctgctgggctactgcctagtagagatgtgagaagagggccaccatcctccagaccccagaatggtagatccacctacagcttgcactgtgcacctggaaaagctgcagacactcaatgccagccagtgaaagcagctgggagggaggctgtaccctgcaaaaccacaagggtgaagctgcccaagaccatgagaatccacctcttgcaccagtgtgacctggatgtgagacatggagtcaaataagatcatttggagctttgaaagttgaccaacctgctggatttcggacttgcatgagccctgtactcctttgtttttgccaatttctcccatttggaacagctgtatttacacaatacctgtacactcattgtctctagaagtaactagcttgcttttaattttacaggctcatagtcagaagaaacttgccttgtctcagatgagactttggactgtggagttttgggttaatgctgaaatgaattaagactttgggcaactgttgggaaggcatgattggttttgaaatgtgaggagatgagatttggagaggctaagggggaaataatagagtttggctctgttcccacccaaatctcatcttgaattgtactcccataattcccatgtgttgtgggagggacttggtaggagataatttgagtcatgtgggtggttcccctgtactgttcttgtggtagtgaatatgtctcacaagatctggttttatcacaggtttccacttttgcatcttgctcaccttctcttgccaccaccatgtaagaagtgccttttgcctcctgccatgtttctgaggcctcaccagccatgtggaactgtaagtccaattaaacctctttttcttccctatctcaggtatgtctttatcagcagcctgaacatggactaatacagataccaaatggttccctccctcatcttgttgggatcttccttcaggtgacatattcttaataaaccctacaaactacactacttaaaatttcaatccccacttttctaactattctccattctggtcctctttctcttttattttcttttccaatagtacttttattttctgacctgccatgtagttaacttatttactataggttaattgctcatctctccccagctagaatataaattctacaagggcagtaatctttatgagtcttgttcagtgatgtgttgcaagggcttagaatagtgccaggaatatagcggatgctcaacaaatattgtcgaatgaaggaatgaataagtgagaccattaacacttcacaaatacttctagtatttcaggggtataaatgtatttctaatgttttctaggctcattaacacagcaggcttaaaactagaaagataatgatgaaaaaatccagagtttcaagtagacctagacctaatactagaactctgaatttggtgatgaaaatgctcaaatagggaccgtttaaaaaactgagcaaaaatctaaaatgtatgagtgttattaggatggcataggacaagaacacatacagattgtcttttttcacttgaattactatgaaatgctcatttttgtctgtgatgttcttcccttatcattgtattaaagataaagatatattgattttaacagtattgattcagttgtttcaaagagggaagaaaaactcagcctgtgcttttccattgggattgtgctatttaaaacagtatggcagaaaagcaagtgagcatgactgtttaattacagtagaacatgctaccaattcaactattgattttacttcattccccatcttataatatattatatactttttcatacattctacctagtgttcaatatagaattttatatttataaattcttttaaatatttaatgccttcccatttaagttcttaaatcgaatgttttgtaatagactgaaataatcggcatcacgctgaaaatttaggaaaaagatatagagatagatcaaaccttataatatgtaaggagttttagaaaacacaaagccatgtatctgaatagtaaatgtgtcaaattatacatattaattagaatttatggattaatataatagaaattgtgtaatgatacgaatatggtacagcagtatataatgacattcatatatgcaggtaatatggaaagtgaaatgtaaatttatgtgatttaataagcttgttatagaacaacatataaaaattgaacaagaaaaagcttggcttcattagcatgtgatataaattatttttaaaattctgtttgaaacataaattatactgctatatggaaggcttctaattttcttggataatagagccacaatattttagaaaagtataaagatcattgacaataagttgaagatcagtgtaaatattacatgcatacatacacatgtgtgtgcctgtatgtgtgtgtatgtgttttagggtatgtatccagtttacaaccactgatgttgtgtaaaaataagtatgaaatgaacaaaactaaactgccatatgtagccaagcaagttagtcatgacatttagttatttgttaaaacttacaaactagaaaaaagatctgcaatatattttgctgtgttattccacccacaccactctggtcctttctgtaggttgttttcttgatctatgaaggcattagggaatgaccactaattagagttataagaccaaaccatggtaaaattgggtgccgcccaggctatctaagttgctaatgtgcaatctcatttcagaagagctgtcactataaaaccaggtcagcatggcggcagaaatctataaatatagtgcctatgtcatatcctatcatctctggaaggagcacgcaccctgtctttttaaaagaggtttccatatgctatagaagacatgtgtgataaattaagcacttctttctagacactgaaaacataatagtgatataattaattacagtcatattcttgttaaaattgtgcagaaaaattacacctttttcgattagcatgaaatataagtgtcaaatccgtaataaaaccctgatcaataaaacaataataattgtgttgttaaaagcggacatcgaaaggtgttcatggcaacatattttaaaggttagaaacccttttaaaataaacggatttcatctttacactatgtcatctaaatcattactgtgtttgtgtatacaattataatcagacgataaattgcagctattgaatggattaagtctgcacttcttgacctcataaatctgagattgtcatagctttagaaaatgcttgtgtaacaatcagttgattacatggcatgagcagctgtgtgcatgttaactggaaaatatgaaaggggaagggtaattcaaagttcaatggtggaactttataacatatttgacgcattcttttaacactttcaaacccttcctttggaatatgctatagatgttagtaagtttacaaatttaatagaaggatgttgagaaagtttaacaaaatggggtccaactgaaatgtcaatgattatgaagattccctgaaaagatttgttcatgttaaatcactgtgtttttgaatgctttaatagagcataaggaagaagagtatagggtgagaaatacttcacagtatttctctctagttagtgatttggggaaagagtcctcacgaatccatttctcacaaatgacactctgtttttaagtgtaccatttccaccagctgcgcaatgccgctgtgacacgacttcagtttacatttaaaaaaatgcatcaaagattgtctgatgttttacattatcaaaaattttgaaactgtgaaaatggttatcttaccctaatgaaaataaaatgcttaaggtagcaatatactaatagtttctgaaggcaggctatacctgaatctgctattttatgtttaattcaagaggtattatgttcattttagatcttcttaaggagaattggttttaactaaaatttatctatttgtgtatagcttccaccttcaaaaatttatatagaatatgacccaattttgaaaatctcatatattaaaatggtattaatcaaagattcaaagagaattagattattaataatgaaatattttcatttactttaattttctcagatgaaaggaactaaagcatgctttaagcattagttaggaatttacagcctgctcataaaagtggcatttttctcattttgcataagaagttagagcatagaatagccaaataactaatcccaaggtcacagcaaaaaggggaatcaggggcagctaaaaagagaatcctcaatttcaagctcctgaggaacaattgcctttttataacccctatttaataacatttaatgattaaattaccatgaaaataaaacatcttgttcgaaaggcattctagtgtggaaaaatagaagacagtgatctatgatatgcactcaacttcgttaaaacagtctcgtaacagattagacccggcatgctcgccacctgtctagagagccccctggcttttaaagagctatggaagggatgtccacatctcaggagaggtggaattttttgccttcatgaattctgactgggatagttgatgattagaaacaattgcacaaatgtctcattctgacttcggacattatatccacgcagattgccccttcatttaatgatgaaatctacagttctgttagacaatgctatagtaccttgttatatactttattaactaataagagctatacctaataataataactaaaatttgagtgtcagtctttgcattagacaatttacttacattaacacactcagtatttcaagtaacctgtgaggtaattattgtatttaacatccagattagaatactaaaccattaagtgtattgtccaaggtcacagagctagaaggtggcacagctagaagatggaacaccagatttcaacatcaagcactcaaattctcaaccactagacaatactgcctccaggttttgcccttcctggccctagttgatttctcaatgtggggcttttggagctcaggaatttaagctgcccaatgggatgcctcataaaatccactgctttaaaagaaacattttaatccaaaattttaatctaaagacaacccataggtgagtatggctagtttcgtcttgtcagcttcatttacctgactaattacatgatgaaatgcagctactatagtgtgtataagtttttcctttgtgtaaaaaatacaatcaattaaagtttatcattctagtcaaagaaagaattttttttcaaataagtagttaaagcaatcaaacaactgctgtgagaaatttttcccttaatagagtacttacttgtctaccacagaatggattgaaaggaacttattcaaaatttgtcaaattggttcttggctttctttgacttcactgatatagacattcaatgaattaacccaattgattaactattttaggtaaatatgccaaatgaaaataatgacatttgggggttatttgatctctgtaattctatgatatcaacacagccttgcttaacttaattttttctcagctgagttaatgcaagttttccctccatgtcccccgtcactctgtggttcttcccacgtctttctgacatctgaaagtgccatatccaccaacccagggctttgggacatgttctttccttgtctagaacacattttcccaccctctttccccatccctaccctagctaaaagtacctttcaactttctgtagtttttcagatctcaacacaattgtgccttttctaagataagtcccctgacctccattacaaggttaaaaccccctattgcaggctaccagaataccagtatctccttccatagcagctgtcaacataactgagtgatatatttattagtatgattctcttattaatgcctcttcccaatagcctggaggctccatgctggcaggtgccatatctgcttttgctcatttactcccagtgcctagcacagtccctgatatgtattaggtaatcaagagataacatggtgaatggagggatgatgaatatcaggctgatgaagccagagacatggtgcacctgtgagcaaaaagggaacattgatttctaatcaacttcattgagctgtaatttacatagaataaaatggacccatttttaagtgtgtggctcaatcagttttcagtatcgcactttttcataggttgcctctctgacactgaactgtagcacattacgagtcttcgaatgttcctggacttcgggcccttcatctgtaataagatattgtgctgttcctacagtccctgcccattccaggattctaggtctgtgtttaggttctctgcatttcagcatatatttaaagatatattttcccaaaaggacagctatacccctagaaacttgtcaaaagataggctcagcttgcctgatttcggtagtgatttgctgatacactccataatttatcaaatttgaatttttaagttatccccactttgaaaaaggaagatttgggtcacttaaaatagcatgtctttgaatatatggttcaatgtctttgtcagcattttcagcccttagaatatagaacagaattttgagacctcttcaaccagagttctggtagcttttttctatcaagccactaagcagagtggaaaaaaaattaaacgaacgttacttagtaaaaaaacaactcaggtatttatcttctttcaacctatcctcctctcttctttccttcctttcttttttctccctgttcattcattcatttgctcattggttcattcttttaataacagaaatacaaaaacagtacatcaatctacttttggaattgaacacaagaaattataaattgttcactaaatataacacataatttaaaacatatcagactctgttatatgaatagtaaacagagagagcttaattgaatttttttatttaaaaaagaagacaagcaatgtgagtaagaactgcccaacagattagaaaagcacatagagaaaggagaaaaaagagaaaaagccaagacagattgacaaaaccacccacccacagggacctgtattttgataaaaaatagacattttctatttttaggagaggtatacccagcagtgaatatttaggacattgattctcaaatgatgcccttgcactcagtatttgaaactaaatatttttaaatgatctaattcacactaaaaaaatcttataaataaaataatatccctctgaagactgctctcccattattttgtaattaaacttttgtatctgaatctgcttatctctactagcatatagatttagcatgaaaatatatatttaattatattaagaattttaaaatttgtattttagggtaggacttctctaccaaaaaaaaattgtaaaagctactaatttaagaattgaccaggcacagtggctaacagctgtaatcccagcactttgagaggccgagatgggagaatctcttgaggccaggagtttgagaccagcctggtcaagatggcaagatccctgtggctacaaaaaatttaaaaattagctggacttagtggtgggtgtccgtagtccaagctactcaggaggctaaggtgggaggctcagccatgagcctagaaattcaaggtggcattgagctatgatggcaccactgcactccagtgtgggtgaaaaagtgagaccctcatctctactcatactaataataaataaaacaaataatttaaaaattgatgttaaaaatatttttctatgtatttttatcccttgtgaaattttaataaaataatccaggcacgtagtttaaaaaaaaaaatcaagcaggacaaaggacttataatgaaaacaccagatggtcttaataccttcagtctcactagctgaggaaatcattttaatggtttcctatgtagttttttggagtgattgcctccaaatgctaaatgatatacttaattactacatctcatttatcaaatttaatataacatattaggcataaaagatgagaagtttacactacttcatttccactaccctgccaacttgtaactcctcacttactcccaatctttgatagttctatcaaagagctatctgaaagaactttggccctctaaaggactttacacctttatattatagatttaaactgtcatttcatgttcatcaattactctcaacaccctactatatacgatgaaaatattagtatttcacctctcttttctctccttgtatccttccagtttttcacttcctaatttacactcttcattatctttctacctttcaacatgaatattttcataatttttattctattctaaaaaataatgcctttttttttaatctatagaaagtgggggcatgcagcagacatgggaagacatttcctaagaggaacagaagggataggatggttctccatggcagtgggcaaagtaaattctattttctgtcttcctacagcatcttgagtaaaatattgatttgttattaatgcaatgtggaatagaatatgctttgtaaaggtgccttcatgcctgagtcttggccaaaggtaagcatggttcaaaaaataggtctttcaaggggatctcattacactctgattacaagagcatatacttaggtcttgaattatgttttagcgtaagtctttaagggtgtcatagaaaggtgatctatgataccaaagtgatcacaaagcagcgctggttagagtatgtggcctgggtcaaaggtgagaaggaatctagtataatgccatgttagggaagttaagaaagtaagttttattcttggagaatagtttttagaaaaataaaaagtcaccaacatgtgggttttgagtgtaaaactgtcatgggtattctttgaataatcagtttgggaaacggagtcagggtagaaggcagtttcactgggaaatgactgcgtgatgggggaggtttccaggaaacttgcataaggaagtctgtagaaaatttactggacaaactggaagggaaagcaagtcttatctatccccaaaggcccatctcaaagtgtcatctcttcacaagattctttctgccttctccagccccttgctgattgaaagtcctttctcccccttacattgtcatgatcatctttcttgtccctcttagacaacttatccaccttttgctttgtgttaggttacttataaatatgtgatgtctgttcaattagatggcaacttaatgttgaatttatctttatctccccaacacctagaccaaaatcttacacatagcaggcatttaatgtgtctttcaaatatgtgttaatatgtatatgcatgattaaaagagaaatgtgttcagttcttttctcgtttccttcctttgtttctacctttcctccaactatcctttttttcattccttcctttcccccaccccactactttgccttatttttttcctttttctatcaaagataaggtctatgcatgcagggacagggaaaggtggaggtttgaaggattagtagagattgaaaatcctaaaagagaacgggaatagaaatgataaaaagagaagaaatatgatccagatatttttaaaaattcttctaaaaaagagagtgcaatatacacatactatgtacccacaaaaattacaattaaaatttttaaaaaagagagtgcataaacctctctctaaggctggaagggccaggccagattatgaatgtaatatcttagctgagcatgcactgaagttttttcagtgatgcttgcctggatgtgaaagtagaggagtgttcaaattcttgccattcctctgcactaagaatagattgaaaaacaaacaagaatccaattaccataaacacatttcaaatgtgagtgaacagagttttaaatccaaagagaaaaaaatacagaggtttatatagtttctgtttgaaggaccagcagtccataaagcaattatctgcattcaaactagctgtcagaattgatggacatttaaatatagatcattattatgtttgagtcacttaggcctcttacagaattaatcgaaaggaatctcaagaatctaaagaaaattgtggcatttattacatttaaaatgtaataaagagtagaagattcaaggaagagaatgctgactactttctaagccgtcacctaagggaggggtcccatggcctgttaggaaacaggctgcacagcaagaggtaaatggtagtcaagagagtgaagcttcatctgtatgtacagccgctccccatcactcacattaccatttgagctccgcctttgatcagatcagtgatggcattagattctcataggagcatgaaccctattgtgaactgtgcataccaggggtccaggttgcatgctccttatgagaatctaatgcctgataatctgtcactgtctttcatcactcccagatggggctgtttagttccaggaaaacaagctcagagttcccactgattgcacattatggtgagttgtataattatttcgtatatattacaatgtaaaaataatcgcaataaagtgtacaaaaaatgtaatgcgcttgaatcatcccaaatccaccccctacccaccagtccatgtaaaagttgtcttccatgaaacctgtgcctggtgcccaaaagattgaggacctctggcctaaggtatcttggtgaattggagaagtttcagctctgcttctcaccttgggggctcacaaatttggctttacacactaagagtagagtcacctctcagggccaaactcacagcaaccaagtgcataaaacacagcgttaccagaataccaacttcttaaattatactgagaaatttaattgtcaaagggttcagacattcatattctctgcttgcaacagtatctccttgtaggcaagctctgtgggaaggtatttgtaactagaattttatttgatgcatttggaattagagtcagcagagttagttgtgtagttcaagggtctactgaaatcccctgacaactgttcaatgcacctataattttgagatgaatattcctgccactaggcctccatagaacgcatggagttgatttgttttttacttgtaattcctgtgagatttattgtatatgccatgttcttacgtgtttcttagtatcattacatttatataatcatttacattcactaaaagcatttacataagttatatcataatgtccatagcagttctgtattaacattatcatctgtatttcacagaaatggaaaccaaggctcagagatgacaagtgacttagctaaagatctcacaggcactagcatatgaaattttgaaagcaggaagcatatcttatattttttatagttccaagaacaatgctctatagctatgagctacttgtaacatacttgttgatgataatagtagttttatataaaatacgtattaacaaaactgatacgtttgaatatttatggaaatagtcttcattttactcagtattttataagtttttctttcaatattgagtttcccttaatacatttaaaacaggatgtgctttataaaaattgggcttttccacagcattttaggaacctgtatatattttaagaaattaatgactttcaactattattttagggtttaaaaatgatgattttcttcctttgggtggcatatcaattattgttcttagttgcaaacaacagactccactccaggaaatttgaggagaaaagtaatttacaatcaggagtagtgggcttgatccgcactttacccaatgctacagttgcaatatttaaccttctaaaccttatgttgaaacatgatcctcagtgttggaggtgaggcctaatgggaggtgtctgggtcatgggagctgatttctcatgaatggcttagtgctgtccttaggtaatgagttcccattctgttagctccccagagagctggtcgtgaaaaagagcctggcaccttctcctctctcgcttcctctctcattacgtgacctctgtacatgccagctgccccttcaccttccatcgtgagtggaagcaccccacatccatcaccagaagcagatgttggtgtcgtgtttcttgtacagtctgctgactgtaagccaaatagacctcttttctttataaattacccagcttcaggtattcctttatagcaacacaaatagaataagacactcagatactcccagatcccttttactgtgtttatgtgcctcacagccagattctctagcaatctttttctaaggttggcccctctgactttctttaaggcctattcaagggctataaatgctgctttaccaacatgcacagagaacctgcagtgctatacagattgggtcccatggggcagccctcacccatgactggcccctgtgactgcaagtatgagagtccagctcctttgccccaaattgggacaaactctggatgtaatttaaactccagagctccttgcaggatcaagatgaagcaggggttttgactaagagctcatccttgcttggcttctaaattcttttctttcctgctttctctactttcttactggtttctattgggatgactttctttcaaagtcacttgcactgaatcctcatctcaggatctccttcgaaggaaatgtgtttatttcctaggactgctataaccaagtactacaacctgggtagcttaaaacaaaagaaatgtatactctcagttctgaaggctaggagggcaaaatcaaggtgcctgcaaggctatgttccttctgagactgtagaatatttctttgcccattcccagcttctgatggtggccattgtttcttggcattccttggcttgcagctgcatcactgaaatctcttcctctgtccttacatggaggtttcagtgtgtctctgtgtctttacatggtattctcctccctgtgtctctgtttttcttataaggacacagattatataggattagggccatcctaatccagtatgacctcatcttaaccagattacatctgcaaagaccctatttctaaataacgtcacattcacagatactagggattaggactactatatatttttttggagtacacaattcaacctacgacagtaacctaagacaaatgaggttaggggactcacaggataggccagagcattagccttggagactgcaaagcaaagaagaataccacccaaccatgccaagaaaagattcccaagaaaagccacttctacttagtaaggacacccctatggcttcggttgctgctgatactgctgttgtggaaagaattgtagagcctctgcccccctgcccttgaaagcaagacacctctactctcaccctcataagaaaacgaactctgtaggtatggcatcagtcttttcatgttgcttctttcaaagtgaaatctcatggagaccaagtggagagttgaaagggagacttcaacttgagcacgtttttgtgcttctaccatggggatgcaggtctcctaagataaagaattcttcaaatacagcaggagtgctcaaaatgtgtgaccaagccagaatacatgacaaaagggccctagagttggactcagtgacacattaagatgcctaagggtatatagaattttctctgcatttttagacatgagtttaattcttttttgaaaaagaagaaataaaaccttctcacttgggaaatttgttgtgactcatattttctcatttagaatgcaatgttgcttactcttctttaagtccttggtgggcatttacagtttattattatactaaagagctgcatgaatattcagcttttgacttcttatttattacaaaattcttaaagatatttgtattcaaattatttacataggaggagaaagagacttaaaggtaaatttcatgattcattgggttattcctgaaaagccatgtttaaagattttatatatcactttatgagacattatctttatatataatcatgaggatatttattaatgttatggttttttagtggaagaggcttgaaatctagttaggttcacagtgccagtcttgttatctgtttttttctagtgcccagtacacagcctgaaaagtggcaataaatatttgttatttgaaaaagcaagaataggttttttaggttcaaatattttatattgaaataatttgaaacttgacatgtggaattctttactggtcaaaatggaagtgatttttttaactttgccatctatcttatcatacaatcaaaatcactttgttacaatgtaaattactaagtttcatgttttgaaggacatccagacaactatgatcttatttttttaatggtcagtactctatagtgggggccacgaaccaatggccaaatctggcccgccacctgcttttgcaaggtctatgagctaaggatggtttttacatatttaaatgtagaatgcaaaaaagactattattatttaagtgagaacagttgctcagagttgaggacattgcctctttgcctgccaagcctaaaatatttactatctggcactttactgaaagtttgctgacccctgcataagaatatatccaagtaagacttctgtgttgaaagcattctgttaacataagaaattagaatctaccaaatgtgttgctatattttattatgaagaaaatcagccataaaaggaaaataagtatattttgaaaaaaataaaccgaaaatgaagaaaatacaatcaaaagataataaaattaaagactacagaataccactctcctcttgcatctgtgttctagaaatgcaaaaatggagaaacactgcccaccttaaggcaacaaaatatattctaaaaatgattccttatgttacagtaggtaacagagaagaggagagcagaaaagagttcccaccacagacacacacacacacacacacacacacacacacacacacgaaaaccaggaatgtcaggcgaccatcaggtgatggtcagactgttgttaactgtctctctaaaataataatagatatgcagctcacacccgggaaaggcagtctcccaataaacagaagcacctgaaactggtaatcaacagcttcccaataagatctcaagagctgggcaagtgggctcaagcatgtgcactaggaggcaaaatgtcaaagtttaactggcatatggcctccaagggacatttggtaagagaactcctcaagcgagcatctgtacaactccagtaagcacaccgtgcatgctaccctcccacatgctggcaggccactgcatatgtgaacaactcatgccaagggaagaatcagggaagaagggatacaagaccctggaagcatggcaccatataaaaccctaagtcaaaggtcaaactatgcacttgatctctcaaatcgcccacttggtcttcatccaagtgtactttatttcctttcattgctgctctaaagctttttaataaactttcactcctgcgctaaggtttgcctcagtttctctttctgccttctgtctcctcggttgaattcgttcttctgaggaggccagattgaggttgctgcagacccatatagattcgctgctggtaacacttaggtttgtataacacctgtaacttttcagagctctctcatgatagtatttaatgtcttctagctgtattatagcagtaactcacattttttattgtttcgcactatgaacctcaattgtgtgtacattctttttatctttcatgatgacagttattctgctctgccaagaggtttagttgaaaatcaagaatttccttgaatgcaatacttgccccaagttttttgtttgtttgtttttgtttttttttattttttggctggagtaggtgcttaaggctgaaaggtactggagcaatcttgaagtcctctttgtttcttaaattttgtaactcaatgatgtggttttggtaaaaataatctccatatactccaaaaaatgtatttttttgcagttactgaacatggtgtgaatataaatgttattccaaagatctcaacacctgatggggagcataattcaaatgtcctaagtttgattattgagaagattgtttctaatggcatgttctggaattctatttaagaccattgttactaatcatgttgacctatgatacagatcaaaaggcatattaatttggtttaaatgagttgatgttgagagaaatacctaataattagaatccaaaagattttcattaggatggactgagcagtagactaaattgttgatattaattgagataaatatcatattatgcacttggatctaaactataagaaggtcaaggtgtgacttaacaacaatacatatgaagaaagattcaaggctctagttgtttgctaggtcactgtgcatccatagcataatgagattgcaaaaatgtttgtgatcttaggctatgacaattttggtcaagtaaggtaatgactcctttgttgtgggaagtcagggaccctgaacagagggactggctgaagccatggcagaagaacataaattgtgaagatttcatggacatttatcacttccccaatcaatacccttataatttcctatgcctgtcattcctttaatctcttaatcccgttatcttcataaactgaggatgtgtatgtcgcctcaggaccttgtgatgattgcgttaactgcacaaattgtttgtaaagcatgtatgttcgaacaatatgaaatctgggcaccttgaaagaagaacaggataacagcgatgttcagggaacaagggagataaccattaggtctgactgcctgggagccgggcaggacagagtcatatttctcttattactgaaaatgggtaagagaaatatcactgaattctttccccagtaaggaatattaataattaacagccctgggaaaagaatgcactcccgtggggaggcctctgaaatggccactcttggagtgtctgccttatgcagttgtagatagggatgaaacatgccctggtctcctgcagcacccccaggcttgctaggattaggaaattccagcctggggaattctagtcagactggttctctgctcttgaaccctgtttcctattaagacatttatcaatgacaatgcgtgcacagtgggacatgaaacttcatcagcaattccagtttcaccctggccttgtggccttgccctgcccatttgccttgtgatattttgttgcctttgaagcatgtgatctctgtgacccacaccctattcatacactccctcccgtttgaaaatcactaataaaaacttgctggttttgcggtcagggggcatcacagaacctgctgacatgtgatgtctcccccagctttacaatttctctcttttgtactctttccctttatttctcagaccggccgacacttcaggaaaatagaaaagaacctacgttaaaatattgggggctggttaccccgatactcctctctctattctgtgacagcgtggtcacaccaaagtcaaaatctagataacacactttaagaagagtatagaagatcaggaatggcaaatgggctttatgtcttttgttaattctgattgattccttgtggttgcccagaaaaaaaaaaaatgggttgaaaaggattctgtaaccttattcaaaatggcccattgggaaatggtgccagatatgtcagtggcaaggaggtaataaactattgattattatatatattcaggattgtgctagtaaagggactataacagtattaacagaagagacagctctctcatcttctgcacactttaatttttctcattagtggtcagcacctgttaaaattttcatatgcctctcaacaatgccatctcctgaaacagatgtgggcaaacaatggctggcaggccaaatctggcccactattttattttaagtttaaatggtaaaaatgactattcaagttttggtgagaacagttgctcaattttgcctcttggcccacagagccttaaatatttaatacctagatctttacaaaaagaagttcattctaatgcccctatcttagagccatggttgttccagataacgttccacaggttggcatccaatgttcagggaaacattaattgatctatacagaaataagtttggtaaattcaagtttttaaaatacaattttatatatatatatttatatacacttttttgctattagactacctagatcttttaatacactaatgtgcattgtgaatcatcaagaagtaatgtagagtatgtactaatttctggttatttaaccatatttagtccttttaaaaatatctaataaatggcctgttagaatggtgttccacagaatgcatttgagatattgctgagatatatacaaaataacagtatattaacaacagctaaatttaacaagaacatacagtaagtcctcacttaacattgataagttcttggagactgcaattcgaagcaatatgatgataagagaaccaattttcccttaggctaattgatataaacaagagttacgctccttcagcatatttccagtcacaaaaacatcactaaatttctaaataaagaaccaaaacatttctcattttaaacatctgtacatacatttaacaaagattaataaggacaacataattatttacccgcttattccaatcgagggtctgggtggcccgagcctgtccccacagatcaaggtgcagagtgggaacccaccctgggcaggacaccatccagctgcaaaattagctgggcgtggtggcggcacctgtagtcccagctactcgggagactgaggcaggagaatggcgtgaacctgggaggcggagcttgcattgagccaagatcgcaccactgcactccagcctgggtgacagagcgagactccgtctcaaaaaaaaaataaaaatacaaaataaaaataagagatggattcttatttatctggtcagcatagctcctgtttctgatgtaagatgctatttgttgcaactttgttcttccatcagattatcagaccatgcaagaaattgcttagcaactcacccctatcaaagacagagttacagggaattctacttgggctttgggtagctttgtcttcatgtttatcttctttggctttttaaggcgactgtattaatccatgctcacactgctataaataaatacctgagactgggtaatttataaagaaaagaggcttaattggcccatggttctgcaggctgtacaggaagcatagcagcttctccttctgggaaggtctcaggaaacttaaaattatggcagaaggtgaaggagaagcatacacatcacattacactacaccagttggaggaagagaaggagtagggaggtgccacacttttaaacaatctgatctcttgagaactctgtcacaagaatggcaccaaagggatgacgctaaactattcattaaggatccaccgtcacgacccagtcacctcccaacaggccccacctccaacactggggattacaactgaacatgagatttgggtagagacatagatgcaaaccatatcagggactggggattgactagatggagcacatttgtttaactcctttgtcaaactgcatatttcaaccatgtctcactgtgattttagcttgtctaagaatagaatacacagtttagttaggcatggattccaggtagatggttttaaaacattgttgcccataaaaaaagttattgaaatgccattctaagacagagccatcatatagaacaaacagaggtgaagttgcttgctctatttgcctagagggcaaatagagaggagggcaaaggattcagggctacagagagggagggtgggggatagtctccagtaccatggagtctccatctagtcagtggaataggtgtgaagacaaacgcttcagagacttttgaaattattaaaaatgtataaagatatgaggataattgaaatacatgaattgtaacataataaaaaatttttaaataatagcaaaaaatcacaacgttaaagtccagtacaataaccaccaaaggtgtgtataaaccccactgagttttaaatggtagcagtaaaggggtggatattctattatcagagtatcataaacacaatttacaatgtactgggtctaactactttaaactgcagtccttgatgaaattttaaaatttgggagaatttacattatttcagatggacttcattaaaacttttatgttgtactattttaaatttagatcattcaagttctcataaaattagattatacaatattagatattaacactgtgcatgcgtttcgctttgatataaataccgaattaagggagagaggatactgtttgcaaaacactgtcttgctttccatcctgtagcagttctacattatcttcacaaaattcgaaggcaacattttaaaactgtaaacctaaaccacagtaaagtttaagaggtttactggaaatgattcataaaattctgtagccagtgattgcaaaagagaaggtgtctcaaggattggaaaactcctataaattaaattcttataagatttcaaatagaagtaatgaatttatacagaatcacctgcaatgagttagtaactaagaaaagaaaaaagaacttgaacacatgatgacatgggttgtaagaataatgcatgaaaggccaaagtctaaaacgatctgcctgtttcaaaatgttctaaaaacacttttacaaagaaatgtttagagggagaggaaccactaagaagagagatgaggctgacgctgtcccattaactaatgacagtgagaaacgaactactgaaactactgaatgtcagttctcctcttcctccaccagaaatggtcttcaaactaagacagaagaagcaagcatgaagcccaggggatgtagtgaataaaattgatggcacaaagcttggatagatttggtggagggtaccacttttggttataacactagatcctatttcagtcatgtagaagcaaatctggagaatgagaaaggggctggagaagtattaataaaaatgtgtgaatactgttctaattttccaaaatgtagaaaaattcagattctagtagatatgacctaatgacgtttcattgattcctagaaaaatcaaaaaactcactatttaaatgataaaatggtagtcttgaatagagacgtattttccatggtataggttataataagtcatgacaatcgaatcccatttctttagctggtacaggaggaaaagctaataaagagttttgggttttgttatttttatgtaactttttaaatctcttgacagccatgacattcttgtgggcaagaataaaaaggttgtgatagtacccataaaagcatattaacgtttaaatgacaatacctaaaacatattgattattgattagtgctaagcgggagagtattctctataggactccgttcatagccacatccctagtcaagtaatttgtaattttaccaacaacttaaagacagttgttatatacagttgacagaaagctggaaaggacagctggctctgcggacagtaggataaaaaccaggacatgccagttgtggggtttagcacttgctggctactttatcctggcaagtgaaataccatctctccatcagtttccacacctgtaaatgggataataatgaaatcataaggatgtaattaattatatgatgataaatatagcatattgcaagacctggtacatattaaatcattaataaaatcaaatcattgtgttatcaatatggaataggaaaatgagctaaaactaacaaggtagcataaacagacacaaaaaagtaaagttccagacttaggttttaaaaaatcagttacataaatgctggatgaaaaattccatgtgaaaagcatcagagttttctcattttcaaattcagtagcaccttatgatataacagtgagagaaacttaacttagactttatttttgtcccaggcaagtggagtagcattccactcctattgtactagaaacaattatgttttaagataattgtttatatgagctataatattttgagaaggatatcaattggtatgtggctagcaaagttaactaaaatgttaacttaactgaatgactaaattgtgtcattcagtaagtaattgaatgaaataacgggggattaggctggggaagaaatggcaaacagatttggaccaactggccagttacatacagtgaatactacaccatgcagaggaatgagcaggctctctgtatactgatattgaaacattttcgaggtatgttaagtgaagaaagcaaggtgtggaatggtgtgagcatcatttgtttttataaaacaaagaaaggagtaagtatctatatttgcttggagattcataaaatgagaccttgggaagaaactaagaacataatttacctattgagagtgagagctaggcaaaaggaggaagaagacaaggactgggagcagacattttacttcatacctgagttgatttggttccctcagaagctgaccctgagatgagaatttttgtacaagcgatttctttaggagatgatcccaggaagcagggatgggaaggaagcaataagtgatgtattattaaccaggttactgctacggagctgtatcccactggcaacctccagcaggtaatgtaaagtgcacatcagagctactccagcagtaaatgaggaaactcccattgagtgaggactgcttactgccggggagccctggggcagatgctcttagccatgggcatgggggaggtaaacccaggacatacaggctgggtagtgcaccaacagcatctgttattatacccttctgattcttttaggtttttgaaccaagggaaagtgtttcattcccaaaaagttcttaataaaatttataaagaaaaataaaaaaatcatatgtcataaaatattagtgatactgacatccagaaagagattagatctattttttgctcagttctgacacacagaaccagaagcaatatatcttataagatagcaaatatcaatgaaaataggaagaagtttctaataatagatctgctgtcttgtgaggtcttgataattacctatcattggtctcactctattagagaatagagctcattcaagaatctgttttaaacaaatatttattggatattaagcacaaggtaataaacaaagtagttagcctccaaaagtggtaacaaaaagataaagtattttgttatgcagcaacaggaacctaaacagcccattacataaatttctcatttaattacctcaatataacattctcaagaagtggttagtattagaaagccaaggcacagaatgacaaagcctgaaccagcaggtagttattccaattccacaatgatcctctgtaagcttacgaacccattgcccagcagcgctggcatcacccaaggaacagacttgctagaaatgcagaatctcaggccctcccacagatttgtttaatcaaaatctgcatttgaacaagatccctgggtgattttgtgtgcacagcgtagtttggaaagcaagtttaccatgctcacactctacatacatggtataatttgctttatccctaaaggaaatattattggctcatatttaaactacatttaatttaaattcaattagacattttaatttataaagccatgatatacaaattgaatcactgcaatagccacaataccagatgatcatatacacctttataaatatcatctcaaacatattgtactcatgtgatgggagttaatcatttaggatagaaagatttttatgtcctcaaatttgagcatagtgtccagtactattgtggacatagttcctagatatactcagagccaacttggtaatctattaaaatatgataggtagttttccttagttcattataaacttcactcacaattgtgaggcactctattacgaactgaaacaatggtacctgaaaatatgaataaaacatcacactaacaatgcttttggaaccattatggcatagaatattgtatcaatccataatttgaagatgggactaaatggatctttcatctaaaagagctactgtgatgtgtcaatttacacctgatgttaataagcacatactatcacataaaatccatattaaaatattttatataagatgtacttgcattaatagatatctgtcatttgttactaaatacagctgttaaaagaacctcttaagtgctttcaaaatttgtttttaagaccttgacattggattgaataaaaactattatggaaccaatccttcattgtgaaaatggacataatggatgaaatactgtatgttgcttacttcatttttgccaggtcaaatagaaattcccatcagcatttgacaccccttacatggccacataataaatgggtgagagcctaaatatggacattaaatatttcattttcactagacattattacagtatagtatgctttaacttttgagaatatctttcacatttcttctttgaccattatcgtctttcatagtgaacctctcctaaaagggagtaaaataaggtagctcactcaattatgaatcattctagattataaattcatgtatcattaaccatgaattcaacaagtacacagtgatctgtttgatctgaaattgcatcagagtgtgaagtagtactttaggaagattaaattaataaaataaattgaataaatgttcaatataagtgaaatatggcaccttcacctaagggtaaataaataaatccactgtttacattgttcccctttgacttcattttctccatcatcttcttgctgacactaactgtgcctccatttgatggaatcaatattttaaatatgaatcaaaatgcaaagtaggaggcttaggcacacataagtttgaagtaatttttttctaatggcttagagtcatttatcttcgtctgaaaggcttttgactagtggtgagagaatcacagtgcttttcattttattaaagttgcttctcaacttcagaaatattctgtttatcattacatttaaataaaagatactaagagcaaactgaatgcaaaaactacagtattgtatcattattattactattattgttcttattttatagactgaatatggaatgtgatttctatgcagctttggcattgaaattagtaaaatataatttctcttccaaaaggtttgtatcctttgatttccgtcatgcctttattttctctatcctgagaaggattcatctgtcagaagtatgttagatgttgtgccaaccttacagagggatttttaaagcaaccactttaaatgactagccagcactttggtgcataaattggacttgaaaagtgcacaatttaaaaagtgtatttctcaatttttctgctgatttcttgacttttactatttccatgtatgacaacctgtttcctgaaatgtaagcagacaattaacattgttttagtacattttttgaagtctagaagctcagaaataattcagtactcaaagcagcctagaacccaagttgctacttagagaaataggtcaaaacttatttaacctgaaataaattactatctaccatctgtgggctttaaattctaaatgaccttgaaatttcacctactggtttccaccaacatgattgagtggaatgatgttccttctgccattgaactcttcgtttcagagcttttgtagcctggaatggaatgtctttgttagcttcacttacaaaatatattatttgaattacaggattggagacaaaacgttactcaggaaggaaaagaaattgcttgttagaatcactaaattaattgctgctcagcaaacttgaaaacctccaagaagagataaaacacgaaatctccacgttggccagatttcacctgtttgtgcactctcatttgacctctggattactccctgtctcaagttttccatcacagcctttgccttatcttctggtcttttccttctagttggaatccatgccatctttaaatgtattcctattttgtcattcaacagacaaactccgagttttgtatccccctcccgagcccttcccctccgtggctaacacgttctgccattactttctggccacacaatgtcaccgtcttcatgcttttctttgcactctcccagctgatgtcgacatccttcattccacggcatctgagcagaaccacaagatgacaactttaggatcataatgcgaattagttatgctctcaccatttcccattctcattaaatcattgtcaggacaatggattcatgtggtaccatttcctgttctcattacaatttttgtcacaagaatgaggtatcagaatttcaatgcttcccatagtctttgaaaaataatagttaactctgctgctttgacctatattttttctgttctgcgtttgactcagccctgccattctctcccctgcctgtttatggtcttggtgatctggagattaagatgaagggtcctgaagatggcagaagttatgaaatcacgctacaggattgtgttaaaactttgccttctctttttaatgacaaaactaaacccaatagtgcggcatgctctacactaaagttagaaagtggacacatgatcatttcttaggtaaacaatttctcaatattcttttccattccatttttacttttttcttctacttaaataacaaacacataacttttccttaaacaaaagcaaggaaatcattgttcatattttcttggttttttaaaaaacaaagatttcaaatttatgttacttttaggaaaaaaagaaccattcttactcctcaaatatacaatttgaataaattactttatttcccctccctgctgatcctagctgcctttaccaaggtttgttttacaattgatggctttgttcttccaagacagttacacgttctgtttgggttcaggtagaagtcttacaaacactaagtaatgatttgttaactaaacgctcctgaagctgtctgtcagctctccccgcagcataatagcggcttcacctgcctgcagtcacttcaggacgctctaattaaatgcaaactttgtaaaaataccagacaagcacaggcaacacggaaatgccatagaaatatatacttctcccttcggcatatgctgttgcagttgtttttggcttatgttgttgttgttcccacagtataagagaaaatggagatcatgtaattgttaacagaccaattacccgatttgtagaaaatgttttaacctgtaataggcttaaagctaaattccaattctgtttggattcagaataggaaaactttcttcagtttggtattttttaacttgcttctggagtcttgtcacttttttttcacttactgctttttttatttttcatgtttttttttttttagactatgtttttattttgaaatgtggcccagcacagtgcctggtatataatagacacacaatatatatttgtccatggaaaggataaaggagtggggaaatacacaaaaagtgtaataaaaatacaaaaattagccaggcatggtggtgtgtgcctgtaatcccagttactcacaggaccaggcaggagaatcgcttgaacccaggaggcagaggctgcagtgagccaagatcgtgctattgcactccagcctgggcaacaagagcaaaactccatctcaaaaaaaaaaaaaaaaaaaaaaaaacttgagggtaaaatcgtttccagatagcacttctattggatcatgttttattttagtagtttctttctattcctatttgatttagagttttcatttggaatgaattttatcaaaaacctctcagagtctgtaaatgtgatcatagaattttttcctcctttaatttactgctgatactaaatcacctgtttcatcagatgtattattttttaatacatggctgggttttatttttaacatttcatttagaatcttgcatttttctttaaaaatgagttaatattgttttgtttatgctatctttgccaggttttagtattgatgtaaaatgacttggagagaattttcttatttgtatgtggcttgaatcatttgtgtgacagtgtaggtatccttcaaaggatagataaaacttagctttgaaggcatctggaactggtaacttcatggtgcatttctaaccaccttctgatctttttggaggtacattgtactcagattatcctttttagggggataatttcgttaatgtgggttttgccaggcactcatccattttctctaggatttctaatttgttgcaataggatttcaggtagtagtgtctttaaagttgtttaatttctcctgagtctatgattatgcgtcccacttctcattctcaatcaagtctattacatatatattttttctgctcctaactgtgcctacaaggggaatatctattttactagccatttccaagaatcagctttcggatttatgtctccattttatttaatgtttatttgctatttccctaattttaagcttcatctttgtttctttttgtttatctttctttttttctttttaagatgctattaacaatttaattttatttatctgtcatctttaataatgagggcttttaaggccaaaactagtcttccaattatagctttcattgtactactatgtccgggataaaatagtctccatctcgatattgtctggattttatgtattttcacttttttatctgaaaactttccagaaattatctacgagtataattttttatttctaaatgcataaaattattttgattatatttatctattcctaattgcattagcttatgatttcaaaaagagaagcctgaaaaatataactatgctttaaaaaaatccagtaacttttttaatggttagtttcataaatggtctatggacatacaaaaataaatattctatatgggagggatgataatatatgtatatatttaataaatcaagtttattgatcaattctatgcatttacttgtttttcatttagtagatccgtttaatttcataagaactattaaaaactctctagttttattttcaagttcactttgcatagctaatagtttttgctgtatgcatcagttgtcaacttgttggacatgcaaatgtgttagttatatttgcaatataaattgtccctctttccatttcataatgtctctttttatcttgattactacttttaatctttaatttcactgtgtctgctgctagtattactactcccattttcattttgttttttgtttgcattggctggtaccctttgctcatccttaatttttttaaacatttttcatcttaaatgataagtagcacatagctaggttttttaaaaatctcatgtttataatctctgccctttaataagggaatctaggcactcacatttaatttaatgactactatatttaaatttgcttcctcacaaactaagcatctgtcaggaggcactgcaggataattcaattggattaatgttaggtctagtagcatgcccacttaccaagggccctcattggactttactaactttgtccttcatagaaccaactcaacacagagcttgttctaggatatttttcttgttattaaccactatttatgttgttatttctagcatttattgagtctttacatccatttttcttattcacattcccactgttaaagtcatatcttaaaggaaagattgtcattacatgagaatattccctatgaattgacaaattaataaaataatttccctctaaacattctgctccagtgaacactaatacctattttggccttagggcatctgagtcagtttctcagttgctatgctctaattgccagcaatagaaatcaactctggctaacttaaattttaaaaatttaatcaaaggattttacaggtagctgataaaatgaactaaggatagaggacaagataggaaaggacagaaaatatttttgtttcttttttttttttttggcacgtttgtttttgcaccaattgtaagtcagacagctgttatggatccaattgtaagcatagtatagtccctacccttaaggaaggtacttctagtatttgaaaaaatttgttgaagagttccaagtttcaagtaagcagaaaagactggtcagtgactagagtataacaaaaacagtaccataacagtgtgtgtttaggatgcacagatcacatcaggtactgttctaagtgctctttctcgttggttttaccgcaccctattataatacccattttctagaaaaggacactaagatttgggacccgagattcaagcccagacagtctgacttgttcttgtgcttttcatgtctcatatattgagggaaagaatgcttgttggataaatttatggataaagaaatgcagaaatatgtgtcatactcctttttagattcagtggcacatcttaccattatcatctttgtatttttgtcataatccagtgtctgaatcatatatttctggctctgcccagcatttctttctttagataataagaaattcaatacatagttctgttaccccttaagtttacttctttttttaaaattatgtacatcattttagatttgtaagtgtacatttttcttactttttttttaagagatattgcccaggctagtcttgaactcctggcctaaagagatccttctctctcaccctcccaacatgctgggattacaagcacaaaccacctcattcatcccccttaggttatttcaacacccacagccactttattatttcagaacaaagttattccagaattaagcccagaattcaaattatccttgcttgctacacatgtagacattaagctttaaagaaaaaaataattaatcccagagaagtttgttctcaacatatgtgcagaaatcagattacaaaatactgtaaacatttctgttttcatttgtgctttatataaacatgtagccacacaaacacttgcacacagacattttagaaattgtgcaaaatgcttaatgctgcttttctaggaaagtaggtttataagtggtttctattttctttcttctctgtatttctacatttcttactataaaaatctttgctttattaatgaaaagaaaatgattttttaaaataacgattaatacaatttcataaggtgccttacttcatagcagaataaaacttcctggagacatcaggatacaaagctgccatctttcctgttactgtttatctccacaaattgccagttttgctggtagtattgagtatctgtatgggctgagctatatagcaaatgctcagagaaatatcacttttatgcagctcttttttccttcagtgacaaatgttttccactcttagttcctgaatttctacctttgtcccaaaagtgctcccccctcctatgttctaataaagcatgtgggttttttttttttttttgaagcaagcatgtccacataacattccttcatttgcctaccgtaaattctccgtatgtactagataaatggtggcaatatggttcatctttaaaaactttaactgaaagtcatcctctagccatccatttgaattgtatgcgtttacaaggaaaactcagtgtaaaattcaatgctgaagcaattacacaagatttaccggtcttttaaattaaaaattcctaaacctttgttttcgctaaactaaaactatcattttcatttttcaaaaatagatataacccaaaagaggacgacagtaata

SEQ ID NO: 553 - DNA, 3285 bp, Homo sapiens
agatcacaagttactctgaaacagtaaaacttctggatcaactgggtaacactattggttccctgtgtttgtattctggtcccagaggctctgtggtgatagagactgagataagagacaagtaaaatagtgtccctttcgtcaaaagtctaccaggaataggactttcacgaaatgctgacagagctcgtgtaaggtaaaatgtaactactccaggctttgggagggagggaggtggagatgtgaataggtgttgtcctaagatgctagaatggtagaagtttatttcaactcctaggaagagctacctgttatgaccctaaaaataacatctttgctgcaggagacatgaagaatctctcagataatccatgaattctagaatgcaaggaatggaatggagtataaagatcatctgccccagtgccttttgattgtttctgccagtcatttgccagcctgccctcaggaccattccacaggctcttctgcctaaatttgagactctgttcagagactgaacagtagggggaagacaccaggctttgttgtcctctttgtgggtgtaacagcatctcctctgaagctccaggtctctccagacagccctctcttccacattccagctcctgctatctcccctgctgtgacttctgcttgtaacagctagccctagactcggccaacaccatttccttcctctcctatggctcacggaagattcctgctgttgtccatccatctctgtgttgcctcccaagcctgtgtgccttacaatctttccggccctttgttaaattctattaaatgacctcacaaaatccctgtcttcctgactggcccttactgacacagtgcttcacaggctgaaggtgaaggggaatggcagtgatccacttttaaaaaggtctttgggaccctatactggagaagtttcccagttagtcacatgtttcaaatactggggtttcaagatataaagggaccactggggtccaatcacctcagtttacagtcaggaacctggaggcctgatgagggaaagtgtcttgcctagggatcatatagtaagccagaggcctgatgaaagctggactaattcccagcttttttccttccttcacatggattttggcaaagtgaccgtgataggaacagcatcacattcttaaactagctggggtaggtgggcacctaggttttgttccctttggacttgtacaatatccttgccatcattcccttccttcctgcgtttctttgatagagcaaacatttctaagcttggaggggaaggggaaaaatacaacttaaaagaaaagcaacacataaagatttaagggcctatgggaacaagggagcagaagcagaagaaaaagaatgaaaaatgaggcaggggacaaagagaaccagaagataacaagacaatggctaagtgggcaaaaactgacataaaaactccaagcacaaaaccagacagctacacagaaaaaaaaaaatgacatgcccaagaaatcatccttcgccccatggttttaaaattagaggtgtagaaacaactgaaatagcacctggggtggggaggtgggggaatcaacagagaatatcaaaagaaatgtccctgagctcgacacccctgaaagggaaaatcgtctacccactggctctgcacttgctccagccttcttcagctcgactttgcacactagtactgctcacttgggaaggcagcataaagcagtattagaaagagcccaggacttactagtaatcaagaaaatagaaactcaaacaaaacggaagaagccattttgccaaaaggaatgaagatgccactgaacacaaacacaaacacaaacacacacacacacacacacacacacacacgagatctgatgctattgttgttgaaggtcaggtgaaatgcactttctcagatactatccttacaacagaacactagtgcaaccaccttccaaaacaatttgacagtgtttatgaaaactaaagcacccccattctctgacctggaaagtctacttcctgggtatctatcctagcaaaacatgtaccagagatacatgcaaggatcttctctggagaattgtacataacaaaaggatacgattggaaatgatccaaatgcccatcaaatagaagactggcaaaacaaactataatatattctgactgtgtgaactatttaacattatctatggcaacacagtatcaccaagtaaccatgtgtacccctacatttctcagttctcttgtagctagtatgccaaaacttttaagagaccatgtgcaaccctccagagccctatttgttggctacaaggacctggaagccacatgtggagatggtggaatcacaggtgagattaggctggattataagagttacaacatgggggatgtcacctgacccacatgtgcatgactgagaaataaacgtttgacgtgttaaccactgagatcttaggaataactcatgataacagcattgactaatctagcctattaagtctgaacatggtagcactaattattctacaaggcacaagactaaaagaaaccagcaagctgcagaacaatacatacagcagaagaacatatattagacacacatgttcacacatgaagcaataatgtgtatcttctaaggacagatacatgcataagtaaatgtataggaaaaggtccagatgatgttcaccaagctattgccagtaaacttgggaagggcagaccaagaaatttcaacctaatctataatttaaaaaaatttttttaataatgaatttttaaataaattcatttattatttgtgccataaatatcaatctacttaaaagcaacattgagaaaaagaaataaaagccaggctttaacacaatggtgtagccttaagtctctattaacttttgtgcaaaacaaagggcttgccccttacttaaatgtagcagggttcttcaaatgtggtatgaaatcgaggtgggtgagcaaaagccgcattttctgttatacagaactaccacctctaatataaactcctgctgttagatatgaagaggctcttaaacctcacttcgagctctcaacagcagtgacgacagtggaatacaaacaaggaattagatttaaactcagaggaaaatatatttccctctcattacaggcatggcaatgaaggcagatgcttggtgggctgtggcaagtcaaaagttagtatgtgtttgttatattttagttttgccaatgttgttctgtatgcaaattagc

SEQ ID NO: 554 - DNA, 6092 bp, Homo sapiens
aaaaaaaaagaaagatgattaatatctgacagccacctcagaagcccccaatgtcagaaacacaggacactggaagggtgtctcattgacactggtaggtcaatgaaataagacacatatttcaatttcaatcactatagtctatacaattttaaacacataagtactgccatataactaactcggtcctcctagaagccattccagagtagaatttcacacttcctctaatgtgggaaaagacagaaatcctaacggaaaaagatggtaagtggctgggcgctgtggctcatgcctgtaaccccagccctttgggaggccaaggcgggtggttcacgaggtcaggagatcgagaccatcctggctaaaacggtgagaccccatctctactaaaaatacaaaaaattagccgggcgtggtggtgggcgcctgtagtcccagctactcaggaggctgaagcaggagaatggcatgaacccgggaggcagagcttgcagtgagccgagatcgtgccactgcactccagcctgggccacagagcgagactccgtctcaaaaaaaaaaaaaaaaaaaaaaaaaaaaaaaggaaaaagatgataagtttaactacttgcaaaaatatctatataaaccattcaaaacaataggctaggagaacatatctacaagaatatctaataaataaaggtttaatatcccattacataaagggttcctgcaagtcaataaaaaagacaatccaattaaaaaacagccaaaaggaaatgaaaagacaattcacagaagtaaccaataaacatgaggaagaaaatacccttactcatggttaaaaacttaaaagtcaaagtaaataatgtcacatgatatgcaaaatttttcatgttaaaaagccattgtggatgaagttaggaggctaataccaagattatgaattagcgacgttatttgaatcaacttggcaatatctatctaaatttaaaacaaacatgcattttgaccttgcaagcataataccaaggatttgtcctgcagagatactgacataatgaagcaaagatatccacacagttaattacagatacatagctgttcactgccaccctgtttgtaatggtttaaaaacaaattgaagtaggccaggtgtggtggctcatgcctgtaatcccagcactttgggaggccgaggcaggccgatcacgaggttaggagatcgagaccatcctggctaacatggtgaaaccccgtctctaccaaaaatacaaaaaaaaaattagcccggcgtggtggcgggtgcctgtagtaccaactacttgggaggctgaggtgggagaatggcatgaatccgggaggcagagcttgcagtgagccgagattgtgccactgcacttcagattggacgacagagcaagactccacctcaaaaaaaaaaaaacaaattgaaaaaaatctaaatgtccatggggctcaattaaataaatggtgggttaaccatatattatgatgtgattaaaaagaatatcataaatctaattttgccaaaaaaagttatcggagattttttttttttttttgagacagaatctcactccatcgcccaggctggagtgcagtggcacaatcttggctcactgcaacctccacctcctgagttcaagtgattctcttgcctcagcctccacagtagctgggattacaggcacccaccaccacgcctggctaattttgtaattttagcagaggcagggtttcgccatgttggccaggttgatctcgaactcctgacctcaagtgatccacccccttcgggctcccaaaatgctgggattacaggtgtgagccaccactcccgggcttaagacacatttttatgtgaacaaaaaagttacaaaactacagatagaacatgattctatttgagttatttcatgtatatacataaatatacactatataaaaaggggttcagggatacaccaccccaaagtatggcacattgacctttgaggaaatatcagaagcaggaatgactctctgacctctcccacccttctcccctgaagcaggtcataaaagaattacctgaccttcctgtaacataggatgtaagactttcattccaaaagtgccttccctatgcccaggaaaaaaaaaaaaaaaaaaaaatccttatcctcgaagacacagagacaccaagaggaatctgagcaaacaagccttgctaagttcccctcagcttaccaatatttgatcatatccttttgccatcccatcattcttctgcccaactgtacataaaaatacacaggtttccccatgctttggatcttcacctctctttttttttttttttttgagttgggggaggggcttcttcattcttaaggctcctgtgtcacataaaacttacattaaataaatttgtatgcttttctcttgttaatttgtattttgttataggagtctcagctatgaacttagtggtgggtaaggaaagatatcttttctcttctacaataggcttggaaatttctagaatttgtggaaaggaaatggtatttaaagagaaagggatgagagtaaatcccaccttaaaaccttgttgaggcgttttcttgtctttgccatgagcaaatattgttttgaaagttttaaaacatatatatgggagatgttatattcactttaaaattccatataatttgcaagagctatcaaaataaaataattgtcattgcaactctgccaactgcaagcccaataaagcaaaagaacactgaacaacctggatttaaatcctggagtcacttctcagtcacattaccttcttttctacttacttagttaactctgagccagtttcttcacattttaagagaatcgtggtgaagattaaatgaaataacatgtaaagagtgtcttgctcaattttgcatacacattaggctttcaacaaatactagtttctttccattttttctgaatgacatcagagctcagaaaatgcagcggctcaaagtagtggcagattctcagttatctgaaattctacagcaggacaataaaactgcttccaaatgttgaaggaatttgcgtttctacaccatcctaagcaatgtggcctaatcccatggcattaattccaatccacacacagataactccaaatgtaaatctcaagccccatcctttgccttcagttccagacttgctcgtataactgctgaagatgacaagcattaataagatcttaaacatcacataaatcttaaacctgcttttcttcagcctctccatctcagtaaatggttccagcatcccctaattatttaaaatccaaaccaaagattcatgattgtttcctttctccatccttcacagtcttgactctccatttgcaataacccacatctgccatttgtctccatcaatctggtgaccccctttctcaatgtcacagccaatatggtatttttaaatggtcaagtagacgtctcaaatactccagcaacctcccactgggagcgtaattaatcccaaactcctcgccaggggcctgcatggtctctttccagcctctccctcctgcccttctttccaaagatcactagactctgcacagttccccagcacactttgcactcgctgtactcgctgtttcttttccctgaaatacttgcttctcagctatgtgtatgccttactccttttttatattcaggtgaagattaagtaatttaaagggacaagtcctgtccacccaatctaaagcagcctcctagttaactactattaacagtcattttcttcatttcctgtcactgttcactaaaatgtaagctccgtaaggacagaaatgttttatcatcccatgattttctgtgcctagacgaatgcctgccacacagcagtaactacatacatttttgttcactggactaatgaattggtggttcaacaaacagatctaaaggagatccccaactcttgttggttgccttttaaaaaattaaagagtattttaagaataaaagcagagactgatttgtggttatctcagagccagtgaattttagcatttaaagctaagatctgatgaagagccaacacaaatggtaaaaaatgataatggttagcttagattttaatcgatttgtgttacttgtgctaataccaaagaacttgatttgaaagtgttttattagatcaatcagaatatagtggagtcacccagctggctgcaaacttatccagtcaaaatatcttccagaacttcaagtttcaaaatagataaacttcctaaatcaggtctttgggctgcctgcaagagtctgccatattttaggctcctctagttttctgagaattaacccttcctttggcatataccgtctacattttcttctttctgactccggcactgtagttaatcacacaaaggtgaggctcttaacactaaatctgtatatttgtttacattatgagaaacagagaaaagactttatacaaaaatggtggcaactatgattgattctggcttagagggttaaggataattcatattcttctttattctcttccctgttttccaataaacaagtaacattttacaaataaatacagtttttaaaaacttcttaaactagtacctaatatcctatgtacccaaaaggaataagaactaaaaaagagacttgaaaattaaaagacagacactaaacttctttcatatgattgaagaaatttttggaatttaagatattcttttatggctcaccacagaaactacttctaatttttaattttttagggaaaaatttattattcttaaaagttgtttatctaaccctaaaattctgatccaaatttattattaaaaatcaaactggtccacatttaagtcacctttgcctgacttacagccacagcaatgcattaagggaacaaaattctcggtattttggtaatttcacaggaccacggcagtagactcagagtagatgcttgacaaataataaaatacaagccttaaatatgagatggcactcttgcatattactgattatattattaatgctaacatcactaggatcctagtgtaatgctaggatcattgccaagtttaagtacactgtgtttaaatatgatgcatgcacttgaagcagtagaacctcaattcaacaaaaagcactgaggcagcatacttgtcaacatccgggagatgtaggagctttgcctggactccggctctcccagacgtgggtcactacaacattcagtacaggaatgaacaatgtatcgaactgttatcctgtaaggctgcttccctgaaggattgttcacagaggaaaattatgtcgcaatctgcatgctattttgaattttcataactgattcagcactccaattgctgataagtaccgtaatcagaaatctttttcctcccacagaacaagaacaattcaaacatcagaatttatccccacaatccagatctgaaaaatgaaaaagcaacaactagacctacatcttctttaaatctcaaagaaacatttgctctgtgcaagacagtgctattctaatgatagaggaaacttctgatgaataatgcagaagcacctgtggacatttaggcactagtggccatttaaatgctctttccctacgtgaacaagtgaccacaagaactcctttttttttttttttttgtcttgaagcacttgactcagaaacataaaaatagtcaagattggtttaactgaaatcacacttctgtgtgatctgtatgcatcctttcttttgttccagaaatgtgaggatccaaggttttaaacctaagccagtctggccagcttgactcatccaggacatctttcagtagtttcacagtggccatcagctctgtcagacaccggacatggcttgaaagggccatgtcagcaagtgatcattattgtgtctgaaaagagctgtgcttgatggctgaaatattacaactaccaaaaagctacaagtggaaactccatagaatcagctcatttgtagtcacagaatactctattcctacccactttcacacacgctactccctatat

SEQ ID NO: 555 - DNA, 14687 bp, Homo sapiens
aaaaaaaaagaaagatgattaatatctgacagccacctcagaagcccccaatgtcagaaacacaggacactggaagggtgtctcattgacactggtaggtcaatgaaataagacacatatttcaatttcaatcactatagtctatacaattttaaacacataagtactgccatataactaactcggtcctcctagaagccattccagagtagaatttcacacttcctctaatgtgggaaaagacagaaatcctaacggaaaaagatggtaagtggctgggcgctgtggctcatgcctgtaaccccagccctttgggaggccaaggcgggtggttcacgaggtcaggagatcgagaccatcctggctaaaacggtgagaccccatctctactaaaaatacaaaaaattagccgggcgtggtggtgggcgcctgtagtcccagctactcaggaggctgaagcaggagaatggcatgaacccgggaggcagagcttgcagtgagccgagatcgtgccactgcactccagcctgggccacagagcgagactccgtctcaaaaaaaaaaaaaaaaaaaaaaaaaaaaaaaggaaaaagatgataagtttaactacttgcaaaaatatctatataaaccattcaaaacaataggctaggagaacatatctacaagaatatctaataaataaaggtttaatatcccattacataaagggttcctgcaagtcaataaaaaagacaatccaattaaaaaacagccaaaaggaaatgaaaagacaattcacagaagtaaccaataaacatgaggaagaaaatacccttactcatggttaaaaacttaaaagtcaaagtaaataatgtcacatgatatgcaaaatttttcatgttaaaaagccattgtggatgaagttaggaggctaataccaagattatgaattagcgacgttatttgaatcaacttggcaatatctatctaaatttaaaacaaacatgcattttgaccttgcaagcataataccaaggatttgtcctgcagagatactgacataatgaagcaaagatatccacacagttaattacagatacatagctgttcactgccaccctgtttgtaatggtttaaaaacaaattgaagtaggccaggtgtggtggctcatgcctgtaatcccagcactttgggaggccgaggcaggccgatcacgaggttaggagatcgagaccatcctggctaacatggtgaaaccccgtctctaccaaaaatacaaaaaaaaaattagcccggcgtggtggcgggtgcctgtagtaccaactacttgggaggctgaggtgggagaatggcatgaatccgggaggcagagcttgcagtgagccgagattgtgccactgcacttcagattggacgacagagcaagactccacctcaaaaaaaaaaaaacaaattgaaaaaaatctaaatgtccatggggctcaattaaataaatggtgggttaaccatatattatgatgtgattaaaaagaatatcataaatctaattttgccaaaaaaagttatcggagattttttttttttttttgagacagaatctcactccatcgcccaggctggagtgcagtggcacaatcttggctcactgcaacctccacctcctgagttcaagtgattctcttgcctcagcctccacagtagctgggattacaggcacccaccaccacgcctggctaattttgtaattttagcagaggcagggtttcgccatgttggccaggttgatctcgaactcctgacctcaagtgatccacccccttcgggctcccaaaatgctgggattacaggtgtgagccaccactcccgggcttaagacacatttttatgtgaacaaaaaagttacaaaactacagatagaacatgattctatttgagttatttcatgtatatacataaatatacactatataaaaaggggttcagggatacaccaccccaaagtatggcacattgacctttgaggaaatatcagaagcaggaatgactctctgacctctcccacccttctcccctgaagcaggtcataaaagaattacctgaccttcctgtaacataggatgtaagactttcattccaaaagtgccttccctatgcccaggaaaaaaaaaaaaaaaaaaaaatccttatcctcgaagacacagagacaccaagaggaatctgagcaaacaagccttgctaagttcccctcagcttaccaatatttgatcatatccttttgccatcccatcattcttctgcccaactgtacataaaaatacacaggtttccccatgctttggatcttcacctctctttttttttttttttttgagttgggggaggggcttcttcattcttaaggctcctgtgtcacataaaacttacattaaataaatttgtatgcttttctcttgttaatttgtattttgttataggagtctcagctatgaacttagtggtgggtaaggaaagatatcttttctcttctacaataggcttggaaatttctagaatttgtggaaaggaaatggtatttaaagagaaagggatgagagtaaatcccaccttaaaaccttgttgaggcgttttcttgtctttgccatgagcaaatattgttttgaaagttttaaaacatatatatgggagatgttatattcactttaaaattccatataatttgcaagagctatcaaaataaaataattgtcattgcaactctgccaactgcaagcccaataaagcaaaagaacactgaacaacctggatttaaatcctggagtcacttctcagtcacattaccttcttttctacttacttagttaactctgagccagtttcttcacattttaagagaatcgtggtgaagattaaatgaaataacatgtaaagagtgtcttgctcaattttgcatacacattaggctttcaacaaatactagtttctttccattttttctgaatgacatcagagctcagaaaatgcagcggctcaaagtagtggcagattctcagttatctgaaattctacagcaggacaataaaactgcttccaaatgttgaaggaatttgcgtttctacaccatcctaagcaatgtggcctaatcccatggcattaattccaatccacacacagataactccaaatgtaaatctcaagccccatcctttgccttcagttccagacttgctcgtataactgctgaagatgacaagcattaataagatcttaaacatcacataaatcttaaacctgcttttcttcagcctctccatctcagtaaatggttccagcatcccctaattatttaaaatccaaaccaaagattcatgattgtttcctttctccatccttcacagtcttgactctccatttgcaataacccacatctgccatttgtctccatcaatctggtgaccccctttctcaatgtcacagccaatatggtatttttaaatggtcaagtagacgtctcaaatactccagcaacctcccactgggagcgtaattaatcccaaactcctcgccaggggcctgcatggtctctttccagcctctccctcctgcccttctttccaaagatcactagactctgcacagttccccagcacactttgcactcgctgtactcgctgtttcttttccctgaaatacttgcttctcagctatgtgtatgccttactccttttttatattcaggtgaagattaagtaatttaaagggacaagtcctgtccacccaatctaaagcagcctcctagttaactactattaacagtcattttcttcatttcctgtcactgttcactaaaatgtaagctccgtaaggacagaaatgttttatcatcccatgattttctgtgcctagacgaatgcctgccacacagcagtaactacatacatttttgttcactggactaatgaattggtggttcaacaaacagatctaaaggagatccccaactcttgttggttgccttttaaaaaattaaagagtattttaagaataaaagcagagactgatttgtggttatctcagagccagtgaattttagcatttaaagctaagatctgatgaagagccaacacaaatggtaaaaaatgataatggttagcttagattttaatcgatttgtgttacttgtgctaataccaaagaacttgatttgaaagtgttttattagatcaatcagaatatagtggagtcacccagctggctgcaaacttatccagtcaaaatatcttccagaacttcaagtttcaaaatagataaacttcctaaatcaggtctttgggctgcctgcaagagtctgccatattttaggctcctctagttttctgagaattaacccttcctttggcatataccgtctacattttcttctttctgactccggcactgtagttaatcacacaaaggtgaggctcttaacactaaatctgtatatttgtttacattatgagaaacagagaaaagactttatacaaaaatggtggcaactatgattgattctggcttagagggttaaggataattcatattcttctttattctcttccctgttttccaataaacaagtaacattttacaaataaatacagtttttaaaaacttcttaaactagtacctaatatcctatgtacccaaaaggaataagaactaaaaaagagacttgaaaattaaaagacagacactaaacttctttcatatgattgaagaaatttttggaatttaagatattcttttatggctcaccacagaaactacttctaatttttaattttttagggaaaaatttattattcttaaaagttgtttatctaaccctaaaattctgatccaaatttattattaaaaatcaaactggtccacatttaagtcacctttgcctgacttacagccacagcaatgcattaagggaacaaaattctcggtattttggtaatttcacaggaccacggcagtagactcagagtagatgcttgacaaataataaaatacaagccttaaatatgagatggcactcttgcatattactgattatattattaatgctaacatcactaggatcctagtgtaatgctaggatcattgccaagtttaagtacactgtgtttaaatatgatgcatgcacttgaagcagtagaacctcaattcaacaaaaagcactgaggcagcatacttgtcaacatccgggagatgtaggagctttgcctggactccggctctcccagacgtgggtcactacaacattcagtacaggaatgaacaatgtatcgaactgttatcctgtaaggctgcttccctgaaggattgttcacagaggaaaattatgtcgcaatctgcatgctattttgaattttcataactgattcagcactccaattgctgataagtaccgtaatcagaaatctttttcctcccacagaacaagaacaattcaaacatcagaatttatccccacaatccagatctgaaaaatgaaaaagcaacaactagacctacatcttctttaaatctcaaagaaacatttgctctgtgcaagacagtgctattctaatgatagaggaaacttctgatgaataatgcagaagcacctgtggacatttaggcactagtggccatttaaatgctctttccctacgtgaacaagtgaccacaagaactcctttttttttttttttttgtcttgaagcacttgactcagaaacataaaaatagtcaagattggtttaactgaaatcacacttctgtgtgatctgtatgcatcctttcttttgttccagaaatgtgaggatccaaggttttaaacctaagccagtctggccagcttgactcatccaggacatctttcagtagtttcacagtggccatcagctctgtcagacaccggacatggcttgaaagggccatgtcagcaagtgatcattattgtgtctgaaaagagctgtgcttgatggctgaaatattacaactaccaaaaagctacaagtggaaactccatagaatcagctcatttgtagtcacagaatactctattcctacccactttcacacacgctactccctatatctccatatcaagaaaaaagtcctgtcttctttaagtcaattaccatgctttaatccagaatttggaattattcagggaaaccaaatcaagtatctattaccttctagagccatcatcatatccatgaacaaatcagctgtaaagcggtttatctttggggattaaatactttccagtccaaaatgcagtttttaaaatgcaatttttgccttctcttctgtattgagatgactaggcctatgtcaatttaactgtgtctctataaagtcatgcaaatgtaggcactttaaaatgactgctcacaaaaaaattgttaagagctctgcttaaaaatcttgcaaataaaaaaaacagttcctcatacaatttttctaaatggtggtgagggagtgttcttaaagttatatcctgatttatggaaatcttttattagtaaactaaagaggatggtctgcacatgatctgtaatattattattatgaatgctcatggcaattacattagagaagtaatcctcatttgaatttctgatattaataaaaagctcatttccaacttgccaaattcccaggctatgctgatctccaaagcctatcccacttagacacacacacacacatcaaaattcttttctgaaaaagaaaaatcactttccctcctactactaacattgccaatgaggtcagtggttgaccataacgtatttccagatttttcccttccctgagtgtgaagaactcaagtttttctctttttaccatgataaatcctattgcaggggctggaggtgagacagtcaggagacgttttagatcatgaggagggtcaccctggaggggagaaagggggctacagctcccattgctgagggcaccaagacctacctacttgttagatccccaccttctcaaatgtatcatagtccaagcatggagatgctctaagaggctatgcagtttcgaggtcataatcttattttgattattgtatatctgcttctgcactggtaatatgctccttgaaacagtttagttttcttcaaaaaaaaaaaaacctactctttcctgtttccttcactgtttctttcagcacttattatataacatcacacacacacacacacacacacacacacacacacaaacataaacacacctacttgcattattatttccgtctctcctgctggaatgtaagttccatgagggtaagaatttttatatgcttttattactgctatatctcccatacctgccagtgtttggcaagaggtaaatgctaagtagttgatgaataaatcaaaagataaattatagcagaaactccatggtgggccaggtgcgctggcccacgcctataatgccaacactttgggaggttgagagggggcagatcacttgaggccgggagttcgagatcagcctggccaacatggccaaccccatctctactaaactacaaaaattagccgggtatggtggtgcatgcctgtaatcccagctactcaggaggctgaggcacgagaaccacttgaagccagtaggcagagtttgcaatgagccgcaccactgcactcctccctcagcaacagagcgagactctgtctcaaaaaacaaacaaacaaaacaactccatggtgaagcattcctgactccatctttttttttaacttaaaggtattataggctgcaatccacgtctcctctaaattcctttgagttgttctaacagcatcaataactaagcctaaagcagactccctactgcttaccatccacgggtgccaagaaaacttgcatttcaatatcaagttaatttaactgtgaaaataatttcatgtatccttccaaaataatcaccctaatttcttcaagtcaaaacaactcagaaaataagatgtttgtgaccaaaagagggctgtaagagcctggccttcacagcccctccaaccaagaaacagcagcagcgtgttgctctgttacacctgtgcccttagaaaaggttcagactgtgcttaactgcgctgcctactggtaaccatcaaatgaggaataagcattgcgcaaggtagttttgggggaaaagcctcttttcccccaaatcaatagcattacccttcccattttcccagaggcctcactgtggtgagtgggactgaaaccatggggcttcaggtcaccatgaccaacagagggcaatggagctggttgctgagcacttacaggacagtggggactaaatgaagactgaaggatccacccataagggggccagaggttccctcactgtctagaacaactggctgaagcctggctctgggctccagaggctggagaaaactgcttctctcagaactgctgcttaagtaagcagggcccaggaggcatgagaaagtaaacccagcccctctaccaaaagccaaaccaagcctcatgccagaaagctcacagaaagaaagggagaactgcgggcagagaaaggtgttcagggaccagctatgttcttaaagttgtatttctttaaatgacagagtggaggactggatacctgggtgattcctatactattctttgacttggctatacagttgaaatgttccatatggcaagagtggttcatgggtaaaagcgtgaactatgaaggctgtgggtcttggaaaagatagttaacttccctggactggactcacttccttcatctgtaactgggcatgataatgttgtctgtttgatgggactgtggtgaggattcaatgaattaatgtaagaaaagtgctgaggacaatctctaacacataataatggcagactcaacgtgtcattcatttcttaattaaaaaaaaaaaaactaaaatctctcagctctattgccagctacactcactcatatgacctcattcagcccccatctctttttcctttccatctacttgtcacaaactccagcacccaaaatgcctagtcatagttctttttatactcataggtacttctcaagccctgcagcttgcatctcctccatctggacatttcagtaaactttcaaggctgaaagcagagcactgaggaattaaaaaagactgtgcaacccctcagccacagcctccaatggttactgatgatccataacctacagcctgctctgagaggactatgcacattgtgcacttgcctcaagactcaaaacaagattcagacttgatttaacctaccccttctgaaggttagaaatatcccatatctcaaaacaaaggcagtctttacagctgcagtacaccttatttttgtgacatatgcttcttcttaaacatttggctcactgagcaaatcctacagagatcagttcattccttctagtagtctttttgcttgcaagtctaagagctgccacctgatgaaaagccatgccttgcggtagagcattgcatgggaaattgattcttaaacatctaattaattactgattttccttaaaaattgaactccttattaaaatatcatatatgctttgaatgattgcaaattactgtttagatacttttggctgcaaataagagaacgacaaattgcttaaaagataaagaatttttaaatcccatataagaaatttggaaggcagtaaaattagtttatttagcaattgaataattcattgaaaatccaagtttcttccatgtttctactctaatcatcataaacgcataggttgacagatggctgtagcagctccaggcatcatagcctcaaatcatttcatcgtatcttttttaagaggaaagaaaactttttcaaaagtgccccaacttccccaacttccctcacatctcactggccagcattgtgtcacttgttcctacctactccaatcattcagcaggaaactggaataaccaatgtgatcaagattcacccaggactaggcagataacctagacttccctggaataggattaacctgttgaggcgctgttttaaaaaaagggaaaatgtagtcaatgttttgttgttgttgctgttgttgttgtttttattgttgctattagggaaaaaagtgaatatagcaaatttaaatcaagatatcattttgggaaattttttaaggggaagcttctaggtgctatttaactttttcaactacaactaagtagttagattttgtaggccaggcgcggtggctctcgcctgtaatcccagcactttgggaggctgaggcgggtggattacctgaggtcaagagttcaagaccagctggctaacatggagaaaccccgtttctactaaaaatacaaaaaaatagctgggtgtggtggctcacacctgtaatcccagctactcaggaggctgaggcaggagaatcacttgaacccggagtggaggttgcagtgaaccgagatcacgccattgcaccccagcttgggcaacaagagtgaaactccatctcaaaaaaaaaaaaattagattttgtgtctcagcgtgattccatgccaatctgcaaactatttgtgatgagtacaaaatgagataagtatgcttatctcacataagtgtagatatattgaaaaaaattagaaaacttttataacaattagatagtctaattttatatttgttaaatctaataaaactttggagcttatattttttatgtctcggttttttacttttagtaattgatttttactgtagtccacaaaattatcagtctgtaatggactggaaattggaacaacaacaaaacagtcattcactagagatagatcaccctatccaacttctctaatttttgtgtaaattatatacttttagaacagcttaaagctcagcagcttttccccccaaactgattggaccgtaagcctttgacagctaaagatacagtctgaacattgtaaactatacctggatgcagaaattatattaaaaaataaaactgactaggataaattaatgagccctcagtcagaggtccatttccctgtggactactcagtgccagaagaggctaaacccttaactttggccagcccctgggcacaacatcaagtaaaaaggaattcgaaagttctatatgactttggccaggccagcattattagaaaaacatggtaggtcctgtcctaataaaagatgagaaaagtcctaaggatgagcaaaataaaatgccatgtagataaggatccatatctgtagataaggaatcgattcaaagttcatattattttttcctcgaagtgggaaaatattacctacattcaattagcacttttgcccttttgctatggaaaatgcgttttgtgagtagtcccttatcatttttatttcctcagacagcaaattaattcttatacttctctacagaggacaggacaaacttgtagttaatattgaagattaggaaatgaccttagccacaattatcatacatcaataacactttcccaaaacccaagaaagaacctctcacctactttagtatgtttactcagtggatttaaagtaacctttcaaatcaccaactgcaaagacaacattccacctcaaaatgtattcaaagtgggctcttgaattgcgcttttatggaattaacctaccatcttcttatgaaaaagtcacctgacatccctgggtgcactagccagtgcacaaaggaagcaaggggttcaacagttaggaagacagtttgcacacgatctgcacatgtttaccgtcaaatcaaagcttgatgataaacatcactcagctttggcacatctactgatggcatttgttggtggattatgctttcttccccttatttatttcacaatggttatcatggcacagctttccaaatgatgtttttaagtgttcagttgtaagaatgcaagttcaagtatgctttcttcctcactacaagagaatatgatttcaaatattcaacaaattggtttacctaatggtctctttggaggggtctcccactattctactacccactatcaccccaataaatactctagtgatataaccccttcaacagttatcatcattgaactttaaaaacataacaccatatacctttaaccatgtacatgttccccaccagtttccacaaagagctaaatttaagcctgctataagagagaatcgaaatttggtttgctttcttttagactctgctacatagactttaaacatgcagaagagctgactttgccaacaaagctcatccttcttttttccaaagcagccagctgtgacttcattttggatttaggctatgatttttctgatttttctctttgcatgtgaatgtttatttgtgaagtcttgaacttcaagctacttccaactctagaaatgatttgggcaagctgccatgtttataatcttagagcctccagcttcccagataatacaaactctcttgttatttaattaatgtcaaactcataatgtcatgcaacattgctgttagatttctatttttctaacatgtctattctcctagttactcctaactagaatgagtaaaccttctgaataaatcagagacatctttacaggcaaatgattaaagggtttgactgcctgccataatattggaacaagatctgggggaaaatattaatgaataaaggattataaccctggacaagcaagcaaatgtagcttaaatatataacagtttcccccaaaaagtaaactggactttatactatatataattatattatattccatgcatctctatattacagcaccttaaacagtgtagataactagtaaatatcggttaaataaatgagtaaatgaaaaaaattgacaagatataccaccttgttggaaagataggttcttggctgccttaagcttcccataaataaaccaggggccaggggtggtgctcacaccggtaatgtcagcactttgggaggccaacgcgggaagatcacttgagcccaggagttcgagaccagcctgggaaaaatggtgaaaccttgtctccacaaaaaataaaaaatacttagcctggagtggtggtgcaagcctatggtcccagctgcagaggaggcttaggcaggaggatcacttgagcccaggaggttaaggctgcagtggggcacgttcatgtaactgcattccaggctgggctacagagcaaaaccctgtctcaaaaaataaataaataagcaatgtatatggcaatcacagtcctcggtaccaaagaccaaactccaagcctatatgaagacatctgatgttatagtcattggaaaatgaaaagggaaggagtgggctaaggggagcaacaaaaggttgactgtgttttcttctggcagtctgctttcacagccagtactatgcctgtggccatctcccaggctcaggagagcctatcttactctagcccatcagattcactttcccgggaactggaaatagaaccttgatatggtttgcatttgtgtccctgactaaatctcatgtcaaattataatccctagtgttggaggaggggcctggtgggaggtgactgagtcatgggggtggatatccccccctgctgttctcaggatagtgagtgagttctcacgagatctggttgtttaaatatgtgtggtacctccagcttctctttcttcctcctgctccagccatgtaagacatgcttccttcttctttgccttctgtcgtgattgtaagctttctgaggcctcctcagccatgctttctgtacagcctgcagaactgtgagtctttataaattacccattctcaggtactcctttatagcaatgtgagaacggacttatacaaacctctatctctgctgatcacttgtgggaaagacatctaaacaagtgagctacagggtggccatttccaaacatgccaaagcagagacagtccacagagaaagagaatgaggcagatggcagggagagccacggaggtcagagctgggcaggaaggcctgcctgtgctcccagttcacctcttgtgaaccctggtcatccttgaattccttgagatgactcaatatccaagatgtctgggtgataaaatggcagggtggaagaaaaactaaaatgagagtgagtgaatgtaataattgttcagacttcctttgagggctctgtgagccactgaacgttttaagcagagtgacccacgatgggatactcatctttacaatcagcaccctggctgaaagtagagaatgggttagaatggaggaagattgcaattaggaggcttttgtggtcctttaacagcctattgtcccagggaagtatctgttgctcatgtgtaatgctgcctactagcataatttaaatacataggctatttctcttcaaaagggcatattttatgtaacatctctaaccattacatgaaaactcattctttgtcaccagcatcagttaattattagattattggcccaaaacctccatgattatataatatatattaggactagaagttaagtcaccagagagtttccaatatttaatagtgccatatttcagaaatgcccagggagaatatcagtccactactccgctagcatggtatccaacatttcttccttaatgttgtagatcctttc

SEQ ID NO: 556 - DNA, 7795 bp, Homo sapiens
aaaaaaaaagaaagatgattaatatctgacagccacctcagaagcccccaatgtcagaaacacaggacactggaagggtgtctcattgacactggtaggtcaatgaaataagacacatatttcaatttcaatcactatagtctatacaattttaaacacataagtactgccatataactaactcggtcctcctagaagccattccagagtagaatttcacacttcctctaatgtgggaaaagacagaaatcctaacggaaaaagatggtaagtggctgggcgctgtggctcatgcctgtaaccccagccctttgggaggccaaggcgggtggttcacgaggtcaggagatcgagaccatcctggctaaaacggtgagaccccatctctactaaaaatacaaaaaattagccgggcgtggtggtgggcgcctgtagtcccagctactcaggaggctgaagcaggagaatggcatgaacccgggaggcagagcttgcagtgagccgagatcgtgccactgcactccagcctgggccacagagcgagactccgtctcaaaaaaaaaaaaaaaaaaaaaaaaaaaaaaaggaaaaagatgataagtttaactacttgcaaaaatatctatataaaccattcaaaacaataggctaggagaacatatctacaagaatatctaataaataaaggtttaatatcccattacataaagggttcctgcaagtcaataaaaaagacaatccaattaaaaaacagccaaaaggaaatgaaaagacaattcacagaagtaaccaataaacatgaggaagaaaatacccttactcatggttaaaaacttaaaagtcaaagtaaataatgtcacatgatatgcaaaatttttcatgttaaaaagccattgtggatgaagttaggaggctaataccaagattatgaattagcgacgttatttgaatcaacttggcaatatctatctaaatttaaaacaaacatgcattttgaccttgcaagcataataccaaggatttgtcctgcagagatactgacataatgaagcaaagatatccacacagttaattacagatacatagctgttcactgccaccctgtttgtaatggtttaaaaacaaattgaagtaggccaggtgtggtggctcatgcctgtaatcccagcactttgggaggccgaggcaggccgatcacgaggttaggagatcgagaccatcctggctaacatggtgaaaccccgtctctaccaaaaatacaaaaaaaaaattagcccggcgtggtggcgggtgcctgtagtaccaactacttgggaggctgaggtgggagaatggcatgaatccgggaggcagagcttgcagtgagccgagattgtgccactgcacttcagattggacgacagagcaagactccacctcaaaaaaaaaaaaacaaattgaaaaaaatctaaatgtccatggggctcaattaaataaatggtgggttaaccatatattatgatgtgattaaaaagaatatcataaatctaattttgccaaaaaaagttatcggagattttttttttttttttgagacagaatctcactccatcgcccaggctggagtgcagtggcacaatcttggctcactgcaacctccacctcctgagttcaagtgattctcttgcctcagcctccacagtagctgggattacaggcacccaccaccacgcctggctaattttgtaattttagcagaggcagggtttcgccatgttggccaggttgatctcgaactcctgacctcaagtgatccacccccttcgggctcccaaaatgctgggattacaggtgtgagccaccactcccgggcttaagacacatttttatgtgaacaaaaaagttacaaaactacagatagaacatgattctatttgagttatttcatgtatatacataaatatacactatataaaaaggggttcagggatacaccaccccaaagtatggcacattgacctttgaggaaatatcagaagcaggaatgactctctgacctctcccacccttctcccctgaagcaggtcataaaagaattacctgaccttcctgtaacataggatgtaagactttcattccaaaagtgccttccctatgcccaggaaaaaaaaaaaaaaaaaaaaatccttatcctcgaagacacagagacaccaagaggaatctgagcaaacaagccttgctaagttcccctcagcttaccaatatttgatcatatccttttgccatcccatcattcttctgcccaactgtacataaaaatacacaggtttccccatgctttggatcttcacctctctttttttttttttttttgagttgggggaggggcttcttcattcttaaggctcctgtgtcacataaaacttacattaaataaatttgtatgcttttctcttgttaatttgtattttgttataggagtctcagctatgaacttagtggtgggtaaggaaagatatcttttctcttctacaataggcttggaaatttctagaatttgtggaaaggaaatggtatttaaagagaaagggatgagagtaaatcccaccttaaaaccttgttgaggcgttttcttgtctttgccatgagcaaatattgttttgaaagttttaaaacatatatatgggagatgttatattcactttaaaattccatataatttgcaagagctatcaaaataaaataattgtcattgcaactctgccaactgcaagcccaataaagcaaaagaacactgaacaacctggatttaaatcctggagtcacttctcagtcacattaccttcttttctacttacttagttaactctgagccagtttcttcacattttaagagaatcgtggtgaagattaaatgaaataacatgtaaagagtgtcttgctcaattttgcatacacattaggctttcaacaaatactagtttctttccattttttctgaatgacatcagagctcagaaaatgcagcggctcaaagtagtggcagattctcagttatctgaaattctacagcaggacaataaaactgcttccaaatgttgaaggaatttgcgtttctacaccatcctaagcaatgtggcctaatcccatggcattaattccaatccacacacagataactccaaatgtaaatctcaagccccatcctttgccttcagttccagacttgctcgtataactgctgaagatgacaagcattaataagatcttaaacatcacataaatcttaaacctgcttttcttcagcctctccatctcagtaaatggttccagcatcccctaattatttaaaatccaaaccaaagattcatgattgtttcctttctccatccttcacagtcttgactctccatttgcaataacccacatctgccatttgtctccatcaatctggtgaccccctttctcaatgtcacagccaatatggtatttttaaatggtcaagtagacgtctcaaatactccagcaacctcccactgggagcgtaattaatcccaaactcctcgccaggggcctgcatggtctctttccagcctctccctcctgcccttctttccaaagatcactagactctgcacagttccccagcacactttgcactcgctgtactcgctgtttcttttccctgaaatacttgcttctcagctatgtgtatgccttactccttttttatattcaggtgaagattaagtaatttaaagggacaagtcctgtccacccaatctaaagcagcctcctagttaactactattaacagtcattttcttcatttcctgtcactgttcactaaaatgtaagctccgtaaggacagaaatgttttatcatcccatgattttctgtgcctagacgaatgcctgccacacagcagtaactacatacatttttgttcactggactaatgaattggtggttcaacaaacagatctaaaggagatccccaactcttgttggttgccttttaaaaaattaaagagtattttaagaataaaagcagagactgatttgtggttatctcagagccagtgaattttagcatttaaagctaagatctgatgaagagccaacacaaatggtaaaaaatgataatggttagcttagattttaatcgatttgtgttacttgtgctaataccaaagaacttgatttgaaagtgttttattagatcaatcagaatatagtggagtcacccagctggctgcaaacttatccagtcaaaatatcttccagaacttcaagtttcaaaatagataaacttcctaaatcaggtctttgggctgcctgcaagagtctgccatattttaggctcctctagttttctgagaattaacccttcctttggcatataccgtctacattttcttctttctgactccggcactgtagttaatcacacaaaggtgaggctcttaacactaaatctgtatatttgtttacattatgagaaacagagaaaagactttatacaaaaatggtggcaactatgattgattctggcttagagggttaaggataattcatattcttctttattctcttccctgttttccaataaacaagtaacattttacaaataaatacagtttttaaaaacttcttaaactagtacctaatatcctatgtacccaaaaggaataagaactaaaaaagagacttgaaaattaaaagacagacactaaacttctttcatatgattgaagaaatttttggaatttaagatattcttttatggctcaccacagaaactacttctaatttttaattttttagggaaaaatttattattcttaaaagttgtttatctaaccctaaaattctgatccaaatttattattaaaaatcaaactggtccacatttaagtcacctttgcctgacttacagccacagcaatgcattaagggaacaaaattctcggtattttggtaatttcacaggaccacggcagtagactcagagtagatgcttgacaaataataaaatacaagccttaaatatgagatggcactcttgcatattactgattatattattaatgctaacatcactaggatcctagtgtaatgctaggatcattgccaagtttaagtacactgtgtttaaatatgatgcatgcacttgaagcagtagaacctcaattcaacaaaaagcactgaggcagcatacttgtcaacatccgggagatgtaggagctttgcctggactccggctctcccagacgtgggtcactacaacattcagtacaggaatgaacaatgtatcgaactgttatcctgtaaggctgcttccctgaaggattgttcacagaggaaaattatgtcgcaatctgcatgctattttgaattttcataactgattcagcactccaattgctgataagtaccgtaatcagaaatctttttcctcccacagaacaagaacaattcaaacatcagaatttatccccacaatccagatctgaaaaatgaaaaagcaacaactagacctacatcttctttaaatctcaaagaaacatttgctctgtgcaagacagtgctattctaatgatagaggaaacttctgatgaataatgcagaagcacctgtggacatttaggcactagtggccatttaaatgctctttccctacgtgaacaagtgaccacaagaactcctttttttttttttttttgtcttgaagcacttgactcagaaacataaaaatagtcaagattggtttaactgaaatcacacttctgtgtgatctgtatgcatcctttcttttgttccagaaatgtgaggatccaaggttttaaacctaagccagtctggccagcttgactcatccaggacatctttcagtagtttcacagtggccatcagctctgtcagacaccggacatggcttgaaagggccatgtcagcaagtgatcattattgtgtctgaaaagagctgtgcttgatggctgaaatattacaactaccaaaaagctacaagtggaaactccatagaatcagctcatttgtagtcacagaatactctattcctacccactttcacacacgctactccctatatctccatatcaagaaaaaagtcctgtcttctttaagtcaattaccatgctttaatccagaatttggaattattcagggaaaccaaatcaagtatctattaccttctagagccatcatcatatccatgaacaaatcagctgtaaagcggtttatctttggggattaaatactttccagtccaaaatgcagtttttaaaatgcaatttttgccttctcttctgtattgagatgactaggcctatgtcaatttaactgtgtctctataaagtcatgcaaatgtaggcactttaaaatgactgctcacaaaaaaattgttaagagctctgcttaaaaatcttgcaaataaaaaaaacagttcctcatacaatttttctaaatggtggtgagggagtgttcttaaagttatatcctgatttatggaaatcttttattagtaaactaaagaggatggtctgcacatgatctgtaatattattattatgaatgctcatggcaattacattagagaagtaatcctcatttgaatttctgatattaataaaaagctcatttccaacttgccaaattcccaggctatgctgatctccaaagcctatcccacttagacacacacacacacatcaaaattcttttctgaaaaagaaaaatcactttccctcctactactaacattgccaatgaggtcagtggttgaccataacgtatttccagatttttcccttccctgagtgtgaagaactcaagtttttctctttttaccatgataaatcctattgcaggggctggaggtgagacagtcaggagacgttttagatcatgaggagggtcaccctggaggggagaaagggggctacagctcccattgctgagggcaccaagacctacctacttgttagatccccaccttctcaaatgtatcatagtccaagcatggagatgctctaagaggctatgcagtttcgaggtcataatcttattttgattattgtatatctgcttctgcactggtaatatgctccttgaaacagtttagttttcttcaaaaaaaaaaaaacctactctttcctgtttccttcactgtttctttcagcacttattatataacatcacacacacacacacacacacacacacacacacacaaacataaacacacctacttgcattattatttccgtctctcctgctggaatgtaagttccatgagggtaagaatttttatatgcttttattactgctatatctcccatacctgccagtgtttggcaagaggtaaatgctaagtagttgatgaataaatcaaaagataaattatagcagaaactccatggtgggccaggtgcgctggcccacgcctataatgccaacactttgggaggttgagagggggcagatcacttgaggccgggagttcgagatcagcctggccaacatggccaaccccatctctactaaactacaaaaattagccgggtatggtggtgcatgcctgtaatcccagctactcaggaggctgaggcacgagaaccacttgaagccagtaggcagagtttgcaatgagccgcaccactgcactcctccctcagcaacagagcgagactctgtctcaaaaaacaaacaaacaaaacaactccatggtgaagcattcctgactccatctttttttttaacttaaaggtattataggctgcaatccacgtctcc

SEQ ID NO: 557 - DNA, 3535 bp, Homo sapiens
ttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataata

SEQ ID NO: 558 - DNA, 17765 bp, Homo sapiens
ttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaacaaaaaaaaaccaaatttaccagattgccagtaatttgcattaaggaggaagagatggatttttttttaagtcagcaggcattgaagatagttcagtgaagttaagtaatagagatctcagattttaatttagtcaagattatgattttacatagaagcactgttgaaataggcttgataataatattttaagtgttatacaaatctggatgaaattatattatttactgtcttactcattggttcaactgtgttttaaaagtgagagaccttatatcaatgagtgtttgttctgtgcatctcatgtgcatggtgttaacaaaataaaataagcatacttctaacatttgggggagcatcctattagtttgggggtaggttagggactctgctttccaaataattaatttgatagatccatgctcttgaaaaattgggtacatactatttttaaactttatttttcaaacatgatatgtattgtttaaagcattagcttaaatgaaaaataatattttacattcgtaaagttctgtttatttaattcagtaatgaaattaatttggagttgttggcatactgccttcacaggtttctgtgactcatttgctgagaaagtgtgattcaagagaccagaatcatttttttctcatttgctaaaactcatgttttgactatgggcaaatgttcatggcagatttaaaacaaatttaaagtaaatattctgtgataatatttggaagctgagtgatgtctagccttacataactaggacaaatataaatctgtgagttcacggacttcaaaagtatcaactatacatcattttagaatactggttttgtttttctcatattcttagagtttaactcttatactactaattatgacctctagaaggtaattgcatttagaagcagaatatctgctgttttattaatttaataattaaggactaaatggtgttccaatttaggtttaaaagtaagcacattcacacagcatttaaaactatttcttaatgtttttttcctagagaagaaatgatagctccatgatcgctatatgttctgttcaatactcattatatttataatttatattacatatatatttatccattatatttataatttagtcctgtccaaataaaatatattctcatagttaagtgtgttgtggtagtataatgattacatgaaataacctggaccttgctgtttgcaaagtaatttaaatgtttattttctgagttgctacttggaaattaagttgtggagtgatgtttctcattggtccaaggagcaacataaaatcctgatttatcagataatcctacaggaaacgtatgcctgttttgacttatgatatgtttcttagtacaatgtcctgcttttctggctttccattaaatgtttagaaaaattagttaatagttttgcaggaaaagaaaggaaatttatcagtctataccagctatataagaagtaggaacatatataaaagacctataattttccgatctcactttgaacttttcttcacagttttccaactcaagatggtatatagtcttgcacaatgggctgtagccaactttccgtcagaagaactgagtaaaaattattccaaaattgttcttagaaataaatctgagcctggaattgtcttgcattaaaaaacaaaaagcaaatgattgctttaaaagcacaccaaatgatattggatggtctttattcttgactctgttttttaaagtgtgtatacgttcattacatccagttgtctattgggcttttttactctaacttttcggaagttgactgacaggccacttttctatagtgggaaataggcaccttgtgtgcgcggagggatttccagcccccgaccccggaaccagcaattagcgtttaggcgtcctgcaccccaccagggggcagcaccggacactgcctttcctagaggcctgagtgcatttaaggctttctggcagtgctctccacccctcttcctcatacaggccttacgtatttttggtattttcttacacattttaggcttagtaagtgtttaataaatgttagctgtttaggcattgtgctatacggatgctacttttcaggtttgaccgttctgtgtacctgaattttgtctttaatgataatttgttctattatttaaaataccttgtgcttattataaatatgggattcctttaacttgtaaaatctagcaattattgagcactatgacatgtcaggcatgaaaccaggtactttttatatgctactgcagaatctaagtagacatagaggcaagataacaatagagtcataaaacaatatgaaactgcaataatggggaattgtaatacttctattttgatgttgaataaacagtataaacctcggggaggttaagtcacaatggaacaaagatcccttcagatagaattccaaattccgtgctgtatcaattatattatgaaaccttgccataaaaaaaaaaattgttgaggatgagcgaagccacgatgtgtaatgcctgagacagaggtttcagtgatgtaactccagtgacactgtgacaaggagaattagggattgacatacttaaaacttgaatggagaaatagggttagatattgagagatcccaaggaaacctgtgaaaaccttaatatatgtgtttttatggacacataatatgtaacatattacattcatcaaaacatgggaataaattgacgtactcttaatttttaaaagccccataaatatattttacttaaaaccgtaatggatcttattcttttaatttgtgcttgtcctctcttacctgctagaaaatttaaaggttgtctgtccttcctaattttaacaagatacttcattttccaaaaatgaaacaagacaaaaaggtaaatttgttttgttttgttacagaaaatagtcaaatgaagatattttgcctgtgtctgtgactttaatgatttggaattgttatttcacattgtttgctttcttttctggctataatgtgcatagcaatccagatggctaatatataaacaattggagttatgcttattggaatcatttagtgtggcttaggaggttcccactacccaggaccatctgttcattgctctgtgtattaccttcatgatcaagtttgtgttttcagctccttcacatatcttagcctacacctttctttatatgtgaaagaggcttctaagactgaacttaactcatatggccctcaaggctatattgtcaaaccttgataatccaagcctgccttccacattaccattcttctttattcctaattcaattttttcccttatcattgctattctcaatagtagggtcttaaaatttgcagaagagtgactaagaaaatgggctttgtagtcaggttcgaatcttacttggctgtgtatgtagcgatttgatcttgggcaacctcctttatcttggtttcctcacctgtgaaatggagtataatactgacttcatggatttgttaagatggttaaattagataaaatataactcatttagcccatgcctggtttattattaacataatttagaatgaaaattctcctgttgcaaaaaggcatattcagaagtaaattcaaatactatattctaaaatttcacagcgtcttttggaagaaatagctacttttctttaagcacctgtcatatgtgctttcacattgccaacagaatatatgtaggcggtactaaattgttgttttggggttcattttcagtccttcttactggatcctgggtgcaactttagaccccaagtagctagagaaaagtttctctaggtgcctgtcgtctctggttacatgttacactataatctgctttggagcctcacagccacatatgttattgttccacgtgaactgagccagcttacatacacagctctgtggggagaaagaccataaacgaacactccccgtttctagcccatattctgcataatacatgtaagtctctcaacagccctgtaggctatgccattacttaattcccaatttatgtggcttactttttctgaatgaaaagtcatcaaatatggtttttaagttatggaacagaagaatatgattaatctgaattgtcatgaaaattcagggcacatggttgctatggttatggcgtcatgtatttataatggagagatactttgtcttcattaatctacaaacttgccagtgggattcggtattttttttctgtgtgtgtgtgtgtgtttgtgtgtgtgtgtacatacgtacgtacgtacatgtatacagcttctgcatgaaaacactgaggctgaacaaggtgttctgttttggtggtagtgcagagaaacatactcacacataaattatttatatgtgaaccaattcagtgagaagtaagtacagctgcttaattgacctaagggtcttatttccaactgcttaaaaataagtgtaaagtgaagttcatggaagaaataacttaaggctctttaatatacttttgttggtgaagagaatttcaagctgtttcagtcagttagcatatattcttaaaaagactgatatcctattcgtagtcttctcttatatatccttgaattatcttccatgatttttatattttatatacttataatagcgtattataacaacttaatgctacataatttacagtaatcgtttccaaattaaggaagccctatgtgtaaaatcacaaatttatgtaacataacacaggaacttttattcatataagaaaatcattattcactttactgttttcctttatttcagcatcatttattacaaaattaatactgttttcgaaaaaccaaaacaatatattataaagcacaacgtggagtcttctctcacctccttgtcattcccagcctcaaagggtaaccactgtttacagttcaagtgtgtcttcacagcagatgtttttctatgctcgtgcagacatatagatgtattcctggaaagagtgatgcttgcattcttgaggagttaggagcattgctatttgaaaaaataaaaatccagtttgatgatgttagtcattatgctgaaaggagtgattttaacaaataccaacagaacttcttgtggtaggccagctttccaagttactggttcaagagaacagtcattttataacaggtataaaatcaaagacgtttagtaaaatattttgcccttaattctccatggatagcttgtttatgaagagttcagtattcagggaagatggaaaaacagcccagtgtcagctaaagtaataaaaccgacttaatcccaaattgacaatttaaagccctttaaaattacttgttgcaaacaagaaataatccacccagtctgtcatctcttttcagcttattagtagtggaatctcttaggtggctctttaaaccgtgtgtattaaaagtcctaaagttgttcgtggagatttccagttgctagggaataccaacacttatttggtgtttgatattgtaaatcatgatagttattggggccaaagggaggtctgtaaatgtccagtaggttctctttggagctaatttgtgctgtttgcattttctttctgccccaatacacttgtcactggaagaaatcacacagggggtagggataaagcatgaggtatcatgattccttcatgtaaaaattttgctcaaattaaaatgtgaacatagtataatatgtaaaaaaaactggacctccttaaatcctttataaagcaaggcaatgtgtaaacacatgaataaatatgaaggttttattttaagtaatagctgtgaatgttaaaagtaatattattttccttagaatagtttaatcacatatcccttttaaattttttaagcctttaaacgttttattttcagtctgggcttggggactcacacctgtaatcctagcagtttgggaggctgaggctaggggatcacttgagcccaggagtttgagaccagcctgggcaacataagaagacctcatttctgaaaaaaaaaaaaaaaaaaaaaaagaaagggaagaaaggggaaggaagggaaggaaagggaagaaaaaaacgaaaagaaaaggaacaaaggaaggcgtcggtgatgtgcacaagtggtcacagctacttggtagtctgaggtgggattgcttgagtctggaagatcgaggttgcagtgagccgtgtttgcaccactgcacttcagcctgggcgagagagtgagaccctatttcaaaataaattcaaatttgaatattttacttgagtaacattttttttctcctgaaaataattttctacagtgttctactgtggttgaggttttcatgtttaaatcagatctctagcctcatgggactcatagtctctcatggaagacagataattgggcaactacaatggattatgccgagttcggtgctttgggagctcagagcacaagccccttcctcatctgccctgtagggctggggaggtgctgtcaaggaaggcttcccagcgggagtgattcctcaggtaataacctgagatttgtacacacatcagtcaggcaaagagctgtggacttggggtgtgagtggccagagacccagcattatctgcaaaagctagactatgagagagatgagaacacagttaagtaactgatagaagttcagtctggctggggcatggaggaattacaaacatttattatgaaagtaatacatgtgcattgtataaaatgtgagaaaaacagaaaatgagaaggtatatattattgccagtttcatgctgcagagttaactactgtgaacatttgttgcatttttataattctttccatttatattcgtagaacagcgtatttgatattatcccagtttggcttagacaatagatatatatacaggtataaaatgcatatgcatacatgaaaacacataataaaactgggatcatgcgaacatgctgttacctgcttttttcatattacagtatacttaaatatttttaatgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtctttgggttgtatgtgttctttttttttcctttagtaaaaagtttttgtttcagagtaatagcttgtgaattggttaattaaatctgaattaaagtacagtattcactatagaaatggtgacttctcaactttattgtatttggttcagttctttatgaccaggatggttatatgttgacagaacttctagaatgtttcccctcattcttccctcttgcctgaacaaggtgtcgtaatgaatgtactcacctccccagtgtgtggtgggtggtgaggcagaatttttcctactgcctctcttccgtgagatggacagcctaagcctgtccattacaaaactgccaagttttagctgtagctgtagtgtttgtcgtgatgttgcaaagcaatttttgcccatgttctttatattattacttggataaaaagaaaaaacaacagtagcaacaacagatgactctgacaggaggaaacctccttattggggacattgtccagtcctcttgtttcttactctgcctcttctgcccttcaccacattttagacaagccttagcctttctaaataacgaatcctccagcagaacccctcatccctgacacacctcccctcccatagttccagaagatttcctctcatgggttctaggaaaaaggtctctacccccataaagcaaagaatgagggttgtcatgttttcctttctctagaaacactggaaaaaagcaaaaagaaaaaaaaaaagaacacttttctataactacaattgtatgtgtccctttaaaactgtaatttcacaagttgtgtcctatctatttttaccagcaatttgaaggaggatacagaaggtcacttctgtagattaccagaaacttggaggcaaagtaaaggcacttgatcacagagtctgaatagctatgatctgaaataatgaacccaatcatttgtaaaaataaaaccctgtccttggattaaaaatagaaaaacttgtacagcataggaagggaaaagatgtagtttgtcagcaacaagtttggaaaagatttagggagttcagttggcttaccatacagaacattctgagtttaagatgccaaaactcagtatggactttggctttggtctttgttctccactaatggctcaaagcatcctacagggaactctgcactgacatggtcagtccagcagaacaggacatgtgcggtggtctgccaccttggcctacagtgggttgtagttaaacatactgattttagtggaattaatttgttatggctgttgtatctttctaatgctatattttctattcatttggtattttaaggattttctcttagctattttaattttactgtctttaactctatttttgaaatagcaagtgtgagaataactctgaggatgatctatgtactaaatgcctgtatttgaaagcctcttttcacctctagttagccctgcagtccccacaagtaaacactcccttttcttccaataaacctttacagttaacactaaactcaatctatggcataagacatacatacacatttaatttattgccaaaatacatttttgcatgaaagaaagagtccatattatgaaaataagaaaatagtggcaagaaggcacttgagagattttaaatgaatgccaggtccaaaatcctccactgctcccagcctcacataataatgtctgcttcttgtgacaacatggatctataaactaatttaatttctgtggtttaatgtgtctgattctttcaggaaaaaatataataactgcattctatgcaactaatggaatagctaactaaaagacctgtgtacattttaaaaaaaaatgaataagattcagaacttctagaatgttttccctcattcttccctcttgcctgaacaaggtgttatatagctaactaaaagttctgtgtatatttaaaaaaaaatgaggaacaagattcagaaaattatctcaattccttaggtttaaatctcatcatctaaaaattcttggtcaaaatgtttagaagacccacttagaaggtccacatttggtttcatgtaatccctttctcatcagcttgcctagagtggatacatgtggtttctggctgcctagcatcccggcctccaacttctagaaacagcactgctgtttgtttagagaactccctctccccaccacatgtggttctggagaggctgccaatcccaacactgtgcagtgttagccacagagatggccctgatccagacccagccaggtacctca

SEQ ID NO: 559 - DNA, 9755 bp, Homo sapiens
ttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaacaaaaaaaaaccaaatttaccagattgccagtaatttgcattaaggaggaagagatggatttttttttaagtcagcaggcattgaagatagttcagtgaagttaagtaatagagatctcagattttaatttagtcaagattatgattttacatagaagcactgttgaaataggcttgataataatattttaagtgttatacaaatctggatgaaattatattatttactgtcttactcattggttcaactgtgttttaaaagtgagagaccttatatcaatgagtgtttgttctgtgcatctcatgtgcatggtgttaacaaaataaaataagcatacttctaacatttgggggagcatcctattagtttgggggtaggttagggactctgctttccaaataattaatttgatagatccatgctcttgaaaaattgggtacatactatttttaaactttatttttcaaacatgatatgtattgtttaaagcattagcttaaatgaaaaataatattttacattcgtaaagttctgtttatttaattcagtaatgaaattaatttggagttgttggcatactgccttcacaggtttctgtgactcatttgctgagaaagtgtgattcaagagaccagaatcatttttttctcatttgctaaaactcatgttttgactatgggcaaatgttcatggcagatttaaaacaaatttaaagtaaatattctgtgataatatttggaagctgagtgatgtctagccttacataactaggacaaatataaatctgtgagttcacggacttcaaaagtatcaactatacatcattttagaatactggttttgtttttctcatattcttagagtttaactcttatactactaattatgacctctagaaggtaattgcatttagaagcagaatatctgctgttttattaatttaataattaaggactaaatggtgttccaatttaggtttaaaagtaagcacattcacacagcatttaaaactatttcttaatgtttttttcctagagaagaaatgatagctccatgatcgctatatgttctgttcaatactcattatatttataatttatattacatatatatttatccattatatttataatttagtcctgtccaaataaaatatattctcatagttaagtgtgttgtggtagtataatgattacatgaaataacctggaccttgctgtttgcaaagtaatttaaatgtttattttctgagttgctacttggaaattaagttgtggagtgatgtttctcattggtccaaggagcaacataaaatcctgatttatcagataatcctacaggaaacgtatgcctgttttgacttatgatatgtttcttagtacaatgtcctgcttttctggctttccattaaatgtttagaaaaattagttaatagttttgcaggaaaagaaaggaaatttatcagtctataccagctatataagaagtaggaacatatataaaagacctataattttccgatctcactttgaacttttcttcacagttttccaactcaagatggtatatagtcttgcacaatgggctgtagccaactttccgtcagaagaactgagtaaaaattattccaaaattgttcttagaaataaatctgagcctggaattgtcttgcattaaaaaacaaaaagcaaatgattgctttaaaagcacaccaaatgatattggatggtctttattcttgactctgttttttaaagtgtgtatacgttcattacatccagttgtctattgggcttttttactctaacttttcggaagttgactgacaggccacttttctatagtgggaaataggcaccttgtgtgcgcggagggatttccagcccccgaccccggaaccagcaattagcgtttaggcgtcctgcaccccaccagggggcagcaccggacactgcctttcctagaggcctgagtgcatttaaggctttctggcagtgctctccacccctcttcctcatacaggccttacgtatttttggtattttcttacacattttaggcttagtaagtgtttaataaatgttagctgtttaggcattgtgctatacggatgctacttttcaggtttgaccgttctgtgtacctgaattttgtctttaatgataatttgttctattatttaaaataccttgtgcttattataaatatgggattcctttaacttgtaaaatctagcaattattgagcactatgacatgtcaggcatgaaaccaggtactttttatatgctactgcagaatctaagtagacatagaggcaagataacaatagagtcataaaacaatatgaaactgcaataatggggaattgtaatacttctattttgatgttgaataaacagtataaacctcggggaggttaagtcacaatggaacaaagatcccttcagatagaattccaaattccgtgctgtatcaattatattatgaaaccttgccataaaaaaaaaaattgttgaggatgagcgaagccacgatgtgtaatgcctgagacagaggtttcagtgatgtaactccagtgacactgtgacaaggagaattagggattgacatacttaaaacttgaatggagaaatagggttagatattgagagatcccaaggaaacctgtgaaaaccttaatatatgtgtttttatggacacataatatgtaacatattacattcatcaaaacatgggaataaattgacgtactcttaatttttaaaagccccataaatatattttacttaaaaccgtaatggatcttattcttttaatttgtgcttgtcctctcttacctgctagaaaatttaaaggttgtctgtccttcctaattttaacaagatacttcattttccaaaaatgaaacaagacaaaaaggtaaatttgttttgttttgttacagaaaatagtcaaatgaagatattttgcctgtgtctgtgactttaatgatttggaattgttatttcacattgtttgctttcttttctggctataatgtgcatagcaatccagatggctaatatataaacaattggagttatgcttattggaatcatttagtgtggcttaggaggttcccactacccaggaccatctgttcattgctctgtgtattaccttcatgatcaagtttgtgttttcagctccttcacatatcttagcctacacctttctttatatgtgaaagaggcttctaagactgaacttaactcatatggccctcaaggctatattgtcaaaccttgataatccaagcctgccttccacattaccattcttctttattcctaattcaattttttcccttatcattgctattctcaatagtagggtcttaaaatttgcagaagagtgactaagaaaatgggctttgtagtcaggttcgaatcttacttggctgtgtatgtagcgatttgatcttgggcaacctcctttatcttggtttcctcacctgtgaaatggagtataatactgacttcatggatttgttaagatggttaaattagataaaatataactcatttagcccatgcctggtttattattaacataatttagaatgaaaattctcctgttgcaaaaaggcatattcagaagtaaattcaaatactatattctaaaatttcacagcgtcttttggaagaaatagctacttttctttaagcacctgtcatatgtgctttcacattgccaacagaatatatgtaggcggtactaaattgttgttttggggttcattttcagtccttcttactggatcctgggtgcaactttagaccccaagtagctagagaaaagtttctctaggtgcctgtcgtctctggttacatgttacactataatctgctttggagcctcacagccacatatgttattgttccacgtgaactgagccagcttacatacacagctctgtggggagaaagaccataaacgaacactccccgtttctagcccatattctgcataatacatgtaagtctctcaacagc

SEQ ID NO: 560 - DNA, 5718 bp, Homo sapiens
ttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaa

SEQ ID NO: 561 - DNA, 296002 bp, Homo sapiens
agccaaatggatgtcaaattgtcaagttatacaagagggtatttcataaagtgtgtcagaaatatggtttaggcttaaggcaaaaatgatctgcctagtaccccacaaatatcacaactcccacaactgaattaaactggtcctctggaagctgaagaatttagggaggggacggctgattagcacatagacattggaagagcaacgggagtctagcacatctgagaataagttgtccagcaaagcagaagagagtcagggcccatgaatctctcagtgcagccctctccccacagcaacacactggataggatgctctcagcaatctcccagtggtcatcctcctccctcaggaaagaataagaacacagtgggaaaagagactagcagcttttccctggaaacacaaagaatgaggaataaaaaatgttctccataacaatcaggattattgaactgtacaaatagaaatatatttacttttagaatagaataattcttcaggacatgtctttaaaatcttattttagagggcatatataaaagaattagttcattcttatgtttacaatattcttcatcgcttagccaatgaatttctctgagaggcaatagtgttatgaaaacagcctaactttggggggccagttataatcttgacccctccacctactagctgtgtaggtaagttacttaacagctttcagcttcaatttcctggctataagagaggagcaatggtactggatgaatgagatgcatatggaaggtaaatattatagtgtccccctcataaactgcaccaacaaaggttagtttctccttaatacaagaggctcagttgtgatgtggaatgccagctttctgatatacttggaatagagctgttcttcctgaaacactggctctcatatatgacatgcagcttgcccaagttgaaaggggacattttactttccattcaaactccctcggcctcattttggggcagcttctgaaagcttgttgaccccaagtgccacacttctgataagaactgataagagaattcgatacaatgatgaaaaggatcatctcatgaaagaaacttttcttgtgatgtcttcagccctagctcaaagtcttgtggttgccagcagatcaaaaaaagcctggggttaaaataaaacctccatggaggtttgtttgtggaagctgacttgctggaagactacattactcaatgattttacagtctattcttattgatgatatttcaattatatgcagttgattacaaatttttctaacaccatagtactggttcagagctcttactaattatgagagatgctgtggaaaattatgataagggaatttcaaatgctttaattaaaattattcacagaattgacatttatgactaatttggttcttcttttatgctataagttaatccatattttgtgtcgtatatgaaaggaaattaggagaatatcaggagcaaactactaccagcagcaatagcagttgtctatttataaaatagtctctagtgttcaaagaaaaaaaatctatatagaaagatttattttaaaatggtctgaacatattactagatgagagtcaattgcttcatagcattctttggcattcttcagcattttcccacagcaatttatgcctttgtgtaatatgatataatagaaagaagtagactttgggagtttaaaagttcttggttttggccaggcgcggtggctcatgcctgtaatctcagaacttcgggaggccgaggcgggtggatcacgaggtcaagagattgagaccatcctggccaacatagtgaaatcccgtctctactaaaaacacaaaaattagctgggtgtggtggcacgcccctgtagtcccagctactcaggaggctgaggcaggagaatcgcttgaacccaggaggtggaggttgcagtgagccaagatcatgccactgcactccagcctggtgacagagtgagactccatctaaaaaacaaaacaaaacaaaacaaaacaaaaaacagttcttggttttatcttgggtcagctggttatttgatatcgagccaaaaaaccccagttttctcaaatgtaatatagggataactcataagattgttctacagatctaacaagtaaatcgtagaaaacatctagtgttgggactagtatctagcaggcactcgataaatggtaactattatttacatggatagctatcataattcttttgattctatttctgaaggagaatgctatatgaaatccgagtccaaaaaatatatatgctggagagagatattcatagctataaagtaaaacagaagaaaatggaatctcattttttaagctacctattatttttgcatgattattatgtggcagacaatatgctgagacatttacatgagttgtcttatataacactcacaataacttttttttttttttttgagatggagtttcactctgttgcccaggctggagtgcaatggtgcgatctcgactcacttcaaactccacctcccgagttcaaatgattctccttcctcagcctcctgagtaactggcattacaggcacccgccacctcatccagctgatttttgtatttttagtagagacagggtttcaccatgatgaccaggctggtctcgaactcctgacctcaggagatccacccacttcagcctcccaaagtgctgggattacaggcatgagccaccacgcctgacccacaataactttttttcttttttaaaagtgagatggaattcccacactataaatttaccagtttaaatagtacaattcagtgggttttagtatattcacaagatggtgcaaccatcatcaatatctaatcccagaacatttccttaccacagaaactctacacccattagcagtcattgtcccactccacagctcctggaaaccactgtcttagtccattagtgctgctataacaaataccagaagactggatatttataaataatagaaattttatttcttacaattctggaggctgggaagttcaagatcaaggtactagctttagatgtctggtgagggcctttttgctacatcctcacatggcagaagggaggtacgaacaaaaaagggactaagaggtcaggcgcagtggctcacacctgtaatcccagtacgttgggaggctgaggtgggcagatcacttgaggtcaggagttcaagaccagcctggccaacatggtgaaaccctgtctctactaaaaatacaaaaattagctgggcatggtggcaggcatctggaatcccagctactcaggaggctaatgcaggagaattgcttgaacccaggaaatggaggttgctgtgagatgagattgtgccactgtgctccagcctgggcaacagagcaagactctgtctcaaaaaaaaaaagaaaaaagaaaaagaaaaagggacttagcttgttcccctcaacccctttataaggcactaatccatttgggagggcaaagccctcataaccactttccaaaaggcccaacctcttaataccatcacaatgaggattaagtttcaacatgaattttggagggaacacattcaaaccatagcaactaataatctacattctgtctctatggatttgcttgttcttgatattttatgtaaatcaaatcatacaatatgcagccttttgtccctggcttctttaacttagcataatattttcaaagtttatccatgtggtagcagctgtcagtacttcattttcatgtctgaataatattctcttgtgtggatataacacatttcgtttatccattcatcaattaatggcacaataacattttacagctgagaatattgaaacctagaaagtttaagaaaacttgccaaagatcacacaattaatcagtaccagggcaaggattttaaccatagcttttttaaaatgcaaagttcatattcttaatcatttttccttattatatctaattttaaaaatagattggtatataatgagaaataaaagaaatacatctccatgcctttggcttatttttctataggattttttatgtctttcttaaggatttagaggtgttcttaatgtagatattactttgatactaatattttgttggtagtgtgtattgtaaatattttctttcattctgtaacttttttcacatcttgaatatgtattttgatgaataaaatttctcaactttaatataatcaaatttatcatggtcttatagatatagtttctgtgtcttgttaaggaactcttctgctacactaaggtctaaaacatatttacttatatattctaacatgagtataaagtttcattctttatattgaagttctcaattgacctgaagctgattttgtatatgaaatgtggaaaggttctaattttatctctttccaaatattattccacccatgcatttcataaaagaggaaatacacatggccaaaaaagatttgaaataatattgaacttcattagcaatggagtaaacacaatacaaaaacacagttaatagcatattatattcttttaaatggcaaaaaaatttgaagtttacaatatcaagtatttagagaatgtggttccacaggatctcttacattgctgatgggaatgcaaaatgttaaaaccatgagaaaagcaatttgatatttgtcttggtccattcgggctgctaagataaaataccataacttgggtggtttataaacaacagaaattttttctcacagttctggaggctgggaagtccaagatcaaggcattggcggatgtggtgtctggtaagggcttgcttttcaggtcctagatggcaccttcttgctgtgttcttacatggtgaaggggatagctaactctctgggtctctttataaaaacattaatccaatcgtgagggctccaccctcatgacctaatcacctgctaaaggtaacactttccaacagtatcaccatgggggttaggatttcaacatatgaattttgagggaacacaaacattcagacaatggcagtattataaagttgaacattcacaccccctgtgagcaacaattccacagaaacaatacacatagcaccattgttcatattaacaaaacatgtagaaaacccaagagctcatgtcaggagactggtgaataaacagtattatattcacataaagtttcatagagtggttaaaataaatgaccttcaataacagacaataatatgaaagcatcttagctatatattattaagtgaataaaactaattcctagaagataacatacaatttgatattcatttttgtaaccttaaaaataattttaataaaaagaaaaaaaagagaatgatgaacacctcttcaggatggaggttaccttaagtgaggggaagcaacaggttaccatggaaggggaccaaaaaggcatatgtaggctagcttttttttctgagtagcaggttcatgaatgctgatgacattattaaaggtaactaaccaacaaacaaagatataaaagaggccatatatggagtaatattatgagtaaccttttttttagagatagaatttcattctgtcacccaggctggagtggagtggtgtgaccatagctcactgcagcctcaaacttttgtacttaaaccatcctcctgcctcagcctcccaagtagctgggactacagatgtgcactaccatgcctggctaatttttcaattttttttgtagagatggggtctcactatgttgcctaggatggtcttgaactactagccttaaccaatcctcttgcctcaatctcccaaattattgggattataggcatgagtcactgcacctggcctgttatgagtatcttgaagcagaaatttgattactctaattctgagtagctgtggtgtaatacaaaataaaaacaaagaaaaatagctaataaacagccatgtttaaaagggcatgaatttgataaaacagattctttgctaggaccattccaaacaataatggtcagataaatctaaaattatagtagaattatatataaaaatgcaggttttcatctgaaagtccagtagcagattgatgaattttcataagagaagaatgaaagtgacatgatgaaaatattagctttagcttgtttgtttgtggaaactccattccaactacctcatatagcacttggcagactttaagcaaggattcagagaacaagtggcaaaagcaaaagtgcacaggtcagagggccgtcctgaacatgttagcagaagaatgtttcacagcagaatacattatcataggcattgttataaattgaattgggcccaccctctcccaagttcacatactgaagtgccactgtaactgtatttggagataggatctttatatagaaaggtaattaaggttaaatgaggtcataagtgtgagttctagtactttagaattggtgtccttatgaaaagagagataccagaacttgcgtttgctccctctctctctctctctcttttcaccgcagaggaaaggccatatgagaatacagtaagaaggtggctgtctgcaaaccaagaagagagcgctcaccaggaaactaatcagccagcatcttgacctggaatttgtaccttccagaactctgagaaaataaatttctgttgtttaaactacctcatcatattaactacctcatcatataaactacctcatattttgttatggcagcccatgctgatgaatacagacaccctggttagaagttggactgttggaatattcagagacattagtccaactcctacacacacaaattgtctgactaggagttttttttttcaattacctacatccaatcacagtctttttctgggctgataaggtgctaagcgctatacagaacagaaatgcgtttgagctgagttcacaggactcacaagaacacaaagggctgttcttggcctgagaacacctgagtatgacctctcagatgcatctatagtccctttcacttcagcttactgtcaaaccaacaattttatgtttagtattctcttacttttctttatggttttaccacatgtatatgtattcctgaacaaatatttttaattgattttttcaatctagaccaattttttttgttttattgtctcactccccctgccagatataagctctcagagggcagagatttttgcatgttttgtttgctgctatattcctggtgcctaaaacagcacctggcacatgtcaggtgcttatatatatttgttgagtaaatgaattaactgatataagtgagtggaagtagttcctgaggccttcctcttttctcacagatgtccacctaaagatttgtgtaaagttagtatctgtgggaaaaaattatctatgttacaaaagcctagccttttatgctgtcagtactcaaggattcatcctattaacgcatgaaaaattcttgctcaattgtacatatgcacttttgcttcctatttattgctgtgtcaccaagcttgcagcaggcctggctacagtcaaaccatcaatcccacagtgatattacacagcgttttactgtcataccttattgtgtcaaagttcatccattctacacttctacatctacatcccatcatcatatttttcctaagacagagtaccatattcttatacaaatggccttctgacattcgtgggttcattgcctaattcctgggacatagcagtcctgtggcctccagtaagagaccttcccagactagcctccataagctaatctgagcaagaaatgaggagaaagaaggcaacaagctcatctgaccattggtctttctgacctgtgaaaatggaaatccagatgacagagatgaattcagagatgaattcaggggttcatcttgggtcacctccctgttctctctcttccatagctccacgcctccctatttcctgcactctggttagatcttcattcttgcccttggattcagagtatgaagctccttcctcaaatgtcagaccctacattctttcttcacatagtcccacctcttcctttgctttgccctggttgcacccttttgaagcccagagaccactaaatccaggtcagcagattataaagtcctgcttaaagttggcaagaagcatcatttcctcaacctcacagggcttccagaactgacagctgcagacttcagtgaacctttgctcaatatttccttgcacagagctgagaaatagtaacttccatccagaaacattcttctgaataaagatgcactgggaggtttaaggataaatttttggtctcagagcagtcatcttttccttttcacaatattctaatttcctgcagatttctcatagcccagaataaagacactgggattttttaatacatattgagagaatttcagagacaaggagcatttataacacatactcttgaagtagatgagttcatttgaacacatcaagctaattgccctattgtgaggagggtggtagcttgtttcacggggttgccattgttacccattcctaagagggcaactgcacttaaaaaggattttctaattcctgagccacctctttgtttcctcctgtcttggatgaagtcactaagctatctttataacttcatatcattttccaagcaacacactgagaagctataaacagaacattggggaaagccaaacccacacaacttgtaggaaaattggattaaacattggtctgtaatcaaaagtgatcctggtgaaaattaattaaagagaaatatttctgttgcctgtggcgttattctgctgtgcagagaacaactgttccagataatagcatttgactcccaaagtgagagtgggatttataatttttctctcttaagaaattactagtcatggacaagaagaaaccccctgccttctagtgtgcctataaaaataatttggtgcaacttgcaatttgcatagatccaaccttggaccttggacattaaatccaaggtctaagatgagaattctcttcttgaccagagtgatcgctcatccttgcttgtttccctgcacacccttcatcccctgacatactaataaaaaataattcatctgacaatacaagctcttctttctttgagttctttcagtttttctctgagtaatttcagcctatccacttgggtcacgaaaatttgcagaatatgttatcttagaggtagatcaaaacacaaaatgaaaattttctgatccctttctggcctcttccctcaaaaagaaataggagctagtggttagcaagtctttgaacttttccatgttctttccttgaattttgaagagtagttccgcagtaagttgcttttatttttgttttatcaatgtatctatattgagttcttggttttaactagtgatgttactttatcacgtttcagtccctctaaggctatattttattcatttaatgtgatgtagtttgtatttgacctattttctgtggggatatgttttgtatattttcagagtttatctaaaaaatgacaattaaatcttgaacaagttcttctatttcagtgtagctaaatttactggtagccagaggaagagttgttaagagttaagaaaacatatatttactttccacttaaaaatagaaaagagagaaatgcactttgccctatcaaaaatataacttggataatcaaaaatttcatgaggacctctcgagtccagaccggtaaatgtgtaaactatccaaggtaggaagaatttgaaattaattgaggcaatgagagctgggatattaaaaccattatttaaaaagtatatgatataaacttgcaattaaatacactgtatggaaaacaaatgtaataaaaactcatcccttcctcataattttactgcattttactattacctgtgttctaggggtcatttataggcattgtatctgggatggaatataatgctgtgctgcttgctacacattaaatcttccgagctccatgtgcagtcatgtgaggttggcagcttggagcagccatataggagtatttataccatggaatttgccacatggtacaaatcagggctttttttctccagcctttcagttgtttctaacatttcccagcaccctagtacctaacagaataagaatcttgctatttccaggtgtaaatagattggaaagacctattttagagagcgatttccctggatactttttggtttttgcttcccatcaccctttccctcctcatcttgtatgatcatccctttctctgtggaatttcctctttctcatttcatgtagttgggccaaagggtgggagtccacagaccccagcctttccttgcctcgggtgggcccatgagttgagtctaaccagtcgtagtacttcatagcattggccatgtccctggccactgggtcaggcatgaacatctgaaccaaactgggacagagtcctccttaaaatgtcatgaatggatgctggctgggataaggagttgcaaacataggcttgaggttaccattggccatctctccaacacatgataatacatgaagggaagcaggacactaatgacattacacaatttaaaacttgcttgaagccagatgctctttggacttcccagttacctaagccaatatattccctttttcacatggccaataagcattttatcttgggtaattctggtaaacaccatataatgtgacatattcatgtgggaagcattgtcgattcttcttatgttacagtgacagagatgcctggaagggggttgaaatttggtttatattgttaccagatctgtggactaacaaggtgctctttaaaagagttcttattgcacttatcaaccagaattctatgtaatttataagattgtatgtaaaagactaaatattgtattaacttggcactttgaagtttgtgaaaggtaaggacaatacaacaccaatcactatatccccaggaattatctcagcatcatatggaatatagtaagaaattgctcagggaatctttgttgatagaagagctgtctcctgaaaactgtgcattcatctgtaccatgacgatgattcagcagttttatgcaatatcccacggcttgctttgtgtgaaaggcatatggacaacactgtttgatgtgtggcagagtaagcagattcaataaataaagactttctatcagtatgctgtttgaccttgagaactgaacttgtttctgtataaaccagatttcccatttctaagactctgggctcaaaggaaccaagcaagagaaataccctatcctgctttataataagctaaaataaattaatccattggctatttgcaaaggaatttaacagctaaaactgagcttctgaggttttaagaatatttttctaatatagctcatccacttacaacacccaacaagaaaacttttgtgaaaacaagagctttgtcctcatttcagttgatatctgttgggagaatacttgcttctccttctacatttcgatagggacagagcagtattggggtgaatacttctagatcttctcactgtccctttatggattcttccttattagaataaaaagaaatctgtctgggaaaagaagaataagctgacacacattgaccatgctgccaggagaggctgaggcacagcatcaaaagcccagcagcattccagcctctctgttccgccacacactgactattgaacaatcaaaatcctctgtatggttggctgagtaaaatgtgtgctctgcagaaacagccctccctacacgtgaggaacagggcctagaagaagaagaaaataagaggcctcgtgccaactaagcctgagctcaaccatctaatatttgttaggggttaccaagtcaacaagactgaaactctactgcaaggtgcattttacttcattttgctgtgttcaattgattaaggacctagaaataatgttacttctaagtaattagtaccctaggtaccaacataggacattttgatgagaaagtagcatttggatggcaaagaaccccatggggagcctagtgttttggagtgcttcttgtggctggtgctctcaggagtttgagtggtaactggcatgataccacaagcttaaatgtttaagtattaattacagtgttgcctagtaacttaaggcacagggcccagtctgcatttagaaagaaatggcttcatttttggattagtaggtttttctagaaactgaagttgaatgagaagaaatgtccttgagtgtagagaaattcactcctgtatttgagagagggtctttctgggagtttatactagagtggtggctttacttctttagggaccatagggcagaaagtccctactgcatgttgataaggttggtctcagggccatcagaaccttagaagataggcataaatgggaagaaaaattctcaaaaaaattgtttaaaaaaattacttaaccagactacagctataaaacatgggcaggagataatcaaagtaatggtattgtagttgttgtggctgccattcaggactttgcatttctatgctaagctcaaattctgttcaaatttaccttctttggactataaccagttagaatgaagatataatttcaagggagtaggccaaaatggcttgaacataggcatcaagaatcatctctaccatgttgtttcaatttgattctgaattaattacctatgctttgaacatgattgtaaccttgcctagtcaggaataaatatattttattataatgtagacaaagaatggatctttcatgttacagggtatataccaactatttgagttgtagtgaaaaataccagtggagttattatattccaaagaagacattttgaaagcctgtgttagacaatctatagaaaattatttttttcagactcaaggagaaagaccactgcaaaaagcaagtttgaatcttaaacagaatcagacagaaaaaaatgagaagaaaattacaatttccttcagtaaaaagttgaagtttcagtggcccaggtagaaagataggatagaaaaaaaaagggggtaaaccctttcctagatgttcctagaaagaaaactgggaaagagaagggcattttagttgacactagattaagattacagtattttcacactctgcccatttacagagttctatctgcataactcctccccagacctcctcatcaccagtctttcagtcctactgcttctaatttcctgacaatacagacaaataattagcaaccaacataaatcagtatagaacggaacttctggtcatttccccttctagctaaaatgaagaacgaggtgcatgcactgatgcaaattctgctcactgggatgattttctcctactgtccttcagggttatcccatggcgggtctgtagtgctacagtcatcactttgggtatagccagaatattgtgcagaatcatctataaataattctcagatgtttttgtcctccattctggtcataggaaaccccctatgaggccacggatgaagactgagagagagagagaaagctatgtagcagaagtagagaccacaggcatttgggttagttactcatgcccagttaatgagcccagtctcatataaaacattttcatttaataatgaagtgctacaatccaagtaaaacttcatggcttggtgggtcagaaaacatcttgttcatgatgggcaattcaggtcttacagtaatttgatagtccatggtcagcctctactagtgcccaggggcaagccaagaactgttcccttcaagagaaaaacagttatccatagagcacgtcatgcttttgctccaaatcttaaaggtaccactataattcacctatatatgctatgtaaagctcctatggcatccctatctgttacagacacttcaagtaccatctgatctgctgggtcatacaacacccttgaatttttgtgaatttttgtgggattttttgtgaacttttatttcccgccctctggcacatgtatccttaccaagatgtttagagcagttcctgcagcctgctcactaagtcctatcagtataatatcataaatgtattgatatcctgtggaaaggagaagtgatcaaggtccacgtccaccagattttgacttagggatagaaagtttatatggcctgtaagtaagagagtgaaaatatattgccagccctgccagttgaaagcaaattgctttgatagtatttactaatagaataggtaaaaagggaaaagcaccaaatcaatatctgcataccaggtgctcaggggatatgttgatttgccccagcaatgaagaaacacctggaacagcagctataatttgattaaatttatgatgagcaatcatcattcaagatccatcttcttcacaaaccaaatagcaaatgaagatttagtaggaataatcacctgaatctttcaaatccttgatggtggcattaatctctgcaatcattctaagaatacaatattactgttggtttgctaatttggtgggtagaggcagttttagtagcatctgtttagcctttcctaccataacagctcttacctcaaaggatacagaaccaactttgggcttctgtcagtttctgaatatgtctattccaacagtgcaatctagaactggaaaattaatcacaaggtaggttcaggaactcattgaacccacttccagattgacacaagccaaaagctcatttatcacttgacttcatttaaccctattctgactggtggactgcagtagcattttgtttctccaggaattagtgtcaattcagaatcagaaccacaaagtctgattattcttcttttgccaatgcacaattatcctgggaaatgactataggtcccttttgacaaggctaagaggagtattataatataaatattgcctgtgtaacgagttttttctcaaaggaattccatatacaaagatccttcatttaagggatccttcattcaagggactttttatctgtcaagagaataaagtctgaggattggttgagagtatattgactctctattatggcgtttcagatcagacttgtttaccagacctagagctacttttcaaatcgagtaagactttactaggatgtctatctactgcagttctaaggatatcatgatcagataccaataccaaagatttctacagctcagaccattctcacagctacttcagctctgctgtccattaagtgctaccacttggcccatgccattcctggatgctgtcattctcattgaattcagttattggcagtactttctgctgtcatttctggactacagaaaatagccaccacagagctttctagtgatgctgtggctcacttcacaaatgcatttcttaaagccttgattgaggaagcatccttgggacacttctaggggtgtgggcatgaattatggcatgaacaagcagacctttgatggtcgattcattctagcatcctagggtcgctaagcctttgtatatcttctaaagggtttcatgaaagctctggcatttaaactttatttaatgtaagggaccctctgggtggaggtttctgtcaacaaactgatcaaactattagagcccctctcaaccatttgaactaagtcaggaaatccaaaatcttggtttggtaaacctatatcaacaaactccttccaaactaacatatgccttcaccctgatccagtacctgtagcatcaatgcccagtttctgaggtttctggtggtataagttggcaaaatcttgctatcttttttacatgttgattgtatcttcttatagggcacactttatatcttactacctggggcatggcaaaaatttagtcctatcataggtcaagaaacaatgagatgtggtagaggtatgtcctacagaagattagcagtctcctcaaagaaggtcagtactgcttccttcagcaagggagccatcctcatcagacagaagagagaggtataacttctgctggcaaaaaaggtttcgtggaatttatgggttgaaggtcctcaacttccatagaatcagcataaatgtcccaatcaaatttttagggccccactccttcccagtcaatggcctaactttaacatagacatctggtgaggttgagaattcaatttgccttgtaattcagccatttatcattaaacttggttttccaaatcttggtcccatggtcacaagacatttctgttagggcattattataatcttcacagttgtttgcctatatatcgagctgataatttaaagccatgaactgatcattttccccccaagttttctattgcacttaaaggcaaacaatcaaaacccttacatccttattgtcactaaaagtattttatgaaagcaactactttgtcatccaaagccttgtcttctatagacagttcacaaatgaaatttaagtatctatattctcactgcatgccatgaactaccagtgtctctttaccattggaaaaagggtcattttaaatgtttcagatctgagaacctattccaggtagcctagaaccaattcagagaatccatcctttgggttctgttcccctggaactacttccaacaccaaattcagtatcaatcaaggtttgatccaagaagtggaaccatgaagagtgacatagtagaataaggaacttactgtagggaatacatgttatactttgtgtctggtgatgggccttcaatagctttaaatcagccaggctggcagtcaaagggaagagctagccatgaagtgggcaagagcaaaaacaaactggagtgcacaaggaggaaatagaatccatgagaacaaactggaactcatgaaaaactagagcctgagtctgtctctaactgactccataatccatacagcatataacctgcaggtgaagctggtacctttatcatggagcttcaacacacctggctccagtctcaagtcaaaaaacgaggaccctcaggagctgaagctaccacaatcctgagtgctgttccacaccaacaaggcaagtgagcccttcagtgaggcatgtgcaagctgccacaggccaaacacccaacaccaatcttcagatcataaaacagatgttgggtgagagtggccaagatggccaactagaagcagctagtgtacatggcttacatggagaggaatgggagaggaaagtaaatatagcacctttgactgaaacatccaggtactcatattgggactaatcaaggaaacaactcaacccatagagaacagagaaaagcaaagcagaacaacagcccacctgggagtgacatggagccaagggaaactcccctgcccagggaagtggtgagtgaatgtgcgaccccagcttctcccatggatctttgcaagcctcagatcaggagatgccctcatgaacccactccaccagggccttcagtctgacacacagagatacatggtgtctcagcagagcagttgcccaggcacacatggagatctgggagctttacatactctggctttcccggcttcccagcaaaagtagctgcaactctagcaaagtgggaggttagacctccataaatacccctaggaaataagctgaatccagggggccaaacagtgacagtctgtgggccccacttccacagtgcctcacaggttaagacccacttacttggaattccaagcagccactggtagcagtgttgtgcctccccccgtcagtgttctctggcctgcaggagacttgaaaactccctgggacagagctcctaggatgaggggcaagaatccatctttgctgttagggcaactaagcagtttcagcctttgggctttggagagtccaagctgaccaggggtggaagtggtaccctagcacagcacatctgctctacggaaacatggccagactactttttaaagtgggcccctgatctcattcctccttactgggtggggggtctccagccacctcttacagatgcattcagatgagcaacaggtcagtacctccctggtacagagctcccagatggagaagcaggctgccttctttctgttttgcagccttcactggtgatacctccaggtactggaacatctgaggtgactagggactggagcagatccccagcatgccacagcagtcctacggaaaggaggccagactgttacctgggtgcccattcccatatctcctcacgaggtaggtcctccaggtctgggcctctagccacctcccaccagagctgttgagccagtagcaactcggcaagtccctggacagagcctccaggaacaactgaaacctctctgccactgcctcttcagtggagctgtccttgctacccttgggctgagtaagaagcatatcattaccataagtgccttatctacacctccaaaaagctgccatccacccaaagagaggagtccagtctgtctccgacatgtgccacacctccccccgcaagtgctcatcaccagacagggagcttctagcctgggctcacaacatagaccctccatcctgggatgattgcactgaacaattgctgacccacatctctctggggtggagaccccaggagacaagcaaatgtggggcagcaagccagctaatgtggagcccagagggtttggtgtggcagcatctgtagcagagcgtggccagggatggtcattcctctaggctagacttgctcccatgagactttagccatagaggaactgccagacctgatctctgcagggtggtctttcacatcagacaaggttggtccaacctgagcactcctcggtctgttggcctctcctggcatgcctgcttacaaggcagtcttgggtgccttgggattctataccataacttctgcaccagtggaccactggtgaagagctccagcaaggcagcccctacagctgcacaccagcctgcacattccctccccatacttcagcttcccctgagcccatggcaactccccacatcactttgctggtgcatgtcttcactggtgagttttctttacttgccccaccagcatgcaggagtgcagtatgcccccctacccctgctgaccaccattacagacagagcctcggcaggcacagggcctgcaagccccaccaccaccagtgccccacctttacgctaatgctatgcagagaaaagaggatcctctcataccttgagtgatcactcatgctttcagggcacagagaaggcacccagacctgtgctggccagcaccctgccccaagccaacaccacctccagtgcaacattgctcactgtctccagcaggggcccccacttccccccagctgccttgcctctgccactgtggtgaatgaccgcagggaggcaggcacccttgcatctgctagcactgctgccacaccttgatacccccagtgcagtagacctgatacctcgaggagccggagaacaaagttggggaccaatagaagtcacccagaggtagcgcacacagtccaggagttgggagttgagtgttggccccctaaaatctctcagaaatgaagtcagttagctgaatccacctttttctacaatcaaaccctcaaggttatcaaataggataaaacaaaagaaaacattccaaaggtcagcaacctcaaagactgaagatagttaagcccacaaagataagaaagacatagtggaaggatgctgaaaaaggccagagtgcctctttcctccaaatgaccacatcacatctccagcaagggtttggaaacaagccagaagagattatggatcaatattcaacatccttaaagaaaagaaattccggctgggcacggtggctaatgcctgtaatcccagcactttgggaggctgaggtgggcagatcacctgaggccaggagtttgccaccagcctgatcaacatggagaaaccccatctctactaaaaatacaaaattagccaggtgtggtggcacacacctgtaatcccagctacttgggaggctgaggcaggagaatcgcttgaacccaggaggcggaggctgtggtgagctgagatcatgccattgcactccagcctgggcaacaagagtgaaactctgtctcaaaaaaaaaagtaaagaaattccaactcagaatttcatatccggcaaactaagcttcagaaaagcaaatgctgagggaatttgctaccaccagacctgctttacaagagctcctgaaggaagcactatatatggaaaggaaagatcattaccagccactacaaaaacacactgaagtacagagaccagtgacactataaagcaaccacataaataagtctgcaaaataaccagctaacatcatgatgacaggatcaaattcacacctatcaatactgatcttaaatgtaaatgagctaaatgccccaatgagaagactcgagagtggcaagctggataaagaaccaagacccattattatgctgtcttcaagagatgcatctcacatgtaatgatacacataggctcaaaataaagggatggaggaaaatttatcaagcagatggaaagcagaaaaaactcagtggttgtaatcctagtttctgacaaaacgactttaaagcaacaaagatcaaaaaagacaaagagaggtattatgtaatggtaaagggttcaattcaacaaagagatctaactactctaaatatatatgtacccaacacaggagtacacagattcataaagcaacctcttacagaccttcaaagagacttagactcccacacaataatagtgggagactttaacacaccattgacaatattagacaaatcatcaagatagaaaattaacaaagatatccaggacctgaactcagcactggatcaaatggacctggcagatatctacagaaatctacacctaaaaaacaatagaatatacattcttctcattgctgcactgcacatactctaaaattaatcacataatcggaagtaaaacactcttcaggaaatgcaaaagaatggaaatcataacgaagagtctctcagaccgcagcacaatcaaattagaaataaagactaagaaatgtactcaaaaccatacaattacatgtaaattgaataacctgctcctgagtgactttggggtaaataatgaaattaaggcagaaatgaataagttatttgaaactaatgaggtcaaagatacaacatatcagaatctctggaacacagataaggcagtgttaagagggaaatttatagcaccaaatgcccacatcaaaaagttagaaaaatctcaagttaacaacctaaaatcacaactaaaacaagtcccaaagatagcagaagacaagaaataaccaaaatcagagctgagagctgaactgaaggagattgaggaaataaaaaccattcaatagatcaatgaatgcaggagctggtttttgaaaacattaataaaatagttagaccactaactagactaacaaagaagaaaagagagatgattcacataaaaataatgagaaacaaacagtgggatattaccgctgaccccacagaaatacaaaaaaatatcagaggatattgtgaacacctccatgcacataaactagaaaatctagatgaaatggataaattcttggacacatacatgctcccaagactgaaccaggaagaaactgaacccctgaagagaccaatcctgagctctaaaattgagggaataataaatagcctaccaactaaaaaaagtccaggaccagacggcttcacagctgaattataccagatgcacaaagaagagctggtaccattcctactgaaactattccaaaaaatggaggaggagggactcctcctccctaattcattctatgagggcagcatcatcctgataccaaaacctgacaaagaaacaacgaaaaaagaaagcttcaggcaaatatccttgatgaacaataatgcaaaaatcctgaacaaaatactggcaaatcaaacccagcagcacatcagttagcttatccaccatgatcaagtagttttgattcctgggatgcaaggttggttcaacatatgcaaatcaataaatgtgatacatcacataaacagaactaaaaacaaatccataatttaaagctgttaactgatcatttcccccccaagttctctattgcacttaaaggcaaacaaaacccttacattctttattgtcactaacagtaatctataaaagcagctacttggtcatctaaagccttgtctctgataaacagttcacaagtgaaatttaagtaactattttctcactgcatgcgacaagctaccagtgcctctttagcattggaaataaggtcattttaaatgtatcagatctgagaacctattcaagctaaatagatacagaaaaggctttcaataaaattcaaatccattcatgttaaaaactctcaatacactaggtattgaaggaacataactcaaaataataagagccatccatgacaaacccactgccaacatcatattgaaatggcaaaagctgtaaacattgcccttgaaaactggcacgagataaggatgccctctctcaccactcctattcaacatagtattgaaagttctggctagggcaatcaggcaagagaaagaaataaaggcatccaaataggaagagaggatgtcaaactatcctggtttgcagacaacatgatcctgtatctagaaaactccatagtctcatcccaaaagcttttaagctgataaacaacttcagcaaagtctcaggatacaaaatcaatgtgcaaaaatcactagcattcctatacaccaacaacgtcaagctgagagccaaatcaggagtgaactcccattcacatttgccacaaaaagaataaaatacctgggaatatagctaaccagggaggtgaaaggtctctacaagaactatagccaggcatggtggctcatgcctgtaatcccagcactttgggaggccaaggagggtggatcacctgaggtcgggagtttgagatcaacctgaccaacatggagaaaacccgtctctactaaaaatacaaaattagccgggtgtggtggcacatgcctgtaatcccagctactcaggaggctgaggtaggagaatcgcttgaacccaggaggcagaggttgcagtgagctgagattgcaccattgcactccagcctgggcaacaagagtgaaactttgtctcaaaaaaaaaaagaactataaacaactgctcaaagacataagaaatcagaggacataaacaaacagaaaaacattccatgctcatggatagaaagaatcaatatcattaaaatggccatactgcccaaagcaatttatagatttaatgctattcctattgaactgccattgagattctttacagaactagataaaactattttaaaattcatatggaataaaaaacaagcttgaatagccaaggcgattctaagcaaaaagaatgaagctgggggttgggcacagtggctcacgcctgtaatcctagcaccttgggaggccaaggcaggtggccaaggcaggctgaggctgaggtcaagaatttaagaccagtctggccaacatagtgaaacctcatctctactaaaaatacaaaaattagctgggcatggtggcgggtgcctgtaatcccagctactagggaggctgaggcaggagaattgcttgaaccaaggaggcagagattgcaatgagagagcaaaaactccatctcaaaaaataataataataataacacaaagaatgaagctggagtgatcataccatctgacctcaagctatactacaggattatagtaaccaaaacagcatggtactgatacaaaaacagacacatacataagtggaacagaattgagaacccagaaataagaccacacacctacaactatctgatcttctacaaacctgacaaaaacaagcaatggggagaggattccatattcaataaatggtgctgggataactggtagccatatgcagactaaaaccaaactccttccttacaccatgtactaaaagtaactcgagatggattaaagacttaaatgtaaaacccaaaactataaaaaccctagaagacaatgaaggctataccattcagaacataggcatgagcagagatttcatgacaaagatgccaaaagcaattgcaacaaaaacaaaaattgacaaataggatctaattaaactaaagaacttctgcccagcaaaagaaactatcaacacagtaaacagacaatctagagaatgggagaaaatttttgcaaactatgcatccaacaaaggtctaatatccagcatctgtacagaagttaaacaaatttacaagaaaaaaaaacattaaaaagtgggcaaaggacatgaacagacacttctcaaaagaagacatacaggtggtcagcatcatatgaaaaaaagctcaacatcatttttcattaaagaaatgcaaatcaaaacaacaatgagataccatctcacaccagtcagaatggctattactaaaaagtcaaaaaataaccgatgttgatgaggttgtggagaaagaggaacttatacactgttggtgggagcagaaattatttcaaccattgtggaagacagtgtggcgattcctcagagacctaaagacagaaataccattcgacccagcaataccattactgggtatatacccaaaggaatataaatcattatattataaaaagacacatgcatgcatattttcattgcagcactattcacaatagcaaagacatggaatcaacctaaatgcccatcaatgatagacttgataaagaaaatgtggtacatatgcaccacaaaatactatgcagccattaaacagaatgagatcatatcatttgcagggacatggatggagctggagcccattatccttagcaaactaatacaggaacagaaaaccaaatactgcatgttctcacttataagtgggagctaaatgatgagaacatgtggatacaaagagggaaacaacacacactgggacctatcagagaatggagggtaggaggagggaacggatcagaaaaaataactaatgggtactaggcttaatacctgggtgatgaagtaatctgtaccacaaacccccatcacacaagcttacctgtgtaacaaacctgcactgtatccctgaatttaaaataatttttttaaagttgatatcatgggagagagtagaatggtggtcaccagaggatgggtaaagaagaaatgttggtcaaagggtatgaagtttcagttacaaaaaaggaatacattgtagagatttattgcacagcatggtaactgtggttaactataatgtattatatatttcataattgttggaagagcatattttaaatgttctcaccacaaaaaaaataggtcaggggatggatatgttcattaacttgatttactctttcaacaatgtatacagatagcaaaacaacatattatatcccataaatatagacaattatttgtcaattaaaaatttatgaaaacttttttaaaaaaaaacagatgctcctttatcccctgctttcaaatctcatgcaaatttcccttgctgctaagcccaacacaaaaccaacaggaagaaaattttgggagacatatttttagctcagctaagttgaccaacaaccaagttatcagaagggactttggaggtactggcagcattctttttcttttcgtggatggttgggggctggaggtgtccacaagcatagcttttaaattattcattaaatgtatatttacaacttatgtgattttgtaattacttatttttaatgctttttaaatgtttatgctttttaaatgttttaaatgttattttaaatgttataaaacattttaaatgttatataaaatgtttgtaaatgttattttttataagtctaaaatttctccactaatcctcatatttccatggagaagagaggatttctgaccaagcctacaaaagggagaaccaatgaaatctcctcagaggaaacacttccagtctgtctttctgatcccttacttgctgtttctcttgggagagatgcctaatccaattggcctatcacaccggtagatgtcacaaaaacaagatgctatttattgactctcccttggcctcttgacttacttatcaccatgcacggcaggtgtctgtacttctagaccccatgcagtaggccccttagtagggtcttcccttctcccacagaaggggcaagccattctatggttgcacagctacgtccaaggcataataaacctggctctcctctctgttggcccagtcatctttaattcaggggaaagcattggtaactccatccacattggcctaaggtccaagcttcattctcaaatccatctttgtcattatttcagtacccatttgactcattcctgtgtttatattatatcagccagaactcttatgtctccaccagcattagaatctgggactctgacataaggtcataaggttcaggaaaagaagtctccaagtagtggggatccctcaaaatcatgtggtaacagcattatagtaccaaatcatctatctggaaacaattgagacctgatgacaggatttagccctgatcaattactgggggccagggtcctaagactcatcactccctctaagcatctggccaagtgtatgcactcaaatatgcaagccaagtagaaaacaagtgtcattttttcatatctgtgaaagtcccctacgaactccaaaggcaacccttattcattgaaaattagctattgcccaaccaacccaacccctaaaaaatgtggcctgttaggcaagtttgccctgaagttggcatcatgcaaaaatatgtcatttaggggacaattagagtctctgataatttttacaaagctaatgtgcttctgcaagaactgttcatgtggtattaaaagtcagtgaacacttttaacttttatttgcattccatttttatacttaccagaaagaaaaaagtgcagaaaacactctccctatatcaaactacaaattccagctcagttcaagaaactaagagtagggaccctgccttctaactgatgcataaaagagtggaggtgctgctttttaaaaaggaggctaataataaagcaagaacagccagtaacagtcctgggcagggaagaaatcagccaaactcttgccaaaaattattgtattaaatgctaaatcctactttaaggtagcaaccaaaatttaatcttttcaaatgtttccctttatgagtagagcctcctactattttctaagaggcggaagcactgctctttgcaaagtgattgacttttttgacaggagccagaatttaaaactggcattgaaactcagaaaatctgaaaccaggaagaagaaagaaacaattgtttattgtatgctccatacacattttcagtatattgatgccatgtttgccagagaacaaatttccaaagtctgattgcagacctcctatctcctgacttttcacctgcctctgtaagtgtatgatgagatggtactggtgattattcggagccatcaccaggggctgcttccactaagagcagcccagttaagcaacacttccatggtgtttcttatagtgaccaatggaccatatccatctaccccaggtcaatgaaatcccttggcaaatgaggcacttatgtggaatttcacatgactggccatattcaggcagagccttgacaaggaggatgtggaaaagattctaatttgaggggagaaagttggggcagagctagccggggtggcagatgagatgttgttttttaaatgttctagagatcagaataggtgtgcgggttcagaagatcattcaggcataccaaaataatggcacctcctcttcactgtggaatgttttaaaatgactgctaaaattgccgggcacagtggctcatgcctgtaatcccagcactttgggaggccaaggcaggcagattacatgaggccaggagttcgagaccagcctggccaacatggtgaaaccccgtctgtactaaaaatacaaaaattagccgggtgtggtggtacgtgcctgtagtcccagctactcagaagactgaggcccaagaatcgcttgaacctgggaagcagaggttgcagtgagtcaagattgtgccactgcactccagcctgggtggagacagagttagactctgtctcaaaaaaaaaaaaaaaaaaaaaaaaaggaaaaagaaaagaaaaaaagaaaagataaataaataaataaataaaacgactaataaaaatgaaaatatcttccctttaacatattttcaaagccttcagtaataaaaaatatctgcttctttagccatttcgcatgcttaaagaaaaacttacaatgccattagcatggaaactgtgaactctaagccgccaagtattaaaaaacatataaaaagacgtttaatcttgagatttaactctgaatcctcagtcttcccaaaacatgctctaatgatcagacatcctaatgtgttgatcatagatctgtaaagaaggtcatagcctcatagaaacacatatcagttgtttaaacttaggcattagatgagaaagaaataattgataattaagggaacggaagttgaggctcggcatgggaatccagaaagaagtatctacaactgaaataaaaggtgagaaatacaatatattctgggaaaaacttatggccataggacctaggattattctatgacgcctgttctctttgttttctatttatcctttatcacaaagctccatatgccctacgctccaattatataaaatatagcttattaagtgttctaccctaatactcctcccacaccatttcttcctttagcagagaacattgtagataaaagtctttttaaaaataaaatgtttgcatagacacaaaggacatgatttttatcttcacattccttatgaagacaaaccacagtggtctttgttccctgtatcctgagagcctagaacagtgcctggcacatagttaagtgtttgtcttaaccttgaatccccagaaagcaaagctgaagacaagagttttaagttcaactactttgcctgtgaatgaaatgccagggaagcaaaagtgaggatgaagataaggggttatgaagcaagagggagaaccattccttaagatgaataccaagggcaaatatttgccccatctcaagacatcatcttctgctaagcatagaaactgcacctcaagactgtcctctgagggaagaattcatccactagccccatttcccttgtactcccttgcctttttgagctgtgtatgcatgggtgctgtacagggacccccagaacctccttccttgtggtcaacagaaaaggagcaagtagctcagtgtgggatagttgcccctggaggaagctggtaggagcacacacagagacaggtgaggaggagaggacctgcagtggtgcataaaaggagtctgatacagcactcaataaatatttgctgaatgaatgtgtttttttttttataacggttccagttattgattgaagaggggtaaaaagtcagcagtaactcatcatcataatcatctgtagtttagtgaagaaaagacacaggtcgccctttgaaagagcttgttacttggaataattttaatatttgctgattttaaaaacatttttccaattgtcagcttggcataactggaactgattagtgacaaaaagtgatagatgatgcacctgtccctcacttgaactgaagaaaaattgttcataaaagcatggacatttccacaagcatcattagtaacaaatatctgctgagttagcttttatgctccttcaaattagccactctctcacatactgatccttcccacattgcagcatcactttgttactacaactcatcctttaaagcttagctgaaaaatcactgctaccaggaagccttctctctctctctctctccctccctccccttcctctctatttccaatttgtgctaggtgctttcaagttactcagttttactgctattattgcatctctcacattctattgtaactgtgattgtctatctccctcactaaattatcaacagtggtgggactgagacatttatcttcctagcaccagacacatagcaggcatcctatgaatttcagcagaaccaaagaatgtgtaagtcactgaatcagtgtttgacaaaactgcaaaggatattgggaaatgaacagtagctgatgtttatcactggttgggttagggaaatcttagaggagctggatgtgggctggatgcagaaggaagatgagactcatggatttggggagaaggaaaattgcattacagttgggtttctggccatgagacagaaatgcacttaacctaccataaagcagtgaattatctagctaggcaggggcagaaagatctggagcacttcacagagaataaaactgaacaggaaagtcagagtgagattgtagagagcatcaaatgtcaggctaagcagctttgcctttttcttctattttatattctcagaattttcaaagcagtaggcaacatgaccaagtggagtttcaaatggctggtagatgtgtggaagagtaattagaaaagagaaaccaattacacagagaagaaaaaagcaattccctttgtcaaactatgagccaaggaagtaagacaaagtttggctttagaaaaaataatttgggaggatttaaagattatacaagttcggtgatttcctattctttgtttagagttaacgttctccaagacgtaacctgaactccataatctaccctgatttcttcatctcctgccaaactgaactgttagtgcatacatgacctctattgcctcatgtctgggaaaatcttggtgcccggaatactctcccttctacccattttcttctgtcaaagcctgaactgcactttaattctcttttctaagctatctcatccacaatagaaagtatatgtacatcacaattagaagaactagagaagaaagagcaaataaattcaaaagctagcggaagaaataaataactaagatcagagcagaactgaaggagatagagacatggaaaacccttcaaaaaatcaatgaatccaggagctggttttttgaaaatattaacaaaatagctaggccactagccagactaataaagaagaaaaaagaggtcacttccaagatggccaaataggaacagctccggtctacaactcccagtgaaattgacacagaagatgggtgatctctgcatttccaactgaggtacctggttcatctcattgggactggttggacagtgggtgcatcccaaggagggtgagccaaagcagggcagggcatcacttcacctgggaagtgcaaggggttgggagatttccctttgctagccaaaggaagccatgagtgactgtacttggaggaatggtacactcctgcccaaataccatgcttttaccatggtcttcacaactggcagaccaggagattccctcccatgcttggctaggcagttcacacgtccatggagccttgctcactgccagcgcagcagactgagattgacctgggatgctggagcttagtgaggggaggggtatccaccattgctgaggcttgagtaggcggttctatgctcacagtgtaaacaaagaggcagggaagcttgaattgggtggagcccaccgcagctcagcaaggcctactgcctctatagattccacctctgggggcagggcatatctgaacaaaaggcagcagacagcttctgcagacttaaatgtccctgcctgacagctctgaagacagcagtggttctcccagcatggctttcgagctctgataactgacagaatccctcctcaaatgggtccctgaccccagtgtagcctgactgggagacacctgccagtaggggctgacaaacacctcatagaggtgggtgcccttctgggacaaagcttccaggggaaggatcaggcagcaatatttgctgttctgcagcctttaccagtgatacccaggcaaacagggactggagtggacctccagcaaactccaacagacctgcagctgaggggcctgtctgttagaaggaaaactaactaacagaaaggaacagcatcaacatcaacaaaaaggacatccacgccaaaaccccatccataggtcaccaacatcaaagaccaaaggtagataaaaccacaaagatggagagaaaccagagcagaaaggctaaaaattccaaaaaccagaacacctcttctcctccaaaggaacaaaactcctcaccagcaaggggacaaaactgagtggagaatgagtttgacaagttgacagaagtaggcttcagaagttcagtaataacaaacttctctgagctaaaggagcacattctaacccattgcaaggaagctaaaaacctagaaaaatgttagatgaatggtgaactagaataatcagtgtagagaagagcttaaatgacctgatggagctgaaaaccacagtacgagaacttcatgaagcatacacaagcttcaatagctgattcaatcaagtggaagaaaggatatcagtgattgaatatcaaattaatgaaataaaatcagaagacaagattagagaaaaaagagtgcaaagaaatgaacaaagcctccaagaaatatgggacaatgtgaaaaggccaaagctacgtttgattggtgtacctgaaagtgacagggagaatggaaccaagttagaaaacactcttcaggatattatccagaagaacttccccaacctagcagggcatgccaaaatccaaattcaggaaatacagagaacaccgcaaagacattcctcaaaaagagcaaccataagacacataattgccagattcaccaaggttgaaatgaaggaaaaaatgttaagggcagccagagagaagggtcgggttacccacaaagtgaagcccatcagactaacagcagatctctcagcagaaatcctacaagccagaagagagtgggggtcaatattcaacattcttaaagaaaagaatcttcaacccagaatttcatatccaaccaaactaagcttcataagtgaaggagaaataaaaccctttacagacaagcaaatgctgagagattttgtcaccaccagacctgccttacaagagctcctgaaggaagcccataatatggaaaggaacaaccagtaccagccaccgcaaaaacacgccaaattgtaaagaccatcgatgctatgaagaaactgcatcaattaatgggcaaaataaccagctagcatcataatgacaggatcaaattcacacataacaatattaaccttaaatgtaaatgggctaattccccaattaaaagacacagactggcaaattggaaaaagagtcaagatcaatcagtgtgctgtattcaggagacccatctcacgtgcaaaggcacacataggctcaaaataaagggatggaggaagatctgccaagcaaatgaaaagcaaaaaaaagcaggggttgcaatcctgctgtctgataaaacagactttaagacaacaaagatcagaggagacaaagaaaggttcatgacataatggtaaagggatcaatgcagcaagaagagctaactatcctaaatatacatgcacccaatacaggagcacccagattcataaagcaagtgcttagagacctacaaagagacttagactcccacacaataatagtgggagactttaacaccccactgtcaatattagacagatcaacgagacagaaaattagcaaagatatccaggattgaactcacctctggatcaagagaacctaatagacatctacagaactctccaccccaaatcaacagaatatacattcttctcagcaacacatcatgcttattctaaaactgaccacataattggaagtaaacactcctcagcaaatgtaaaagaacagaaatcacaacaaacagtctctcagaccacagtgccatcaaattagaacgcaggattaagaaacgcactcaaaactgcacaactacatggaaactgaacaacctgctcctgaagattgaactactaggtaaataacaaaactgaggcagaaataaagacgttctttgaaaccaatgagaacaaagacacaacgtaccagaatctctgggacacatttaaagcagtgtgtagtgggaaatttatagcactaaatgcctacaagagaaagcaggaaagatctaaaatcgacaccctaacatcacaattaaaagaactagagaagcaggagcaaacaaattcaaaagctagcagaagacaagaaataactaagatcagagcagaactgaagcaggtagaaacacaaaaaaacccttcaaaaagtcaaagaatccagcagcttgttttctgaaaagatcaacaaaacagaccactagcaagcctaataaagaagaaaagagagaagaatcaaatagatgcaataaaaaaatgataaaggggatatcaccactgatcccacagaaaaactaccatcagagaatactataaacacctctatgcaaataaactagaaaatctagaagaaatggataaattcctggacacatacaccctcccaacactaaaccaggaagaagttgaatctctgaatagaccagtaacaggttctgaaattgaggcaataattaatagcctaacaaccaaaaaatgtccaggactagacagattcacagccgaattctaacagaggtgcaaagaggatctggtaccattgcttctgaaactattccaatcaatagaaagagagggaatcctccctaactcattatatgaggccagcatcagcctgataccaaagcctggcagagacacacagaaaaaagagaatttcagaccaatgtccctgatgaacatcgatgcgaaaatcctcaataaaatactggcaaaccaaatccagcagcacatcaaaaaggttatccacaatgatcaagtgggcttcatctgtgggatgcaaggctggttcaacatacataaatcaaaaaatgtaatccatcacataaacagaaccaaccaaaaaaaccacatgattatctcaatagatgcagaaaagaccttcaataaaattcaacagcctttcatgctaaaaactctcaataaactaggtattgatggaatgtatctccaataataagaactatttatgacaaacccacagccaatatcatactgaataggcgaaaactggaagcattccctttgaaaaccatcacaagacaaaaatgccctctctcaccactcttattcaacatagtattggaacttctggccagggcaatcaggcaagagaaagaaataaagggtatttaaataggaaaagaggaagtcaaattgtccctgtttacagatgacatgattgtatatttagaaaaccccatcatctcagccaaaaatctcaagctcatatgcaacttcagcaaagtctcaggatacaaaatcaatgtgcaaaaatcacaagcattcctatacaccaacaacagacaaacagagaaccaaatcacaagtgaattcccattcacaataactacaaagagaataaaatacctaggaatccaacttacaagggatgtgaaggacctcttaaagagaactacaaactactgctcaatgaaataaaagaggacataaacaaatgaaagaacattccatgctcatggataggaagaatcagtattgtgaaagtggccacactgcccaaagtaatttgtagattcaacgctattcccatcaagctaccattgactttcttcacagaattggaaaaaagactactttaaatttcatatggaaccaaaaaatagcctgcatagccaaggcaatcttaagcaaaaagaacaaagctggaggcatcatgctacctgacttcaaactatactacaaggctacagtaacaaaacagcatggtaatggtaccaaaacagatatatagaccaaaggaacagaacagaggcctcagaaataacatcacacatctacaaccatctgatgtttgacaaacctgacaaaaaacaagcaatggggaaaggattccctatttaataaatggtgttgggaaaactgacaggccatgtgtagaaaactggaactggatccctttcttacaccttctacaaaaattaactcaagatggattaaagacttaaacataagacctaaaaccataaaaatcctagaagaaaatctaggcaataccattcaggacataggcatgggcaaagacttcatgactaaaacaccaaaagcaatggcaataaaagcgaaaattgacaaatgggatctaattaaactaaagagcttctgcatagcaaaggaaactatcatcagagtgaacaggcaacctaaagaatgggagaaaatttttgaaatctgtccatctgacaaagggctaatatccagaatatacaaagaacttaaacaaatttacaagaaaaaacaaacaaccccatcaaaaagtgggcaaaggagatgaacagacacttctcaaaagaagacacttatgcagccaacagacatatgaaaaaatgctcatcatcactgctcatcagaaaaatgcaaatcaaaaccacaatgagataccatctcatgccagtcagaatggcaatcattaaaaagtcaggaaacaaatttgtggagaaataggaatgcttttacactgtgggtgggagtgtaaattagttccaccattttggaagacagtgtggcaattcctcaaggatctagaaccagaaataccattaggccagcaatcccattactgggtatatacccaaaggtttataaatcatgctaccataaagacacatgcacatatatgtttattgcagcactattcacaatagtaaagacttggaaccaacccaaatccccttcaataatagactggataaagaaaatgtggtgattacaggggcaagatggccgaataggaacagctccagtctacagctcccagcgtgagcaacgcagaagacgggtgatttctgcttttccatcagaggtaccgggtacatctcactagggagtgccagacagtgggcacaggacagtgggtgcagtgcactgtgtgcgagctgaagcagggtgaggcattgcctcactcgggaagcgcaaggggtcagagagttcactttcctagtcaaagaaaggggtgacagacggcacctggaaaatcgggtcagtcccaccctaatactgcgcttttccgacaggcttaaaaaacagcgcaccaggagattatatcccacacctggctcagagggtcctatgcccacggagtctcgctgatcgctagcacagcagtctgagatcaaactgcaaggtggcagggaggctgggggaggggcgtccgccattgcccaggctgcttaggtaaacaaagcagccgggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttttcccaggacgcagctggagatctgagaacgggcagactgcctcctcaagtgggtccctgacccctgaccaccaagcagcctaaatggaggcaccccccagtaggggcagactgacacctcacacggccaggtgctactctgagacaaaacttccagaggaacaatcaggcagcagcattcgtggttcacgaaaatccactgttctgcagccaccgctgctggtacccaggcaaacagggtctggagtggacctctggcaaactccaacagacctgcagctgagggtcctgtctgttagaaggaaaactaacaaacagaaaggacatccacaccaaaaacccatctgttcatcaccatcatcaaacaccaaaagtagataaaaccacaaagatggggaaaaaacagagcagaaaaactggaaactctaaaaagcagagcgcctctcctcctccaaaggaacgcagctcctcaccagcaacggaacaaagctggatggagaatgactttgacgagttgagagaagaaggcttcagacgatcaaactactccaagctagaggaggaaattcaaaccaaaggcaaagaagttaaaaactttgaaaaaatttagacaaatgtataactagaataaccaatacagagaagtgcttaaaggagctgatggagctgaaaaccaaggctcgagaactacatgaagaatgcagaagcctcaggagccgatgtgatcaactggaagaaaaggtatcagtgatggaagatgaaatgaatgaaatgaagtgagacgggaagtttagagaaaaaagaataaaaagaaacgaacgaagcctccaagaaatatgggactatgtgaaaagaccaaatctacgtctgattggtgtacctgaaagtgatggggagaacggaaccaagttggaaaacactctgcaggatattatccaggagaacttccccaatctagcaaggcaggccaacattcagattcagtaaatacagagaacgccacaaagatactcctcaagaagagcaactccaagacaaataattgtcagattcaccaaggttgaaatgaaggaaaaaatgttaagggcagccagaaagaaaggtcgggttacccacaaagggaagcccatcagactaacagcagatctcttggcagaaactctacaagccggaagagagtgggggccaatattcaacattctgaaaggaaagaattttcaacccagaatttcatatccagccaaactaagcttcataagtgaaggagaaataaaaccctttacagacaagcaaatgctgagagattttgtcaccaccaggcctgccctaaaagagctcctgaaggaagcactaaacatggaaaggaacaaccagtaccagccactgcaaaatcaagccaaattgtaaagaccattgaggctaggaagaaactgcatcaactaacgagcaaaataaccagctaacatcataatgacaggatcaaattcacacataacaatattaactttaaatataaatggactaaatgctccaattaaaagacacagactggcaaattggataaagagtcaagacccatcagcatgctgtattcaggaaacccatctcacgtgcagagacacacataggctcaaaataaaaggatggaggaagatctaccaagcaaatggaaaacaaaaaaaggcaggggttgcaatactagtctctgataaaaacagactttaagccaacaaagatcaaaagagacaaggctattacacaatggtaaagggatcaattcaacaaaaagagctaactatcccaaataaatatgcacccaatacaggagcacccagattcataaagcaagtcctgagtgacctacaaagagacttagactcccacacaataataatgggagactttaacaccccattgtcaacattagacagatcaatgggacagaaagttaacaaggatacccaggaattgaactcagctctgcaccaagaggacctaatagatatctacagaactctccaccccatatcaacagaatatacatttttttcagcaccacaccacacctattccaaaattgaccacataattagaagtaaagctctcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgaagacaaaaataaagatgttctttgaaagcaatgagaacaaagatacaacataccagaatctctgggacacattcaaagcagtgtgtagagggaaatttatagcactaaatgcccacaagagaaagcaggaaagatccaaaattgacaccctaaggtcacaattaaaagaactagaaaagcaagagcaaacacattcaaaagctagcagaaggcaagaaataactgaaatcagagcagaactgaaggaaatagacacacaaaaaacccttcaaaaaatcaatgaatccaggagctggttttttgaaaggatcaacaaaattgatagaccgctagcaagcctaataaagaagaaaagagagaagaatcaaatagacgcaataaaaaatgatgaaggggatatcaccactgatcccacagaaatacaaactaccatcagagaatactataaacaactatatgcaaataaactagaaaatctagaagaaatggataaattcctggacacacacaccctcccaagactagaccaggaagaagttgaatctctgaatagaccagtaacaggatctgaaattgtggcaataatcaatagcttacccaccaaaaagagtccaggaccagaaggattcacagccgaattctaccagaggtacaaggaggaactggtaccattccttctgaaactattccaatcaatagaaaaagagggaatcctccctaactcattttatgaagccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgatcaagtgggctgcatccctggaatgcaaggctggttcaatatacacacatcaataaatgtaatccagcttataaacagaaccaaagacaaaaaccacatgattatctcaatagatgcagaaaaggcctttgacaaaattcaacaacgcttcatgctaaaaactctcaataaattaggtattgataggacgtatctcaaaataataagagctatctatgacaaacccatggccaatatcatactgaatgggcaaaacctggaagcattccctttgaaaatggcacaagacagggatgccctctctcaccactcctattcaacatagtgttggaagttctggccagggcaattaggcaggagaaggaaataaagggtattcaattaggaaaagaggaagtcaaattgtccctgtttgcagataacatgattgtatatctagaaaatcccattgtctcagcccaaaatctccttaagctgataagcaacttcagcaaagtctcaggatacaaaatcaatgtacgaaaatcacaagcattcttatacaccaataacagacagagagccaaatcatgagtgaactcccattcacaattgcttcaaagagaataaaatacctaggaatccaacttacaagggacgtgaaggacctcttccaggagaactgcaaaccactgctcaatgaaataaaagaggatacaaacaaatggaagaacattccatgctcatgggttggaagaatcaatatcgtgaaaatggccatactgcccaaggtaatttatagattcagtgccatccccatcaagctaccaatgactttcttcacagaattggaaaaaactactttaaacttcatatggaaccaaaaaagggcccacgtcgccaagtcaatcctaagccaaaagaacaaagccggaggcctcacgctacctgacttcaaactatactacaagtctacagtaaacaaaacagcatggtactggaaccaaaacagagatatagatcaatggaacagaacagagccctcagaaataatgctgcatatctacaactatctgatctttggcaaacctgagaaaaacaagcaatggggaaaggattccctatttaataaatggtgctgagaaaactggctagccatatgtagaaagctgaaactggatcccttccttacaccttatacaaaaattaattcaagatggattaaagatttaaacgttagacctaaaaccataaaaaccctagaagaaaacctaggcattaccattcaggacataggcatgggcaaggacttcatgtccaaaacaccaaaagcaatagcaacaaaagccaaaattgacaaatgggatctaattaaactaaagagcttctgcacagcaaaagaaactaccatcagagtaaacaggcaacctaaaaaatgggagaaaatttttgcaacctactcatctgacaaagggctaatatccagaatctacaatgaactcaaacaaatttacaagaaaaaaacaaacaaccccatcaaaaagtggggaaaggacgtgaacagacacttctcaaaagaagacatttatacagccaaaaaacatatgaaaaaggctcatcatcactggccatcagagaaatgcaaatcaaaaccacaattagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgatacctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattgagaaaatgtggcacatatacagcatggaatactatgcagccataaaaaatgatgagttcatgtcctttttagggacatggatgaaattggaaatcatcattctcagtaaactatcacaaggtcaaaaaaccaaacaccacatgttctcactcataggtgggaattgaacaatgagaacacatggacaccggaacgggaacatcacactctggagattgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacataaagtataacaataataaaataaaatgtagcacatacacaccatggactactatgcagccataaaaaatgatgagttcatgtcctttgcagggacgaagctgaaaaccatcattttcagcaaaatatcacaaggaaagaaaaccaaacactgcatgttctcactcataagtgggagttgaacaatgagaacagatggaaatagggaggggaaaatcatacaccagggcctgttaggggctggggggttgggggagggatagtgttaggagaaatacctaatgtaagtgacaagttgatgggtgcaccaaatcaacatggcacatgtataactatgtaacaaacctgcatgttgtgcacatgtaccctagaacttaaagtataataataattacaaaaaaagaagaaaagagagaagaatcctagacacacaataaaaaatgataaaggggatatcaccactgatacaacagaaatacaaactaccatcagagaatgttataaacacttctatgcaaataaactagaatatgtagaataaatggatacattcctggacacatacaccctcccaagactaaaccaggaagaagttgaatccctgaatagaccaataacaagttctgaaattgaggcagtaattaatagcctaccaacaaaaacagctcaggaccagatggattcacagccgaattctaccagaggtaaaaggaggagctggtaccattccttctgaaacagtagaaaaagagggactcctccctaactcattgtatgagtccagcatcagcctgacaccaaagcctggcagagacacaacaaaaaaagaaaatttcaggccaatatccctatgaatatcaatgcaaaaatcctcaataaagtactgtcaaaccgaatccagcagcacatcaaaaagcttatccaccacaatcaagttgtcttcatccctgggatgcaaggttggttcaacatacacaaatcaataaacgtaatccatcacataaacagaaccaatgacaaaaaccacatgattatctcaatagatgcagaaaaggcctttgataaaatttaacaccccttcatcctaaaaactctcaataaactaggtattgatggaatgtatctcaaaatactaagagttagttatgacaaacccacagccaatatcatactgaatgggcaaaagctggaagcattccccttgaaaatcaggacaagacaaggatgtcctctctcaccactcctattcaacaagatattggaagttctggccagggcaatcaggcaagagaaagaaataaaggttattcaaataggaagagaggaagtcaaattgtctgtttgtacaggacaggattgtacatttagaaaaccccatcgtctcagccaaaaatctccttaagctgatatgcaacttcagcaaaatctcaggatacaaaaccaatgtgcaaaaatcacaagcattcctatacaccaatcatagacaaacagagagccaaatcatgagtgaactccctttcacaattattacaaagtgaataaaatacctatgaatacaacttacaagggatgcgaaggacctcttcaaggtgaactacaaatgactactgacggaaataagagaggacacaaacaaatggaaaaaccttccatgctcatggataggaagaatcaatgtcatgaaaatggccataatgcccaaagtaatttatagattcaatgctatccccatccagctaccattgactttcttcacagaagtggaaaaaactactttaaatttcatgtggaaccaaaaaagagcccgcataaccaagacaatcctaagcaaaaagaaccaagctggaggcatcacgctacctaacttcaaactatactacaagaccacagtaaccaaaatagcatggtactggtaccaaaacagatatatagaccaaaggaaaagaggcctcagaaataacaccacacatctacaaccatacaatctttgacacatctgacaaaaacaagaaatggggaaaggattccctatttaataaatggtgttgggaaatctggctagccatatgcagaaaactgaaactggacccctccttacatcatacacaaaaattaactcaagatggattaaagatttaaacatgagacctaaaaccataaaaatcctagaggaaaacctaggcaataccattcaggacataggcatgggcaaagacttcatgactaaaacaccaaaagcaatggcaacaaaagtgaaaattgacaaatgggatctatttaaagagcttctgcacagcaaaacaaactgtcatcagagtgaacaggcaacctacagaatgggagaaaatttttgcaatctatccatctgacaaagggctaatatccagaatctacaaagaacttacacaaatttataagaaaaaaaaaccatcaaaaagtgggcaaaggagataaacagacacttctcaaaagaagacatttacgtggccaacaaacatatgaaaaaaagctcatcactggtattagagtaatgcaaatcaaaaccacaatgagataccatctcacgccagctaaaatggagatcattaaaaagtcaggaaacaacagatgctcgagaggttgtggagaaataggaacacttttaaactgttggagggagcataaattagtccaaccattgtggaagacagtgtggcgattcctcaaggatctagaaccagaaataccatttgacccagcaatcccattactgggtatacacccaaaggattataaatcattctactataaagacacatgcacatgtatgtttattgcagcactattcacaatagcaacgacttggaaccaacccaaatccccatcaataatagactggataaagaaaatgtggcacatttacaccatggaaactatgcagccataaaaaagatgagttcatgtcctttgcagggacatggatgaagctggaaaccatcattctcagcaaactaacacaagaacagaaaaccaaacaccgcatgttcccactcatacgtgggatttgaacaatgagaacacatggacataaggaggggaacatcacacgtgggggcctgtcaggggtatggagctaggggagggatagcattagaaaaaatacctaatgtcgatgacgggttgatgggtgcagcaaaccaccatggcacgtgtatacctatgtaacaaacctgcatgttctgcacatgtatcccagaacttaaagtataatttaaaaaagaagaagaagaaagaaagtacatgtaagaaggccacttccaaagtgacatgtcacttctacttgggccttctggaaacaagctctccccacttcatgtgtccactccatgtatataggggtcaaactaataacatttatcttgggttttatatatggagaaagaatcaagtgtgatgtaaacaaagcataagtgtgatgtaaacaaagcataagtaaacaaatcaagtgtaatgtaagaaaagcatggactatagttctgttctgtatgtcctgagctatctacaaccttagcttcctcataggcaaaataaaggggttggtcaatgtcatctgaaaggtgcctctcaactctaacactctgtgtgataaatagtgagaacttcatacagcacagggagcgagatatactgagggctaaacgcgtggcacctatagtgactggaagctaggagatgcccaatatatatttagctgatggactaacctcctgactcatgctgtctacacttgcctctatttggagctggctgggtgcagtgcccaggggatcagagcttaccttgttatggcagtgactgcaacatttaaagcagcttctcaaattcaaatatgtacatgcatttcctggggatcttgtaaaatggagatcctggtttagtaggtctgagtggggcctcagattctgcatttaagtttccttttttattcatacataataattttacatatctgtggggtatatgtgatattttgatacatgcatacagtgtgtaatgatcaagtcaaggtaagtaggatattcatcacctcaaatgtttatcatttctttgtgttgggaacatcccaaaccttttagctgtacaatacattattgcgaattataatctgtgctattacacaccagaacttattcattctagaattcttttttggattgtttactgttggcatatataaatgctactgatttttgtatgttgattttgtgttctgcaactttacttaatttatcagttctaacagttttttggtggattctttaggtttctctaaatataagatcatgtcatctacaaacaaagctaatttgacttcttcctttccagttcggattccctatatttctttctcttacccaattgctctagccaggacttccagtattatattgaataaaagtggtggaagtgggaatccttgtcttgttccagatcttagaggaaaggccttcaatttttccccattcagtatgataactctgggtttgtcatatatggtctttctattttgagatattctcaaacaaaagccaatttgataagggtttttattttcataaagggatgttaaattttatcaaatgcttatttggcatctatggaaatagtcacatgattttggttctcggttctgttaaggtgatgtatcatgtttattgttgtgaaatattatgttgaaccatccttgcatccctgagatgaatcccactggatcatggtgaatgatcttttcaatatgttattgaatttggtttgctagtacttcattgaggctttttgtatctgcatttattattgatatcagcctattttttttccattgtgtccttgtctggttttggtatcagggtaatactggccttatagaatgagtttggaatattccttccattgcaattttttttaagagttggagtagaattagtattagttcttctttaactatttggtggcatttagcagtgaagccattaggccctgggctttttgtcgatagaagacttttcattaaagcttcaatctcattacttgttattggtttattgaggttttctatttattcatagcttaatcttgatcagttgtatatatccaggatttgtctatttcttctaggtttcccaatttgttgccatatagttattcgtaatagtctccgatgatttgttgtatttctgtggtttcatttgttatgtctcatttttttctgatgttatttatttgggtcgtttctttttcttttttttaatctttaatttttgtgggtacttagtaggtgtatatatttatgtggtacatcagatattttgatacaggcatgcaatgcataataatcccatcatgtaaaaggtgtatgcatcccctcaagcatttttcctttgtgttacaaaaaatccaactatactctttattttttaaatgtacaattaaattactattgactatagacactctgttgtgctaaataataggttttattcattctttctaactatttgttttgtgcccagtaaccatctccacctccccaccactcccctactacccttcccagcctctggtaaccattcatctactgtctgtctccatgagttcagttgatttgatttttagatcccacaagaaaaattagaacatgcaatgtctgtctttctgtgcctggcttattttacttaacataatgacctccagttccatccattctgttgcaaatgagaggaactcattcttgcttatagctaaatagtactccattgtgcataagtaccacatgttctttatccacttacctgttgatggacatttaagttgctttcaaatcctggttatcatgaacggtgctgcaacaaacataggtgtgcagatatctctttaatatactgacttcctttcttttgggtatatactcagaagtgggattgctggataatatggtagctctatttttagtgttttttgttttgttttgttttttgagggacctcaaaactgttctccatggtggctgtaatcatttacattcccagcaacagtgtatgagggttccctttaatccacatcctctccagcatttgttatttcctgtcctttggataaaagccattttaattagggtaagatgatatctcatagttttcatttgcatttctctgatgaacaatgatgctgagcatcttttcttttccctttacttttttttttttttttttttttgcttttctttttctttttcttttccctttcctttcttttattttcttttttttttttttttctgtgacaacgtctggctctacggtccaggctggagtgcagtggtgccatcttggctcactgcaacctttgcctctgcctccagggctcaagccatcctcccaccttaacctcctgagcagctgggactagatgcaggcatcaaaacgcctggctaatttttttttttttttttttttttttttgtagaaatagggttttgccctgttgcccaggctagtcttgaaattgtgaactcaaacaatctgcccacctcagcctcccaaagtgctggaattacaggcatgagccactgtgcctggcctgagcaccttttcatatgcttgcttgcttgccatgtatacgacttcttttcagaaatgtctattcaaatattttgcccatttttaaatcagattattagacttgttcctatagagttgtttgagttacttatacactctggttattaatcccttgtcagatgggtagtctgcaaatattttctcccattctgtgggttatctattcactttgttgcttgcttcctttgctgtgtggaagcttttaacttgacgtaatcccatttgctcattttgccttggatgcctgtgtctgtggggtattactcaagaaacttttgcccagaccaatgtgctggagagtttccccaatgtttccttgtagtgttttcatagtttgagtccttagattttgatttgatttttgtgtatggtgagagataggggtcaagtttcattcttctgcatataggtatcctgttttcccagcaccatttattgaaaagactgtcttttccccagtgtatactcttgccaactttgtcaaaaatgagtggtatgtgaatttgtttctgggttctctattctgttccattggcctatgtgtctgtttttatgacagtagcacgctgctttggttactatagctctgtagtataatttgaaatcaggtaatgtgatccctccagtttagttctttttgctaaggatatcttgggctattctaggtcttttctggttccatataaattttagattttttttctatttctgtgaagaatgtcattgctattttgataggattacattgaatctgtaattgctttgtgtagcatggacatttaaacaatactgattctcccaatccatgaacatggaatgtctttccattttgtgccctcttcaatttctttcatcagtgttttgtagttttcattgtatggatctttcatttctttcataaagttaattcctatttaattttatttgtggctactgtaaatggaattttaaaaaatttctttttcagattgttcaccattagcatatagaaatgctactgatttttgtatgttgattttgtatcctgaaactttactaaatttatcagtcctaattttcttttgtggagtcttcaggtttttccaaatataagatcatgtcagacgaggataatttgtcttctttatttccagtttggttgtcctttatttctttctcttatctgattgctctacctaggacttccagtgctatgctgaagaacagtggtgaaaatgagtatctttgtcatgttccagatcttagaggaaaggctttcaatttttccctattaagtatggcactagctgtgggtctttcatatatggctttcattatgtcaaggtatgttccttctatatccagattttttagggtttttattattaagagatgttgaattttatcaaatgtttttccagcatcaattgaaatgatcatatggttttttgtccttcattctgctgatatgttgtatcacttggattgatttgcatatgttgaaccatccctgcatccctggtataaatactacttggtcatgatgaacaattttttaatgtttgttgaattaggtttgcaggtaaaatattttgttgaggattcctgcatcagtattcatcagagatatcattctgtagttttctttttttgatgtgtctttgtctagtttgggtatcaaggtcatgctgatgaatttggaagtatttcttcctctatttttcagaatagtttcagtaggattggtattagttctttaaatgtttggcagaatttagcagtgaatccatagggttccaggttttcctttactgggagaatttttattatgggtttgattcttcacttgttattggtctattcaggttttggatttcttcgtggttcaatcttggtaggttgtatgtgtctaggaatttatccatttcctccagattttccaatttattggcatatggtttttcatagtagccactaaagatcttttgaatttctgtgatatcagctgtaatgtctcatttttcctgtctcattttattcacttgggtcttctccatttttttcttagtctggccaaaagcttatcaattttgtttctcttttcaaaaaccaactctttgttttgttgatctttttatttgcttcattttgaattcatttatttctgccctaatcttgattatttctctgcttatattaattttgggtttggtttgctctcccttttctagatctttgagatgcattgtcaggttatttatttgaagtttttcttcttttttgatataggcacttataggtataaatttccctcttagtactgctttatctatatcccataggttttggtatgttgtgtttccattatcatttgcttcaataaatttttcaattgtcttctaattcctttattgacccattggtcattcaggagcatataatttaatttgcatgtgttcgtgtagtttccaaaattcctcttgttgttgatttctagttttattccattgtgtgtgagaaaaagaagatgtttgatataatttcaatttctaaaaatgttttaagacctgttttgtgacttaacatatggtctatctttgcaaatgacccatgtgccgaggggaagaatgtgtattctgtaacttttggatgaaacgttctgtaaatatctatgagatccatttgttgtatagtgcagattaagtctaatgcttctttgttgagtttctgtctgggagatctgtccaatgctcaaagtgaggtgttgaagtctccagctaatgatttctatctctctctttagttgtattaatatttgcttcatatatctgtgtcatcctgtgtcagatgcatatatatatttacaatcattatatcctgttgctggattgactctttatcattaatgaccttctatattagtctgttctcatgctactaataaagacataccccagaatgattaattgataaaggaaagaggtctaattgtctcacagttcagcatggctggggagcctcaggaaacttacaatcgtggcagaaggggaagcaaacacatccttcttcacgtggcagcaggatggagaagaatgagaacaaagcaaagggggaagccccttataaaaccatcagatctcctgaaaacttactatcatgagaatatgatgggggaaactgcccccaggattcaattacctccctctgggtctctctcaccacatgtgggaattatgggaactacaattcaacatgagatttgggagggaacacagccaaaccatatcaccttttttgtctctttttatagtttttgtcttgaaatctattttgtctaatatgagtatagctactcctgctcttttttgatttctgttgtcatggaatatctttttccatccctttatttacatagtttatatgtaaagtgtgcttttttcacttcaaaggttaagtgtgcttcttgtaggcaacagatcattgggtcttgttttttcatctattcagccactctatgtctttagattgtagagtttaatccatttatactcaatgatattcttgataagtagaaatttaccctgccattttgttatttgttttctggttgttttgtggtcttctcttccttatttccttcctttctgtcttccttttagtgaaggtgattttctctgttggtatgatttaatttcttcctttttattttcttgtgtacctgttgtttgtttttttgatttgatgttaccatgaaacttgcaaatactttcttataacccattattttaaactggtgataacaatgattgtataacaaacatgtaaaaagaaagaaaactaataaaaactctacactttaacttcatccccctgttttttaagttttattgtatttgtatcttattaaactatgtttgaaaagttgtagtagttattattttttattagttcatcatttagtttttgtacttaagagagaagaaacttacacaccatgaaagcaatgttataatattctgagttattctgtgtgcttactcttatcagtgagttttctactttcagatgatttcttcttgttcattaatatccttttttctttcagattgaaagactccctttagcatttcttatagggcaggcttgatgttagtgaaatccctcagcttttgtttgtctgggaaagtttttatttatccttcatgcttgaaggatatacaccagatctactattctagggtcaaatatttttttccttcagcaacattctacccttatgtctctctctacctcctctttaaggccaataactcttagatttgtgtgttttctgaatcttgtagggatgcttcattattttttattcttttttctcttgtcttttcagtgtgttttcaaatatcctgtttttaagctcactaattctttctctgcttggtcagttctgctattaagagactctgatgcattattcagtacgtcaattgcacttttcaactctagaatttctgcttgattctttttaattatttcaatctctttgctaaatttataccataggattctttttttttttttttttttttttgagatggagtcttactctgtcactcaggctggagtgcagtggcacaatctcggctcaccacaacctctgcctcccaggttcaagcaattcttctgcctcagcctcccaagtagctgggattataggcacccaccaccacacctggataatatttgtgtttttagtagagagggggttttgttggccaaactggtcttgaactccagacttcaggtgatctgcccaccttggcctcccaaagtgctgggattacaggtgtgagccaccatgcccagcctatcccatagaattctaaatttcttctgtgtattatcttgaattttctttgagtttcctcaaaacagctattttgaattctccgtctgagaggtcacacatctctgtttctccaggattggtccctggtggcttatttagtttgtttgattaggtcatgttttcctgaaggatcctaatgattgtagatgttccttggtgtctgagcattgaagagtttagatatttattgtagtcatcacagtctaggcttctttttacccatccttcttgaggaggatttccaggtatttgaagggacttgggccccaagtccaataatttcatagtatttgcagacttgcgaaggtaattccttggtggttttggataagatctggaagaattatctggattaccaggcagagactcttgttctttttccttactttatcccaaacacatggagtctctctctttgctgagccatttggaactaggaatgtggtgaagtaagcagcctgtggccaccaccactgaaagtatgctgggtcagatctgaacccagcagagcactgagtcttgcccaaggcctgctgtaaccactactgagatgtcacctatgttcacttaaggccctagggctctatgatcagcagatagcaaaagccagccaggtttgtgtcctttccttcagagtggcaaattcccctaggcccttgatgggtccggagatgctgtctaggagccagggcttagagtcaaaaaccttagaagtttgcctgatgttctattctactgcagctaagctggcactcaaaccacaatataaaatccttcccactctttcttccctttttcacagccagagaagcctctccctgtggccacgaccaccagtggcccatggggagttctaccaggccactaacaatgttcacttaaagaccaacatctcttcagtcagcttgtggtgaatgctgccaggcctgtgggctcttttctgcttcagagtaggtccagaaatgctatccaagggcctaggcctggaatcagtccatggttctctgtgtgctgttgtttcttgtggatgcacatctatgtctttgctttgaaggattagttattcgttccagtcttctctgttcagtttgtttgtttgtttgttttattggatagatttgcttacaggttctttactgcccagtcactgactcctttttggctctaggtgcaccttaagcctatgtttgcctcagctctagtaaacaatcagagagctgcctttcctgaatgagggaggtcccccaaaaaatattctggcagtgtgggaggctggctagcagttcatgcccaggggcctgtgggacaaacctcctacagcacagggctgctgaataaccatagaaatgtggcatcttctttggctgagttacagagcagagtttccagggctggaaatgggagtcctgcctatccactttgtctctgcttgtcctcaaggatatttcttccttcaggcattcatgatgctttttgtcagttaaggtagggacagttctcctgccagggaaccaaagatggtggagaagctggttgtacacctcagtttcactttttttactatagaaaaagtgagtttgggggacatttttcacacacttggttacagggagaaagtagggaggggcatcatgaatgtggaagtctaattctcttactgtccactcagttattttcacctttctgtggccccagggagtatctcaagttcatatttgagttctgggatatttctggtaacaatcttggtgctgtatatttagtttgggttttctgttatgggggatggggaaggtaaagccagattgcttctatgacaccattttgattttggaattggaagtcacttattccttttacttaactctattttcgtacccattaaccagcttcttttgattcccctgtcctgcctacacttcctagcctccagtaaccatattctactctctaccttcatgagatcaactatctcagcaaccatatatgaatgagaacatagggtatttgtttttctttgcctggcttatttcacttaacaaaatgtcctccaggtctatccatgttgctgcaaatgacagaatctcatcttttatggctaaataatcttccattatgcatgtataccatattttctctatccattcatccattgatggacacttagaaatgcagaatcttgtccactattcacagtagccaagttatggaatcaacctaacaagctcctggtggtacagatactgatgattcctgggccatattttgagcagcaagtatttaaaatacagtagtacctgaatgcctctaagtcagaataaaagaaaaaaataataaaatacaatagtaggctgtagagttcagatctgtgattttcaaagtagggttcacagtcagacataggcagtgaggatccttttatggtgcaaataaagtataacttaatatattttaattttcatacactaataaatgctgcttagtagcaggagttcctactgagaagatccaattaccttgcagtgcttggtaattacgtaaaatgtgttcattcattcaacaactgctattaagcattgtctgtgtgtgaggcactgatgtcgtcactgggagtgacatctgaacaaaacaaacaaaaactccctgctgtcatagagattacattttagcagagaaaaatataataagatatgcatgtagttggaattcctatatgtttaggaaaatatacttttttttttttttgagacagagtcttacttcatcacccagcctggagtgcagaggcacaatcttggctcactgcaacttctgcctcctgagttcaagccagcctcccaagtaactggaattacaggagcataccactatactcggctaattttttgtatttttagtagagacatggtttcaccatgttggccaggctggtctcaaattcctggactcaagtgatctgcctgcctcagccatccaaagtgctgagaattacaggtgcaagccaccataaccagctcttttgtgatattctttctaaacatctagatctgtatgaagaaagaatacagaggaaataacaaatactagttaatatattaatgatagaaagtattacctcatcaagatgtagagagctcttgcacatgcattgcctgagtatcagatatagaagctgaaaaaaatgtgatatatagtacaaaactatccagtcaatgatgagcaaaacataaaggaggcatgcttccaacatattgaaaataaaatgtatcaagtaaatgtatcttttctaaatatttttatttagagaataaaatcatgctgctaataaagacatacccaacactgggtaatttattttaaaaaaaaaaagaggtttaatagattcacagttccacatgacttgggggacctcacaagcatgacggaatgcaaaggaggagaaaggcatgtcttacatggtggctggcaaaagagagagcatgtgcaggggaactgcccatttcaaaaccattagatatcatgagaattattcactatcatgagaatagtataggaaaaattcaccccccatgattcaattacctcccaccctgtccctcccatgacacatggggattattacagttcaaggtgagattcaggtggaggacacagagccaaaccatatcaactcctattcccataagcctcaataatgtttaaagtgatacaaatgccctataatctaaagaaaaatagaagcgtagaaaatttcataagaaaattttggccaggcatagtgacttacaattgtaatctgagcaatttgggaggcttaagtgggagaattgcttgagcccaggagttggagactagactaggcaacatagggagacccccacctctacaaagaaaaaaacaattaaaaaattagccagctttgtggcacgcacctgtagttccagctcctcaagatgctgaggtgggaagattgcttgagcctagcaggtcaagtttgcagtgagcagggatcacaccactgcactccagcctgaggtatggagtgagattctgtctcaagaaaaaaaaattgtaagaaaatttgaaataagcagaaatggttatggttatttttaatagaaattatgcattgtttagagcacactcttccaagttattcgatgtaagcctttcatcaccattgagctattttaaacttttaaaagttgtaggtgactgatagcaaagcaaaataattgtctatgcataattctagtctatggatatgcaataaattgtgtctagtggaggttcaattaacttcccttccccatgatagaaagtcagttttgcaaccacttgcaaattcatttcaatattcttgatatataagtgtcttcattctttgggttctctctcgaatcagttgaaaaagtttttccaattctctcatttaattaatgagttgaaatctttgacatctgttcattttatattcataggagtcatgatgttacttttttggaaaattatcttttacagatttatgaaacaaaacacatcaccattttcaagttgaaaagaagcttcaatttttacataaattgaatctaatcattcaattaaatttaagtgaatttacatattcctattatatattccaagcatagcactcttgtatgaaagcattaatccctggatagatggactgacagctcaaggtcattaaatacactgtttttccatagtgtccccagttttgataacttctggctggaaagttttccaggctagctgtttcagggctagggaaatctgggataaagtcatagagaatgtgaattcatttgtcttgctttgtaaattaaaagtcaagattgacagtaatgtaattttaaaaataattgcttgatgacaattcaatagctattatacctgaataataattttacaatttacatgtcacaaataagtgaagaaaaagaaatacaccctccagcccaattcttcacatttgaaaaaatagacttcattaaaattagaaacttctaagaaagacattattaagataatgaaaagatatgccataaacttggagaaaatatttggaaaacgtatacctgataaagcacttgtatttggaatatataaagaactctaaaaactcaacaatatgaaaataaacaatccaactaaaaaatgcagaaaagatccaaacagatatctcaccaaagaagacatacagaaggcaaatatgcatacaaaaagaagttcaacatcatatctatagagaattacaaattcaaacaacaataaaatatcactacacacctgttagaatgggtaaaatcaacaccaaatgctgacaagcatgtgaaatgatagtaggtctcactcactgcttgtggtgtaaaatggttctgcaatttggaagataggtttgcagttatccagaagctcaaattatgtctataaatatttcatatgtaatattcaactctcaataaaaaatttccaggtatatgaagaaacaaaaggttataaacaaaagcttattaaaacgaagagaaacaacagacagtagaaacagacaagttgggagtacagatggtgggtttttaaatattcatgcttaatatgctcaagaaataaatgaaaaaattgtaaatgttagtagaaaactgaaaattttaaggaaaaaacaaatggaaattctagaactgaaaaatacaattgatattaagaagtcagtggatagattttacagatatagttaaataaatagtgaactgtaagatacatcagaagagaatattcagaatgaagaagagcaataaatagcaaaaaacataagagacatagagataaaaatagaaggtacaagtaattggagtctgatgtgcttggctctgtgtccccacccaaattccatgtagaattgtaattcccatgtgatgaaggaggagcctagtgagaggtaactgaatcgtgggggcagacttcctccttgctgttctcatgatgcagctctcatgagatctggttgtttaaaagtgcacatcacttccccctttactctctctctcctgctctaccatgtgaagaaggtgcttgcttagcctttgcccttcttccatgattatgtttcctgaggcctctccaaccatgcttccgctacagtctgcaaaactttgagtcaattatacctcttttcttcataaattgccccgtctcaggtagttctttatgtcagtgtgagaatggactaatacagagtcatagaagaagaggagagtgaaaaaaaatcacaagaagaggagattgagaaaaaaataagaagaggagagtgagaaaaaaacaataaagaaataatttcttgaacccgggaggcagaggttgcagtgagccaagatcaggccactgcactccagcctgggtgacagagcgagactccatctccaaaataaaaaataaaacaaaaaacaatggttgagaattttccaaaactaatgaaagacattaacccacagaatcaaagagctgtattcaatctaagaaggaataaaacacaaacagtaacacttctaagtgcatttttttttgctaaaaaaataaaaaaacaaaaaacagaaaatattttttaaaaaaaagtcagaagggacctcaacaaaatactagcaaaccaaagtcagcagctaatgaaaaggattatacactatgactaagtgggatttgttcctggagggtgttcaaaatacaaaaatcaaacaatgtaatataccatattaatagaatgaagataaaaatctcacatgttcatcttaactgatggaaattaagcactcaacaaaattaaataccccttactgatataaattactcaacataataaagcctacacagtagatattacttgtattggttcatgttttatacagtcagtgtttatttgtataccaatttcatttttcactgttcctctttcttctcaaacttcctttctggatttaattttttcttcctggaattcgtccttgagaattcctttagtaaggcccattgatgttaaactctttccaagttttgtttttatgaaaaatatattttgctctcatttgtgaaaaacttacatgattctatgttgaattattttgtctcagcatgtagaagataccattctactgtcttccatcttttgttattgctattgagaattctgctggtctaactgcttctttgaagttactctctttgactgtctacctcctttaagtaccttttaaactttcagattctgagttttactaaatgtatccagatggcattaaaaaatttttttctgccttgggtttcattgcatttcatgaatctccaaattcatgcccttctctctccttaaaaatttaccaatcctgaactattgctcaaataaatataatctctaaatatttcctatttcccattttatcaattctctccttttgaaaactccaattaatttttttattaaaccttctcattatatctgccatgtttctaaaactcctttcctagataatttcttcttgactatattctagttcactacttctctcttcatttgtatctaatgggctatttaactgttacactgattttttttctgaccataatttttaatttaggaagtctggttgaacataaaggaagcctatacactggaataaatatgaagctgctgcatatgattcttattccaaaataaggcctaatcagcattaggctgagatcttcattggtggcataagaagttcaaccacttgagtggacataatctccaaggtggaatggacctggtaatggactggatgacatgctggactttaggaatatccacaaatctgcatgaggtctctcctgctacaggccattggtgtggaagagaagatttttctaattgaggttgattatggaatgaaattaaagggtgggaaggaaaggttttcacatatgatcagagaacagagataccactgtgtggtcaccaacaaactttgtccccttcttcctctccctctctctcctacttttttctcttcctcctccttgtttggagaagcagttcaaagcagattcaccacttcttggggcagacatgagcataggcatcttacccaattgagttggatacttgcagttcaggtcatatttaaataatggttgggaaaacaaatagtgtggctccttctagtaggaacttcacctgcttttgtcttcgacactctttttcttgatcagcttttcctcctttatatatctttttacaatttgttcaatctctgttcaatttgcagaacagacaccacaccctcaatccaagaactgtgcagacattcctggaagttcaaatactcagctttcttcgtaaagcaaaatggatttgctccttgaccacattcatgcactttatttctagagggctctgtaaatcttattaaagttgatcttgtcctcaggcctaatcagcattaggccgaggtcttcattggcagcataagcagttcaaccacttgaacggacataaatctccaaggtgcaatggacctggtagtggatggcatgctggactttaggagtatccagatcctaagctgccacatctgttcccaggagaacagtcttccatacaggcaagccactccaggtatctgactctctgcttgtggtgcatgcgagtatgtagggtcagcagcatttaggactttgaggagcctagaaaggtgtgtgatgtaagagatgttgttggcaaacactaaggtgaggcctggatactgcatcaggaagtagtacaggtggaagtctttctcatcagtctcataatggatcttggtatctgtcagcaactccattgtgacttcattgcttgtgggggtcaatgaccttggacttgcccctcgtgccaaccttctgcatgagaaggtcgagtttggcagttttgtccattttcttggtgtgcttcttataaaggattcatgcagcagcttgatgtaccagcatcactgcgacacaaaaatccaagtgtctgtctctctgggttgtattgggagtcatgaacatctctagcaactgtgagagctcagcaaagtagcctttctcaatcatccagtcagccccatctaccaccaggcacctgaactgctgaaggctgctcaaatgaaggtgattttctttaaccagctcccacagtcagcttgaacggctgatcacaatatcaggctgacacctgagcatcctctgctatttgtgcatgaatatgccaccgaacaaaatagcagttttaattcccataaacttggctgcagcatcaaagggttattagacctggatggccagttcttaagtgggaatcaggaccagtccaagcaggtgatgttttagatgtcctttacaggtagcaactttgccattcaactcttgttttgacattccagtttgctctttatcaagcctttcctctttgtcctcatgccttgttaagggaagaaagttctttaccagcatcatcatcatagaagaacagcacctggtttgagggggaagctctggtctttgctctggccttgttgggtggtactctagccttagctcagcttcacaggggagtatttcactctcgattccagtctcatcaggcaacattcccgactcagttccagccttgcttagtgatccagtctcagctctggactcagttctgggctctccaggtggtatttagtgttacttggagttagggcaagcttactactccagcactgccaatactgcttgaatcactggaatgacaaagacaagagttttcccatatcctgtctcagcatccccaaggatgtctagtttgtcacagatgacaggtgtcaaagtcagggcttcttagactggtgtaggtgcagagaaacctagaaaacctgctgcttggagaatggcttggacataaaaagtccttcaagctgatacattcaccttctagtcaggcatcagtgtctttgctttttggggcacctttgggacagtgccatggggaggcttaattttttccctttttcttctcttttggaacaatctgggccgggctttctgatgccctctcctctcctctgggtcaggacaaatcataccatctccgatttggctctggttcagcatctttgacttcaaactctttctggacactaattccttcagtttccacatctttacttttcttcaacttgatcattttctttgaggagctacactttacttcctcctcttctcaaacagctggtgcctttttcttcttggatgcctcctttgagaagagactggaggaattcttggcagaggggaccaaccagtaatctcagttcctcaaagcataccacatcagccatctgtccacttacaaacatatttgggtctaccttcacttgcttccatttccccacaatcttgattcctttcatctgaaacttccaatagtttgatggttttgatcttgattttgtctccttcagcttcatggttgcatttggagatggttatcacagctccttcagatgctggctgcctcctccactgagttttaattatcatatttttcacttctaaaaattttgattccttttcaaatttctttatttttagtgcaaacttttcattaaattatgatacatagacaggccgggcacagtggctcatgcctgtaatcctagcactttgggaggctgaaatgggtggattgtctgagctcagaagtttgagaccagcctgggcaacatggcgaaaccccatctctactaaaaatacaaaacattagccagttatggtggcacatgcctgtagtctcagctattctggatgctgaggtatgagaatcgcttgaaccccagaggcggaggttgcagtgagctgagatcacatcactgtactccagcctggggaacagagcaaaactctgactcaaaaaaaaattatgacatacagaaaagtgcacacattatgaatatagcttgatgaattttcacaaagtgaacacatctatgtaaacctcacacagatcaagaaatggaacattcccagaaatccagaagttatcttgtgctctttctactcttctcatggtaagttttacatggttcagaactttatatacatctaatcatacagtaattcctcttttataatctacatctgataattccattatttgaaatacttaggatctaacttatttgttcattctattgactttttaaaaatttttggattttgagctcatgtatagagggagttctgtgaggaatcattccagggaagatcagtcttgtttcatccaagattcccaggaagttaccaactcagaattctttaagtcaacttctggcctcaggatttctagggcccaaacacaagttcaaactccactctacatgaatgtaagattatggttgcaaattctcaaggggacgtttttcatcttgagctaagtccttgaaaaccaaataaccttttaatttcctttgactaaggggtagattttctatctcttcctttcattgaaaatgtgatcatttgagaatcttggttttatgtaactgtcttagttccaactccctaccttacatgaaccaaagccttgtcacttgtcctctatttaacttaaaattaaaggtgtttctgcttaaccacaagatataatttagcagcaccaatgataatataaactgttatcatgagcttcctaatatgatgaatgagaaatatacattactaatgtaggagtttggctacaaatgtttaacctgaatctaataatgagaaaacagacaaatccagattatggcacatcctctaagacattgacaaatggcaatgttaaaaaagttcagaaattctctgcaaagacttaatgtttttcttcttaaaattcagatttgagaaataatttgtttaggatgtggtgtggaaggatagaacaatggccctcccaaagatgttcacatcctaatccctgaaacctgtgagtacattaaattacatggcaaggaggcattgagattgcagattgaattaaagttattaattagctgaccttgaaatacggagattatcctggattatctgagtgggcccaaggtcatcacaagggttcttaaaagggaaagagaagcagaagagacccaaagaaatgatattgtgagaggaacccagcctgatattgctggcttagaagaccaaagaatggagtcatgaaccaaggaatgtgatcgcctcaaaagctggaaaaaaaaacaaaaaacagattctctcctaaagactccctgccaacaccttgattttagctcagtgtgacttattttggacttctgacctctagacctgtaagataatttattcttttaagctaatacatttttgataatttgttatagaagcaataggaaattactaaaaattagatgtgagggagaagaaatcaccaaaaggattagtggaatggaggtgcaactcacagaaatggtgaagccctgtgatgaagccttcccaatgaggtttgggaaagaggaaatgaatttaattttgagcacaaacctgggacaagaggcagcctcatgaggggcacaaagcagcctctttcttattacagctctgcctctttcaagctgttccaacttggacaagatacataaaccccgtgtctcaatctctttgcctgaagtggggataataatagcaccctgataataataatgccctacttcatagggtattatatagaggaataaatgggataatttatgcaaggtctttttacttggcatgtgctcaaatgttggttaataatgatgatgatgatgatatagaagacacacttctgtgcagtgttttagtcaccacaggccactaaacaaccatgtttcatgactatatggtcagtataggaatgaagaatgtaaattaccttgcttccttgtttacgagggttgtcaactgtactatttaaaatattctagacgtgtgtatatatgcagatgcaacttcattcattttgaaaagtaattctgcctttattttgattagtttctttgggtgtaacttgttacttgctttctgcgccccacccccacccgccttctgtttttgttttttgagatggggtcttgtgatgttgcccaggctaatcttgaactccttggcccaagtgacccttccaccttccacctcagcctcccaagtagctgagattacaggtatgtgccaccatgcccagctgcattcatttttattttattttaatttatttatttagagacagtgtctcactctgttgcacaggctggagtgcagtggcgtgatctcggctcattgcaacctccacctcctggctcaagcgattctcctgcctcagcctcccaagtagctgagattacaggcatgtgccaccatgcccagctgcattcacttttaattttctttatttagagatggtgtgtcactctgtcacccaggctggagtgcagtggcacgatctcggctcactgtaacctccacctcccggctcaagcgattctcctgcctcagcctcccaagtagctgggattacaagcaccagccaccatgcctggctaattttttctatttttggtagagacagggtttcaccatgttggccagggtggtctcaaactcctgacctcaggtgatccacccaccttgccctcccaaagtgctgcaattacaggcgtgagccaccatgcccagccatgcattgatttttagaattgatattttgttcctcttttaagccagactttcgatttgcttttacaatatctatgcagctggcctaaagtccagtgagaatgttatcctctgagagcactggagctgggaaacaactgtgtccaatcctgtggcctggacctacagaagggtagaaagtgtacagctgcaggagatactaaaatgcaacttgcttaagtaggacttattatcactataccctctttccattaaaagctccatgtccttctagggctgtgcttaaaagactacattttctccttgaaaatagagctcctccaccctggggtaaagggcaggtatgtacacatttctggaagtgagtttatcctagttgctaattaaacacaaagtttgacaaggtgcttgtcctaaaagagctcaaagtctggtggaagactggcactcaaacaattaacaaacaatgatataaaaagtttgtttcaagaagaatgagaccaagtgcttcactttaactggggagacccatggaacaagggtggcagcatgacaaagcgcaatcctccagagggaagtgtaaaccaaagtcctctggtaaatgggaggtctgtttcccaattcctatccactactttgttatgtattaaacttactccattttccaaaaagtatatagaataaagtgactctcaatcagttagaacccaaggttgtaaaagaatgctatttttcaactctggatggaaagatcttactgacgaacctctgggctgtttccagtttggggttattttgaataacctgccatgaacattcatctacaagtctttgtgaacatgtttttattcatctcaaataaacacctaagagtagaatttcctggtcaaggacacgtgtacgtttagtttaaaacttttattagcaggtactcaacagagatgaagtgagattgtttaaaaacatgttggctaaaatgaaaagattttttctttttgtgatcacatcaggtatctgccaaggatagcaattttacttaaattttttttaaaaaacttttactataatttccaaaactggaatctcctctaaatcaaggagaatgtcttaactgacatgtgagagagctattcatttgtaaactgttgctctactggatccactctgccatgttgtgccattattaacatcctatttcatacctctttttaactgagtcctctgctcttcgacatagaatgattgtttggttggggaaacttgtcataaaagaaattcaaactattggcaaaatcctaggatgtaccctatcaaaagctttttgttgatcacctccctcccctatcaaaaaactttttttccaggtcaaaaatagtcctttcattctgaaggagaaacttctttaccggtcaccttagtaatattctaggattttatccttcctgctcttatttctaagacatttgcttgcaacctaagtagcctgtgatgcaggatctccaaagtgtttctttccctgttaactttaatgagttaactcattaaacactccaacagagcaatgccaaattatctaaactggtaacagataccgctaatccaaacattaaccaactgcctgtagaaattgaggctataggctgggcgtggtggctcatacctgtaatcccagcactttgggaggctgaggcaggtggatcacgaggtcaggagtttgagaccagcctggccaacatagtgaaaccccatctctactaaaaatacaaaaattagccgggcatggtggcacgcacctgtagtcccagctactcgggaggctgaggaaggagaatcacttgaacctgggaggcggaggttgtggtgagccgagattgcaccgctgcactccagcctgggggacagagcaagactccgtcacaaaaaaaaagaataaaaaaaagaaaaaactgaggttataacccacatgtgttagaacaaggacttaggatgccatccgcagggcacttttgagactagactggcaaaccaccaaagctgagatgtcagggcccctgtaggctttatttgcatatgtcttagtacgttcttaacctttgattagagggtggaaaataaaagatttaacttgccaaccaaaactttcagcaacgtagaatactgaagtcagattctgtctgttggaaaactagaaagaagactcctggtttaaacagggattctagaaagtcagaaaggagacactgtgctattaactgaaatggacacaggcatgatttcctatgttacagtacctgccatcagaaaatctcagtaccctttatgagaaggccctgagaaaaagcttttttgtaattggaaagaaattataagatagaaggcagaattctccatgttttagtcaaagattctcctgtgcatttatacaaagctttcacctaaaagtcaagacagcacattcttgtcattgagaattcagaatagagagtctgaaagtacaaatacattcttatactaacattaggctcttagaggacataaatctttttataaaaaatttatttctctgtaaatacaaattccaacatcaacaaacaatagtccagtggaaaaatactagccattaacattgaaaacttttttcttaatttaataaatagaactttggcattcaaaattctagctgtaaaccctattaaaaaacagaacaacaagaagaaaacccctttacaaaaaaagaggcaagaatgatagatcagaaggcataagccaaccagtggcttcacattctttttttttttttttaaacaataactgtatttcaattaagtcatgaacactgtatttacacatgaggtattctgggtggttcaaaaactgaacccagcttacaaaaccaccagtcatagtgactgattatacactgtgctgtgctttttaatgtaaccacctagcaccttactacttcttgtcatcacaacaatgcgatgttaagttttatgtttatgtatttaactatttatacatatatgtacatatacatacacaccaatgaatacaatctaaaggagtttccagctcactacacagggaaggctgggctccaaagacatctatctgataattcccctcatgtttactaaggtatccacctagtaacaaaaaacggctccttgctttaaaaaaaaaaattccttaatcaagtttatatacagaagaacaaggtgcaataatcatcaacattcttagaactcatgtaaaatagaaataaatgcttactgcaggcaaaaaggcacaaaaggttctctctgtgtacagctgcaatagtgttattagacttgctgatttaaaactatattcttatatttagcacttttttaaataagaaaaaaaatccaaaatctttcccatacatgattaaatatatgatataatcatatggcaatatgccacccatggcattttggggcaaagttggaaattttgctctttataccaaataggaaattgttcctgttgttttgtgaacatgaattgtcaaaaatggaaacatggcagtttcaaatgatatagtctgagtgagcatggttatgaaaattgcttattaccataattacatatctacaatgatataattcctacgtaagagaatgccaataatccaaactaaaggtgtgcctaagctgaactatgctgtgaaaatatagtccatgttcttagctactatgttacttaatgaactattactgatatttaaagaacattttcccaattaagtagctcctttaaaaacatcctctaagaaattaataattcttgcactatgaaagaattactttataagctccttagtatatcagaaatgtatgacattcattttagcaacactttccagcccttgagattgtctctacaacaagctattgaaagaagtctaattaggtttaataaactgtcaccaccaaaataaatttcactaaaatataatactgttagcattaaatattgaatcctaggtgccacacttcttttaaaatgacctcaggaatatcttacctagccagtatttgtggttttttgtttttgtttaattagaggccactgaaaattaatagttcaaattaagccattttacttttctgagctcaagtgaaaagatagctattgtgcctttgattcagtgaattttatctgtacaggcaatttgggtctttcattgagtcaactgttactttatgcttgctgtaatgtgattgaggctgaataagctcaactttaaaacccaaaagaacaaaatattaatactggataagatactttctaagcaaacaagtgttggattcacaaaaagcacaattaaaacgaggtttcattatctaagtaaattttcaaatagattcactttaaaatttaggttaattttcatttcaggaatatattggtgtcataacttccacgaacatcctagttcaaactgggtgagatgctctagtgttgctatttgcccatcttatttggtctaacagtaaaatctgtttttaatgtgatacagaagaggatattctaatacaagagggtgtcctgggaaaggaaaattttctgaaaaataaaaatcaaaaagtaaatactgacaaactagatagaatactattagtttcaattcccccacaaaatccctccaagtctatctactgtttatgtaggcccctttacaaactccagattttaagaggatcaatctataattcagctaactacttaaactagcacatcttaactcccttttttatggggggagggtacagattttggaaactgaaatgcatcagcagtagttttgttaacttcctactaagtcagaaattttttaactttggaattttatttttaagatacgtgaattaaattactttctctaagttttagaaagctaacttacaaataaattattttatccccaactaagccaaaaaacaaaaacgtatctatagtagattaaaacaaactgtaacgtctgcttaaaaaaaaaaaaataaataaacccataaaatcccaaaacatacactaaaaatctaggagagatatttaagtaagaacctactggtccaattagtgattgtttgccaatttgttctattattttaggaagcctttatttctaaaatcatgggggagggtggttgggattctattcaaagagagtgtaaaaatatttgctgcacttgtggctgatctattttagacgttattatctgttttaccataaaggaccaaggcagaattcttcgcatcacatttttggtggaaatttactataccctgattatcgtcaagctactaatgttaaaaaccaagtgaatataattagaaagccaagttcttaccagtgactaagaccctccttaggttaaggactctgggatgcaggagcactacaatgtacttactgatttcttagtgcccagattctcagaagtaagaagagcaggaaggactcagacaccaaacagaaggaaaatctgatttctttacagtgtattataactgattattcaactataactataaaataatctattgagagctgtatagccaacattttaaactgtgtatcttcctgggtagtctccttgaaggccttgtctcacattttcacttttaaatatttaagaaaaatctttcctaggagagcctttattctagtatataagaaaacaggcatgtgctatgccctttatctggcaagaaaacaggcatgtgatatgctctttatcaaatcaatattatcctgcttgagtcacaccctctacccctccatctcttatttagtcttgacctaaatgagacttggttgcatcacaagatcaaaccaacttacaaaggacaaggctttcgccaaaactaagtatattcaaaagaacataatcaatgctgaaggcaataaaatgtataatccttccaaaataccaacagaaacatggacaacactcatttggaagtttaaatgactgtacgtctactgcaaaatcaactgcatttcatagtaataccctgtaattcagattaagaactaatttcgccaagttcatatcctgtgaaaaactgttgttaatgtactttaacaaaagggattaaaatacaatctcaattaaaaaatgtttatgctactgttgattcagatataaatagtattggctttctcttacagtagtttcaactttgaaacatacaaaactgttaaaatgtaaatgttgagatttggataagtaagctattgttccagggtaactttgttaatcttccttttataataatgatccaatgcctttattaattatatatggctttgtttacatttatatatgtatatatataaaacatataaataaaaaattgtaaatagtaaggaacatgttaaaattagttcaagttatgttaacctttcttgtaacacatacattacaatgctaaggaaaaagagcatcacgtcaaaatttcacacctcttgggaaatccacaatcactctggaaaaacagctgacctatctacagtactaaaatcagctcaaccacaaacatcctatcagtgcagtaagtgttcaaaatataaatggttttgcctcctgtactaccatgacaacacttgcctgctgtttgaactcttgttcagccagccactgaaaatcccaaagtacaacacaagcttctatatgaaagaaatataagaataaacagcgtgtgcctttctcagaagctctgctctgaccctagaaacccttataaatttgtgaataaagcacgtgcacacacacacaacaacacacatacatgcacacacaaacacacaaagctataggattaaaaggaatcctactccttcatgtgaagggtactcttcacagcttggtcctacaatcagtagtttgagaatatagacatttttttccttgtagattttatcatattttccaaaggtaatttgattttttttctttttgcctgattagataagccccttcaaaatctcttcacttcccttctccccttcaacaaaacaaatccacagaaaaaaaatccctaagtgcaagtcatgtcacttgcaaccttccattatggctccataacacagcagcatttaaacaacaggtcattattgctgtgggactaacacttgatcactgagtaatgcagttgtctcccatgtcctgagcatagcggtctgatattgtagtccttaattcatcaatgtctcttcgtaactggcacacatctgacagctttttagtgagtgtttctgtgctgtggtcattctcagtctcttcagctgaacagttcattgctgtgtaaataaaacatagagagaatatctcacatttttttgaacaaagacattttagaatttttcaccttaatcatcatggaaatacagtgctacacactgaataccagtgaggctcaggttcaagttatgtttaaatcatgcatcattcaatattaaacagatcttatccacttggtcctttataaatttcacaaattaaactgaattaaatgcacacagtgatacacacaaattcagcatgtttaatgggtaacaatattccaaaagtgaaaaaaagcatactctaatgtctctcttcaagctcaactagagcactcagtttttcccatttggcaaaatctgaagaccatttgtgtagtaagaggtggtatcttacatatttacgactgcaaagtgggtttactgccatgaaaatattaattttcaaatacatagtaagtgtcacacacacacacagagggagagcggggagggaaaatgagagagacagagagggagaggaagagggagaggaagagtgaaagctgggaccctacaatcccaaacaatttaatcaggctgatagctggttgcctaatggctgaataactgagggccttgagtcagccagcttttagttatttacttcagttcttctctttgtaagcatatctcaacataaaatcaggcagagccagtgattacaaaagaaacctctccttataccttcatagtagtttattgtaggcataagagtcagtgagtgactgttattttaacaaatgttaactgaacatctgccatgatataggaactatgttagatgttgaagtcagaaaaggaacagacacagtggcttgttctcgatgctttacatacaatttcataaacaaatgaacacagtgaggtactgtgggtaacctaccactatatacaagttgcagtggcataaaaaaacaaacaactagtcctaactggagaggtaacagttgcttgttcactgggttggccaaactgcaaaatgaacaaaagtggagtcagaaagcaaaacagtatgatagaatttgagaaacctcaagaaaatcagtatctagctctaaaatggtagagtacaaactgtgacaaaggagagtaccaagaaataaggctatagaggtaggtagtagctacctatcttgaccacagagcagtgtaggcattaggaaaccaggttcatagtttagacagatctgtctggcaacaatgtaaaatggattagggggaggggatgagaaagatggttgtcagagagaccagtataggtgacgggttatgaaaacttaaattaaggcaatagtgcaatggagatagaagggcaggaatgttagatgtagtaagcagatgacagaactgatagcactcaatcatcatcaacttgagtgatgggcagggattgggcacaggcgccagatgaaggaaaaagcagagtggagaataaattctgggttcaagtgacaggtgaatggtggtgttactcactgagaagaggaaccggttcagggagggaaggaaagtgtgttctggttttgaatgtgtagagtctgtgatgcatttgaaatagccagttctaatatacatgggaatataatctggagcccagaggagataaatgtctgggtaaaggagataaatgtctaggtgaaaggtatggcagtaacagaaaaaacaggagtggataagatcactcagataaagtactgaataaaaagaaacaaacacaaaaccagtaacaaaaggcttctggggataccaataattaagtggcagagaagtccacagaagacagagactgagcagtcataaaggcagaagcagaacctagagaatgatgtcatggaaaccaaggtagtgcacagttttcagaaggacagggtgagtaaatggagccatgaagtgactggtttttcacaaatcaactggctggtaaaactttcacaatgccaaatataaggtaaggattctggggtcaaactttaaagactagaaggagtattgggaggtgggcgtggtaagattcacattaggatagctctactactctattactgaaaaacttaacaaatgctaccttatgacagtgaaaatgtaggagactctaaagtaattaaaagggtgaccaactctaaaatcatgaagaaagtgagttccctttgtgtgtgagctttgcttcttgctcccaagagatattaaagcactccatgttcaccaggcaaacttctcctcttcctcgtctgagagcgacactgaacaccaactactctgtggagtctccacagcccttcccacgtagatttagttgtttttttcctcttgtgctcccactgtcctttgtccacatctcaactatagcacctatcagaatgctctaataatttggttaatgtgtggacaaggactgtgttcaggttatctgcattaccagcacttacttagtgtctggaccatagaaggcatctgataaatgtttactccgtgagtgaatatacttaaacattatgtgttttttcgatatccacatttgtgtatgtgtacaaatgtctatgaaatgaaagggacatagttgagcacagataatgtttcatttaacaagtgatatactttggtcaagagcattatttgatttgccaaaataactattatgatgcaaaatggtggaatctttttgatgaaactagaaacaaaatcagtttgtttgaaacaaaaccagtattattaaccataatattaggcagctactaaatacacgttggcccataaaccttattatatggtcttactgcattcctatttccttccaagttcatttcttctctattataaagagactaacatcctgatttggaaccacgtacagagatgagcgtttctgcaaaagtagcacagaaagaaagggacactaggattattactgtggcagctcccacaattatgtgtggaggaagacagaattgaggccaagagtgaatgggtgtcacattaagccagcaggtacgcatgacaaaggcaacagatttgtaggctgtgaaaactggctcatgtgaaatcactggcactcacgtgaagcagctgccatagaacatatactgcactggaaagcaaaaatatttctcaaatattttaccagtggacaatatggttgggtcacttaatctatacaactaacacatgaaagcaaatagaaggaatcattatttttggaagagaaaatgggaagtcacacctaactaccactctattcacatatttacagattcaacataggaaacatcaccaggcattctaccaagtggcagttaatgtcagctataaccctactcacttcttgcaatgaagtaataacaggtatacataaacccacagactgattctaagtaggaaaagagattacaaaaataaacagagaaaaggcagtcggaagttcctgattcatgaagataggtttctaattgccacaaaataaggacaagtcatcagacacttacatcttattcccagtaataatgaaagattaggctccttgccctgagcacgctgattaagaatactacacaatgctttcaagtcaaacaaacaacaggacatttccttgaacagctgatcaatcacagtcaaatcaaatagtggccgtttggaaagaactgtctgctgcctagattggtcaggttcctggccctgatccaataaagagcatgtctcatctgtttgtctttggttctgcaaggataaagaaaacaaacatcagattgttagaacagaggaaaggtactcaaagccatacaggttaacattctcccccaagtctataaacaaaacgatggagtcatattatatgcacattaaccaaattcaactacatatatgcagtgggaaaaaaaacacatagaaaaataacaatttaaatagtggaaattgtttctctgtgccatctgatgctttagcgtatatccaagggaggaaacataaatccagtctcagtttctaggagtctctcacgtaataagcatgttggttgtgtatgtatttttcttttttgggcctcaatctgtcacccaggctggagtacagtggcgcaatcatgactcactactgcagccttgacctcctcgggctctggtgatcctcccacctcagcctcctgaatatctgggaccacaggtaaacaccatgatgcctggctaatttttgcattttttgtagagagagggttttgtcacattgcctaagctggtctcaaactcctggggtgaagtgatctgcccacctcaggttcccaaaacaaagtattaggattacaggtgtgagccaccatacccagcctgtatttttctataatgagatttattccaaggataaaaagaactaaaaagtaactttgaacctcactctgtggtttttattgttagtagcaatagtggtttaattactttgaaactactttttgcatattggtggggggaagcatctatgttaatgttgataggaaccacaaacttcggtgcgagagacaaagaaataacaagtataaaatcaaagaagaagaaaaaaagaaaaaaccaacaactctgaattgctgatccccaaaactgctaccttcttatcttgaaaactgctaattaaaggtaactttaattagctttccaattggaactgtatttcagaataactcaatagcctggggtgattggaaaaaaacttttttatagatgaatgccagctaataaatataataaatatatactgtactataattatgtgaaactgtattctaaaacacaaaataaataaaggtttgtctttttataataattttggtaagaaacaatggaattaattaacaggcatatcaaaatcatgtctttaatctgaaaatgctctattaatatctataaaataagcattttatagtgaatcatcctttcaaagcaaaattgaatttcttctactcacttcaagcaatgcttttgttaatctctgtacatttctttctttcttttccagctcttccatcatcttttgagtggtcagtttctctttagaaagctttccttgcatagactagaatttttaaaaaaattggaaagcaaaacaggttaacatgtaaagaaaaatctcaaacagaaagaagtaggaatgttggctctgaatactttaaatcttctttcctccccatccccttggaagatgaagccttcacttttaaactaatccctatcagttagagagtggctgaatccaaataaaaaagaaaaagaaatgctggtttcccagaatacatttggatttttttaaattacagtttttaccaaggaagtttttaatttgtataaaacatgtcaaatctgaagttcctacttaatatggtattacaaacagttcttatttcattaactttttatatgtagagagtgtattagcaacaaatctatatttttgttttacattttgcttacagttaatgagatgcaagataataagatcatgatatcatccctattttctatcatttgaaacatagctcccgtctttcattgtatagtaatccaagcagtgaatatactgtgaactctgggtcaaaggtctattatgggaatttgataagctaatctccttcttactccttataaaattgcaaattacctagacatgacactattgtgagtacgccaaagcagcataaaggacattttgagtctttggttagtcttttcaccaatatattaaaagaaaaaattgccatacaccctgtagttattagtgaattctaagtgtttctatcaactattttccttttattagaccacaaaatcaataaacatatgaccagaagagaggttatcattttatttcaggtctgtatttagtctcaattctgacaatacttcagtttgctgaccacctaaatagcacacaatctactataaagatattttcctcacattatctttggatggagtaaaaaaagatagctatcaccatgggttgaaataagactccataaatataaagcagttttatcagtaacagatactcaaacttgttgcttttaaatttcatttgtctgctaaactctgaaaaaaatattacatttagtaactcagaagttggacagaaatgaatcaaactctataacaagtgtttctccttctagggaaaagttgttttatattccacaaaaatgaaaaaaaaaaaagcaccaagtcaacaaggggctctctgaatacgtgtattattgaaaactgaaatttcctttgtaacttcattagattgactcaaatcttatttgattaaatgaacatggagagttatttacctagctgaagatctatcctttctggcctaacaagattatttggctggaatccagaattcaacctaaattttctcaagatttgtgacggtttattagaattacagaagaagggcatcatagacacactactcaaactcacattctaacaaaaaaaaaactaaactcgaggggtgttttcacaatataattattatatataacagaataattataataatgatacattgtaacagaatacagtcctttaaaagataagagttttatatttttaccaattcagagtcatgttgaatgtgactaataattagctaataaatccaactaatatgtccctatgtaagactgattttaatcagtgcagaaacaggcaatcttctccatcagaaaaactgaaaatgtctggcagtattgccatttatcacaaaaaggaaaatcagatttctcatatgttgcttgagttgaagggcagttatcaagaagcactttaataggtaaaagacattgcagataggcttatcctgaaaggaccaagtgctgtacaaattggtctaggataatactaggtatgagtgctatagttgtctgacagtaacatttcacctaaaacattaattacttctctatcctaaattgtattaagatatgtttaaaagataacaagaaaaattctatcaagaatactgtgcgttattttataaatactttttgcagagcatttttttgaaatctcttaagctcttaaaatatacttgctcaaactggtagtactttacaatgcataaatgaaatatctcatattttctgaaacgagtgtttggccttgtgaattttacaataactatttatcattcactagacatgtaggggattaataaaattaaaaattaatttgcaaacacctacaacagctctcaaattctcagtttaatcatgacatttaaaaattctgccaaggtactaacctacaaggtctttataatgatcatgtttgaagttgaacagtggaaataagcacatttgttgttttaacgtaagtatccagaaatgccccatttacaaatagcttgaatgagggaaaaccaggtgtgccttagtccagattctatataatccccaaacccaatttaaaaggaactattttgaaagaaaatttatgttaacatttttactgcatatatacacacataaacatgcataccatataagaaattcacagggacattccttcatgcaaaaatcattgccaaacactgttctgttcattgagtgatacatcagtgaacaaacagtcaaaactcttggcctttgtggaactttactaggagaaaaaagaccaaaagaaataaaataaatatgcaagttacacagtatcatgtattagaatttgactagtgctgtggagaacagagcacagtaagggtcaggagactgaaatctcaggtaagcaagggcctgaaggaagtgagagattgtgtcccagagatatccagagttcctatcagtacaaaggttctgggacagatggtgtcttctgtgtttgagaaaaagcaagagagccaggatggctgagaatagtaggagaaagagtcagagaaggaagacagcatgcagaacagattgtatagggcctcagaaatcagtataagaactttgatttttattctggaaaaaaaaaatgaggatccactgaagagttctgagcagagacatgatgtaatctgatttttgttcaaaaggatcacttaacctaatgagagtatactgtgcacaggcaagggtagaagcatgaagaaataacccagatgagaaagggagacagcttggaacagggtggcaatggaggaggcaaggagaagaggtcagattctagacatactttcaaggtagtagaatttgctgtcaaatgtgaggtaagtgaggagtcaaggataaatctaggatacctggactgaacaaatggaagggcagagatgccattaataggaaatctgaaatgtatagcagggtgtttattttggtggtggggagataagaaataaaaaaaagagccttttttaatgtttctaagaatctaagacaatgtacagctcgaattcctttcttaaattagttatcatcttgtaacttgataaaactttaaaaacaatctgcctggagttttgcttctagcatgacagtgtgaggagctccacagacctaccactcaatgaaattggtgaatattataattaaaaatttctggaaatggtcctaagagcatatagcaaatgaagaaacattactcaaggaaatctactaaaactcagtaagaagagtaagagactggtatttgaaataaaactctgcttcacgaaaggattctagagtagaaaaatgaaacaaaactcaactccatctctgacttctcacatctcattgggatggaaattctacttcagactgacagagccaataacacacggctccctctcctcccagaccctagttagacagttctctttccagaaaagatagggcatcaacatttatcatcctagcaaaggctgttttaggcaagtgcaaccaagagatggggggctcccttcttctacctcaatccccttatgggatggaagcttacattgagtgcagaaatcctgacccttgccccagcttgtggggcactggttctacgctgggagaggcaagtcaaaaagatgtagggctgctgccagaactccctccagtgagcgttcagctactagagtgggggtaccattcagaaatttgtcattgtccccacaccaattaacctggcttaagagattttgcctgaggaaaagtaggccatagaactagaagctccaaatgtctctctataggaattcacttcatttgcaacagtgtgatgacaaagccttagagcactcaaaaacattggagattgtcatgaaaggcagttgacaggatactattagacccattggccctataggctaaatccatagactactttcccagggaaaaacagtgagatagctgggaagaatactcctgaggtcagaacaaatctcaaacactaagctaatgaactgtcccttcaaaagagctagaatggatcagtttgtgaagcaatttatgccacagggcattgttgaaaacaactgaatgattggctacaattagtggagcctaacagctggatatggtcaagagtcacagaagaccatatatacatttgtatgaaatgtttaaaataggtatatttatagagatagcaggtagatcagtggttgcttatggctggggaagtggatgggggcttagggaagtgacaaaaatgaggcttctattcgagatgataaaaatgttctaaaattgactatggtcttggttccacttatctgtgaatatattaaaaagtattgaattgcacacttcaaaaaaggtgggtgaattgtaggtgacatttttttttttttttttttttttttgagacgagtctcgctctgtcccccaggctggaggacagtggcacaatcttggctcactgcaagctccacctcctgggttcatgccattctcctgcctcagcctcctgagtagctgggactataggcgcccgccaccacgcctggctaattttttgtatttttagtagagatggaagtttcactgtgttagccaggatggtctcgatctcctaacctcatgatccgcctgcctcggcctcccaaagtgctgggatgacaggtgtgagccaccacgcccggtgacttatatcttaataaaactgttaatgcttgagttctttggcttctaacttctggaaaaaatgtattttctggtttataagtatatctaccaaaatatgttaaatgtgtttgatgacacctaagtatctcagaaactaaacttgttttttaaatttaaacctcagtctttctctccagttcccactctttggtccactgagcgtgctgaggattgtaatgcttcctaaatgctctagttttactgccagactatatggcaaagttagggactgcctgaggaacttaataatacataattcgaaattcatcccagagatactgattcattaggttcacaatagggcccagaaatatatatcttaaaaagtattacaaataatgtgagtatccatatagatttggtgactattcgcagcgctaacaggcccaagaacattctttcatgattcaagtgagctgtcttcactcgtacaactcccccccgcgacataactgatttttcaagttaaatccaccttttacacattttttgacatatcttaattatgcaactataacatgcatacaacagatctacgtgaacagtaaagactgttctctttacaagtaccaagactacagtgtgtgcgtttttttttttttaaagctacttttcatagaaggcatttggctggtacatttttcaaaatttagtattaacttctgataagaatacttttagtttttcaccatcataagcaattttacagaagtaaatgttttcaaaattaaacttgagaaaaagaactttatttcaagacataacacaattcggataacaaaaaataggagataaacatcacacaataataatgggaaaacattaaagcaattgatatttaaaggagttatgttctacctataagatattccattgacttatgatccattttcccactatttctactgaggaaaactgctagatgaaggatttatgagatttgctaaaaattggaatagaattttcttaggctgtgggaacatctcgatgtgttataaatagaacagactgtgtcacagttttgagactggtggttccaaccacggccaagtaaacagtcttaatgtcctctaacgtattattctatcttttgtgatattatgatcatctattgatggctgtcaattcagaaaggccatttaaatgcctaagttcttgcaattagtaaacattttaatgtcagagaaaacaagcacacattacaaaactctatgtcctctgccaaaagactacaatgataacagctcactgaaaaaggcttacggatttgaaatgcacttttgagaaataagaaggaaagtaatgcccaatgaagaactcaatcacattctgactgcagccatatgttcatggaattgacaagcaacattctaccgcaaaatgtctttatatactgtataatgacagaagaaaaaacctataggagaagcagccaggctagctatactagttttatggatataaataagggcgacatttctaaaaggtcaatgagtaaacaaggtattcatgccagttaacaatatgaccttgacagctgaaaaaaacagtagataaatctgtatttttacagcactcaactcaatttccaaattagcatatacttttacatgaagtattactttttctatattcaacaacaaatatagtataactagtagaggaatgatttctctccaacttcgaaagctgtgaataaataaacatgccagtgacctataacagataagtatttatttgacttttgtggcaaaaaaataaactatagctgtattttgaacacagcatctaagtatgaaacaatgccctattttttatctcctataaattggacataaaatgtacatagcctgggatttttttttcccttttgggagtaaatttaaactgtatgaataacttgcttgttcccaaggaaatgcagtgcaccaaatcaagacaagtgaacttcaaacaaatttggtgttctcaacagtttgcaaggacataaagaggcagtaacacatgaaattctaatagtaccaagttatctttgtctactgaatactctagaatggaaaaaccaagcactgtggaggaagaaagaatatcccaactatagcgtcagtgagattttacataaaattaatactatagtgatagtcaaaatgcataatttatattaaaaataattgggaggttctctggtatccttaattatatagtgttttgtgttattttggataggcaaaggtatttgaagaaattcaaaaacagagctatagcatatggaaaggacatcataatctacataggtataagctgaccattctttacgtaagttgatgaggaaaaatcaggcagctttaaggaagtagaaagtgaagggaattgctgtattaggtatatcagcttgataatacacccattaattatgtccattaaccacaatagaaagccacaagaatattttttcaacccaaagtgttcttttcagtgtgtccaatgctagggaaataatcagtgctcctcttttaataacaagcaatattttcagatttttatagatatgccttttagaaaaaggtcaccaaaaatgaccaaatacaaacaaaatttgtctttttaaatgatgaggggccaaaaaataacatgagtttaaaactagtaaataattttctcattatgtgagtcatattcatctccagctttgctattcaaataccatcttcacaaatatagctattttagccagttatcaacatttattgtctgtctctgtgacctgtatctatagatctctgtgtctctagatctgaaaaccttgatggtcagaatgggcaaatgagatgctaagaacaaaaaagaaaagaaaaccaaaaaagatagccattgtttcaaaagacaacagaattaataattatagtgtctaggcccaaatatttggaaataaatgcatctcattaattttacttcaattctctacatagtttgaataaaagatttgtgtttgctgaaacaatttagtaacaaagaacagtatggcccataattgcatattcttctacatattcatttatgtatggtcatgacatatttacatgtgactacagacttggttaacatataagagtaaattgcagtaagatgcctccacaaatgggggaaaatgcacatttcaatgaatgctaatatatactgaacacctataatgtgacagtatgtgataaatgaaatcttacaagtcattaaagtttcaatgccaaagttcaagtgtcgattattcttaatttagattgagataacttgtattagatttacttcttggaaaacgtgcccaagtgaaatggaaattccttgaattatggtccagcataagtcacataacaatagctgaggaaatctaacaatctagaggttctaatggcttatggaacagctgaagttatgtttgtaggaatataaaataaagtttataacctctgtcaatcaatccatcaggctcatacatttattgataaataatacaaccaaaagacaaagaaagaagactgtatataatggcaaatcatttaccacttttactttgattttaagaagtaacagtaaaattaggggtataaagctaaacatttttcagcaaaagatgaccaatgacttcccatcacactacctcacatttcctgcactccaggctaacagactttgtgctgttcttagagcatgccaggtacataaagggcacttgttgctccctttgcttggaatgctcttcccctggatgtcttcgttcagatccctgttcaaatatcacctcttcaggaaaaacatcatgaccactctattaaatgtagcactctctagcctacttaattttttaaaataacatgtttaacagcaatttttttcatagcacctggtattcattatattggttttgtattctctccaactcaccccactagagtggccagggatgtgacttgttcactgatgaatctttacaattttttaggattaatttatcaaacagcaaaaactggaagattaatattaaagaatttgcaactttacctcagtgctataaatattatctttccatacgatatatgcatgctttaatattttcagattaaataagcattaagagtatatcagaatatagctaaattaaaataagcacaaaatattccttacctgaatttctaaaatcattctgtcaatctcatcttgttggctgtctattatctaaaacaaaataaatacatctgattcaaataatttttacatcgcttcttaaaagtaccaacatttcaagaaaacagcacagaaatttataaatttattttttaaaagggtctttttaaaaaactgaaagtatccttatgatttgggtcacacacgtataaaactacaaaagtcttcctctagttctcaataaaagttttctcaaatttataaaatttttaagagtaactttgagacagactgaataattaaggaaggaaaaagatatccttttgttttggcttttatttcaattatttaattttgtttcaattgctatggtcctttcaaataaaaacattcaaactagaaactatgtaagtgattaaatattaacaaaatataaatcacataaaatagctataaattatgtatctatacacacatatccacatagcatagatttcacgtttatgatctaaggtatctactgaccttactagcagtctcattttgttgtctgagattatcattttcattctgaagctgttttgcatctaacatgggaaggcggattccatcttcaaggcatctttctactttttgttgcaaactatttcaaaagacaattatatgaagaaaataagctctatttgctgattttggtaatgatttcaacataaatgattattgctttattaaaaaatattatagaccctaaaaatgacatcaagacccacagacagtatatgaaaaactgttatctatagttcataacaagtaagaagggtccatagttagctagaggctgatcatcttttcagaaatggcaaatttgagaccagagtccagagttgctcagtatgtgacatccttaggctccgatgaagtccttcattacccaaatctgagctctgaagtctaactcatgttctttccttttcctctaaaagcagggttccttgattaagatgatcattgcagggaacctaagaatatggatccacatcttttgttctttattctaagctcagcaaaagtttgcttgtaagaatagctgttgcctaaatcagtagagttgcatttctctttcatttcttttctttttttttttaacttttattttaggtttgggggtacacgtacttacaactgtattaattgagacccacgaggcaagagaagtaagtaaatctggaagatacatggcaaaactgctgtaccttttacttgcagtaaagttagaaataggagccaatcacttcaatttgatatattccattaaggagtgcagtttgagtattttactggcccctttttcgttatttagaatttttacttttttttttttataaagccattaggtaaagggtttgtattaatattttcagtcttcatttgtatgagtttttatttttactattttcaacagaaacttttggcaagatatcaatatattgcttcaaaatgttaaattataactgagataacctgtttcaatgaaattatgcttctagttcttaatacaggttgaacatccctaatccaaaaacctgaaatctgaaatgtgtcaaaatccaaaactttttgagcatggacatgatgctcaaaggagatgcccatggcagcatttcagattttggattgtcagaattagaaatgctcagtgggtaaatacttggcaaatattccaaaagctgaaaaaaatcttaaatctaaaacatccctggtcacaggcagtttggataagggatgagcatcctgtagtacatctttaaattaaggagaataaaataaaaattataaattaatttaagtaaaatgttttatgaaaaatacgaataaaataatgtagaaggattcagaaaattttcttacctctgaacggtagttactaactccttttctttctttttctggcatattaactgtgtctctttatcttgacactgctttttgatctcttcaagttttttttctgtatctatcaaagcctcttgtaaattcttatttttttcttccagaatctgcagctaaggagaaatgttttacagttcattacacatgaaatattaaatacgcttctattagaaactgttactgtgttggcaaggattaacagacttgtagctaaaaaaaaaaaaaaaaaagaatcacactgtattttatctagagtatttaattctccatctcttcctctgtgtgaaaggcacctagaagaacagaattacaaggaagagaatggggttagaaatttgtagaagaccgagaaaggttaatattctcattttaaatttattttacttttattgtaataaatatataactctatactgtcttaacaatttccaagtgtatgacaggttgaggttaagtacattcacattgttgtgcaactaatctccagaactcttcatcttgcataattgaaactctatatcaattaaacaactccccatctatctctccctccatttcctggtaaccaactttctactttctatctctgtgattgaattcttaaggtatctcattaagtggaatcatacagtatttgcctttttgtgactagcttatttcacttcacaaaatgtcctccaggttaatccatacgatagcatgtgtcagaatttctctccttgttaaggcgaacaggattccactgtatgtatataccacctttagtttatccatttatctggtcatggacacttgggctacttccaccttttggctattgtgaataatcacattataaacatgggtgtacaaacatctgttcaagacccttaactgccaccccagtggatgttaggtattttctgacatattttctaatacccattgccctctgttcctgctcatgcaacctcctgcagtccttaatttcctgcctgactttaatctctcttagtttttacaacttataaattaatgtaaaataaacagagaatgcaacataggtcttaaagtatgcagagtgacacttcatagattagattcttgagtgggggtaactttacccccagaagacatttggaaatatctgtttacattttgggtttgggataaacgagaaggagcactgctattggcacttagtgagtagagggcagatatgtggatgcagaagtacacccttcaaagatcaaggcacacccctgtaacaaaaaattatctgcctccaaatgtcaatagtgccgaggtcaagaatccctggcttagaacaactttgggaagagactgaagagtagatctagtggatttataaataaggtttcaagagagtggccctcacctcagttaggagaaagactctgaggtattgttaaggaaaaaaaaataaataaaagaaaaagtcagaggagttaattgaagtcataggtcaaggtataagaaaaatatatatatataaaggttaagaagaatgaagaaaatatctagaaagatagtcaacaaaaggtcttgtcgagccttggtgaatcctagagactgtgttggaaagcaccagaactgggggtgtgtgcatgcatgtgtatggggtagaggttggcagactggtttagaaactaacttctacagtagttaagagagttacaatacaggatcaataggaaggtaatcacttattaactgacaagaaagatctacttatgcatgcttagataaacaaagtttcttattagaattaagtccccaaaacagcaattaaacacatagatttaacttatagttagccaaatttctagagtcaagttaacatgttttcatgtcatttaaagataagcattttatttcatgttacctgtagactctgactctgtacatcatctagagttggaagatcagccagatacttttccaaggtctcaattcttctctgcttttctttgttttgttcagattccttctggcatttctttttcagactactgatgtatcgatctctagttttaagctaaaagcaaacaattatgaaccttcagtagttttcagtcattaaaagatataacaaaaccaacactttaatattagacaccattgaattcaccaacagtttcaggttatagcgaaggccactagcaactcaattaagatttaccttatttcattctaagatttacacttgccgggtgtggtggctcatgcctgtaatcccagcactttgggagactgagatgggctgatcatctgaggtcaggagcttgagaccagcctggccaatatggcaaaaccctgtctctactaaaaaaatacccaaaaaaattagctgggcgtggtggcacgtgcctgtagtcccagctacttgaaaggctgaggtatgagaatcgcttgaactggggtggctgaggttgcagtgagccgagattgtgccactgcactcctgcctgggtgatagagcgagactttgtctcaatttaaacaaacaaacaaaaaaagatttacacttaaaaaaatttatgtcactgaaatcaacagtttagggaatatttgcttttaccatggacggcatcctataaattgtcatcaaccagggggcagtaatgacatagtttttattgcctgcacatgtgcaaatttggtcaaggctgttcatatctttgtgatttcaatattgtcatatacatgtagaaactatgtgttgagtttaaatgatgtctaaaatgcctaaacaatgttaccttacaatttagtatggaacaatgttattgggtgcccagacaggcacagaaaaaaagcctttgaaatcagtgaagtattcatctctgaaggaatgactccgatttcttagtttttgcataactatacccaaatgctttatgggaactaagagaggaagatactacaagtaactaaaactattttgttacgttaacagacttgcagagaaattgcttatagtgtactaaacaatgcaactaaagctggaagaatacaccaaatacttaggggcagataatggactagtgaaaccaattcatacctcaagcaacactagtttaaggcactgtgtcataattgaatttgcagcttattttctttctaaaaaccacaaaataaaggtgtcttactattgatgtcattttaggattgataaagtatggtaaccgaacacttatgtcacacatggtgtgtacacacatgataatgattctagtaaatcccaatttatataggctgaaagtcagattttcatgtactttttaccccctactacatgaaatatatcatctataaatttcatatctcatagtcaaagctctttcatatttactcctatttaccttaaattaacaatcttccaaccatttaatcctcttcaaaacttacagggttctaaaatatttttacagtgttttcccatattcactgggaaaataactggcaataattagcagtaagatggattattctttcaaactttattaaagctaacacttgttcacagtctagtttctttcatgtattttctaatttttttcaggtctaatgtataacaatttttaaaacttcatgtggaaaaattattcatttcaccagtgacattaggatctacttatgacctctggtaaggagcaacactggtaagacaaacacatcctattatttattggggctttcttaggattaaaggtaaatgtgctggtgtgacagtttaccctgtgatctatcagaatagaaaaccttacatactgttggcactggtggtgaccatataatacaattccctttttacagatgaggcccaaagatctttagtgacttaacaagtcacaaaatcagaagtggaatttgaatctagatcatctgactgaaaatcaactttctttcagttctttgttatgactcattatcaggttcttattttagtaaccagctgtgcttggtccccatcaaccaagcctgctcttgccttagcaaatgaccctgtacattacagaggtaaacatgataaaccaacctatgtttacttaatgctctctaacttggactcaactgtctaaatgtcttcaatgtgacaaaatgatgcctcaaaaagcaatgactggaataggtctgtctgtgtgcaaagatgtcctacttttcttctttttcttttggttgtccaactctctttgctgtcatgtcaagcttgcttcccttgatcacaaattgctgccaacactctcctacgagacactgtctctgttatttgttggtcacatgttgatcatacatattcattgggtcttgggtttttttcagcctgctcacagatgacaagctctttgttttgttttttggtgtttcatttttttttaaaactgccaagttttgtgctgtcccatacaaacagaggttactgaagtctgaactgcattaattacctccagataaatgaggtgtcactaataaatcttctctattctattaatacaaggctaagtttttcttttcaaagaggtatgacgcaatactgatatcattcctagaaggtaataggaaggacatgttttataagaagttcacaaagttacttttctttattatctggcttttataagaaagaactcaaaggtaacattattattaccacattgttttttctgtcatagaatcagtctttgataaggattacagagtaaatgccaaaagaaacaatatgatccaatcttgtgtggacccaaagtgctgtttgttgatttgttatcaaggagcctgctcttcctaatctatgcactcccttgaagaactcaagtcatctccatgtgctctgacacaaactctgccctctacatctatcccctctcctcaaatttctctggtatgtacatttccattcttaattgcctcactcccacagaagctactcctcttcttttcggagagtaactctaccatatttgcatctgttaccaacccttcccgaacttgctccattatgcacccactctaacatctttgatctctctctctctcattgttttttccctagtctaccttactgctttctctcccatcctggcaaaaattacctgaaagaattcattcaacatgccaggcaccatgaatggtgctacatacgccacagagacacattcaaatacaatccccctgccttcaaggagcttagagagaaatataaaaaataatgattatacaaattgggttgagccctggaaaaaaagaataaaatgctataagcatatgaaaggaggagtagaagggaaaaatattaagctagatttgagcaaataaataggtgacttgaaagtgggagaaaaaaatagccaagtatttaccatgcaaaaaggccactctgtgtaaagatcctgataccagaaacaaagcctgagctgtctgagcaactgtaacacccagtgtatcaatacacagtttatcagaggaagattggcagaacctatggatatataattaggcaatgtgtctcaggccatgggaagaatttgatttatattttaaagacctggagagtagtgtcagcaagatggcagaaaagcaagtcttgaactctccttccccaaaccaacatgtgggttcaattaaaaaaatagtaaaacccccaacatggacaaattccctttttaagaaatccaaaaattagtcaagaagctattgtactctgggtgaatgcaaaatcagccacatggaagcaattaaggaaatgtaggacacctgtaatcctacccccaatacagcatatgatcagaaggaacctgttgggaaagaaaatagttggatcacacatccaacaccccaacttttctgggtgctgttcagaagactggcttctgccttgcctgtcttggaacactaataggaccatgacactcttgctgcctgggaccagtgagatcagaccggtgagatcagagatgatggtttaggctagcagtttccacagtccacagctccagctcagcactccagcaatgagtgaagaaactccagattcaagtttctccctgtgcagagaaagcaatggacagaacacccaacaatctgacttttcagaagtctggccaagggactggctgaaattctgcttgtctgagtactgataggacctagaatactcctgaagcctgaaggatgctaagaacaaaaaaaaaaattagttaaactagtacaaagatatgaaaagcccccctctctcgccagactgattagtgagggtcttctcctgtataaggctagtctctgaggagtggaagtgatagctattttatataatatacaagtatcaacttaaagagggaggaaaaattaacacacagggaaatatgtccaaaacaaacaaaataaatctcctgaaaccaaatctaataaaaccaagatacatgatttgcctgaaagagaattcaacatacccaacataaagatgctcaatgaggtcaggtaaacaatgcatgaacaaagtaaaatttcaacagagataggaaatactttaccaaacaaatcttggaactaaaaaatataataactgaaataaaaattcactagagagggtcaaaagcactctagatcaagcagaagaagaaataaacaaactcaaacacaggtatttggaaattatcaagtcagagtaacaaaaagaacaaggaataaaaaagtaaagaaagcttgagaaacttaaaaaacaccattaagcggacaaatatacacattgtaggagtcccaaaaaaggaagggggagaaagggaaagaaagcttattcaaagaaataatgactaaaaacttcccaaatatgtgtgtgtgggagggagaggcaggaggcatggggaatggacatccagatccaggggacccaatggaacccaaataagatgaccccaaagaaatatgtacaaagacacagttaaatcaaattgtcaaagtcaaaaagagaattctgaaagcatcacaagaaaaatgacctgtcacatgcaagagaactccaataagactatgagcagatttctcagaagaaattttgcagagaaagtgggatgataaacttgcactgcttgggcaatggggaatgggggtaattgtcaacccagaataatgtaagaagaagtgttcttcaaaaatgaatgggagtggctgggtgtagtggctcactcctgtaatcccagcactttggggggccaaggtgggtggatcacctcaggtcaggagtttgagaccagcctggccaacatggtgaaacctcgtctctactaaaaatacaaaattagctgggcatggtggcacgtgcctgtaatcccagctactcgggaggctgaagcaagagaatcacttgaacccaggaggcaaaagttgcagtgagccaagatcacaccattgcactccagcctgagtttgcaaaaagtgcaaagctctgtctcaaaaaaaaaaaaaaaaaatgagagataaagattttcccacacaaacaaaagctgtgatattatagttgattacctacccttgtactataaaaaatgtcaagaggaattcttcaagttgaaataaagggatgctaaacagtaatacaaaagcataagaaagtacagttgtcccttggtatatgaaagggattggctccaggacacctcatgtataaccaaatccacacatgctcaattcctgcatagaagacatacaaatagtgaacaggtatatgaaaagatgctcaacatcactaatcatcaggaaaatgcaaatcaaaaccatctcgtgcctgttaggctggccatcttttttcttgaaaaaagaaaataacaaatgatggcaaggatgtggagaaaggggaacccttgaacacttggtggaaatgtagaatgatacagctgctatgggaatctgtatggaggttcctcaaataactaaaaataaaacatgatcaagcaatcctacttctggatatttatccaaaagaattgaaatcaggatctctgagcaacatttgtactcccatgttcctagcagtattcacaataacccaagatgtggaaacaatctaaatatccagcaacaggtgaatgagcaacataaatgttatatacacacacacacacatatatacacatgcacacacacacatacgtgtgtgtatatatatacacacacacacgcacacacacacacaaaatggaatattattcaaactttgaaaagagaaatcccatcatttgtgacaagatggatggctctgggggatataatgctaagtgaaacaagccagtcacaaaaaggcaaatactacataattccacttatatgagataaatgaaacagagagtagactggtggttgtcagggactggggagcagggaagtgggagttactcttcgatgcatacaaagtttcaattacataaatgaataagtgctagagatctgctgtacaatatgcctatagttctgaattatacactcaaaaatttgttaaaagggtacatcttgtattaaatgttctttctacaacgaaaagagaaaatataatgggatggcataaattagttttaaccaaagaagtaaaatgactggatcctttgttgttaaaagttaagtcctttgcgctatcaagaatggatttgggaggatgtggagaaactggaattcccaacactagtagtgggagtattaaatggtacaatcacttgggtagtttcttgtaagttaaatatcgactgtacaaaccctatgatccagcaattcaactaccaggtatttatccaagataaatgaagacacacatagacaaaaaatcttgtacaagaacgttcacagcagccttattcataatttctccaaaatgctaaaaatccaaatatctatcaacaggagaatagatacactgtagtatatctttataatgaaaaacactactcagcaatagatagaaactgatacatgtagctataaaaataaatctcaaagacattgaataaaagaatatataccatgtaatttcattaatatgaagtccatgaaaagtcaaaattatactgataataatcaaaaagcacacacacaccacattttctttatcgattctttgcttaatgggcattcaggctggttccatatttttgcaattgcaaattgtgctgctataaacaagcatgtgcaagtgttttttatgtaatgacgtctattcctctggacagacacctagtagtgggactgctggatcaaatggtagctctacttttagttgtttaaggagtctccacgctgttctccacgctgttttccatagttgttgtactcgtttacattctcaccaatagtgtaaaatcattcccttctatttcataccaacatctatacacacacacacacacacacacacacacacacacacacacacatatgcatgcatatctagtgttcctgtctgtgtatttggtttttagcttcttattctgaatcaggggcttcagtttaataacttaagttgcatcattattaaagataggccagcttcatttaccaaccctttatgcccaacatgacaaaaaaaatgaaatcatagactcaataaggaaaaggagaacagttatttggtgtaggcaattaattttttaaagattttactatttgttagaaagatatacaagagcatttctatcctcaaagaaaatccttggatttctgcagacagcagagggcttctcaaaagttactacaaaattaatcacctccacataaatgtatacataacctggcatgacacctgacagggtaaatgacagacaaataattatatgctgaggaaatgttgttgacctaattcaactttattagaaaaacctactttttcctctagtttcttcttctcttcactaaataggcttagtctttgtttgagaaactcattaagctgtaaaacttctttctcagtagatgcaagcttttgctcaaattccccttgttgggaatgggaaactgattcctctgaaaatggtgtctggagtgaagtgttctcatattgtggctgttaggaaagaaaaaaaggaggtaagactttaaaagtttgtcttgaacaaatgtgaagaaattggaaatgaagtataatataaggagtacatataggctacatgaacagacacaccttgatttaaattccagctatcttgcttcctagttatgtaccataattaaagtaaattacttaccttctcaaaaccctggttttctcatctctaaaacagaaacaataaagcctactttgcagtgttttttgaagaaagataaagtatgtaaggtttccagcatataggagaaacttcatgaaagacagctattatttgattttaaaagtatacttcaacatgtaaatagtacagtatatacattaatcatataaaagtgaaagttctaagtaaataaataaaaactaaagaaaaatttcttcacagttaatcatttccagctaatactaaattcaatatgtattaatagaatgtttctctaactagaaagtaagatccatgaatcggggattcttgtccatctcaaagtgtccatcttatattccctattgcatagaaaaaaatggcacaaaataagtactcacaaaataattgttgaatgaataaatgtattattgcttctatgagcaaggctttgaaggaaattcttttcaaggggaagatattccctctcccccatgtaggattaaaatctggaagaggaaggcaggaaatacaaatattccttcaaacaaatcagcatgtggttaagtgctgtaaaaagatatcaacaaagtactgtaaaagcaaagaaagaggttatttttccatttatttaaaagatatttacaaagcacatacgttaggcattgtgctaggtgctggggattctacagttaataaaatcagatcccaccagtttaatgtgtcatacacaaaaagaccaaaaaaagacaatgaaactaagtgctaagatagttacatgtgcagtagctaagggagggtgttacagaagtaaatttgaactaggccttgaagaactgatactttcccaaaaggtaagcatgcaactcaaccattacagaaatagcatttatcatgtccaggctatttcaaagatggcagactcaccctttacaaactcaaattttaatcagagacatgagaagcctttagatgattgtaatatagaacagaatgaatatggtagccaaataaaggccatgttaagtacaaagtattgggagaaagtaggatacatgaagacattgagcgaatgaggaaaaaggcttttctggagaggtggcttttgagacagattttgaaaaacagattctggcaagaatggaaaaaggaacaggcattctagaaagaacatttttaaaaaggttaaaaagtagatacagagagttatcatgtcatgtttataggttacaagtgggcagaataaaagggaaaacttacaaatctaggttgcagccttcctgtagaattccaagaattgtgaacttggctttgtaaatctctatattccccagcattcaatctagtgtctagactctgagcaagtctgatgaaagggaagagatgagaggaaaaagacaagagagtgctagaagaaataggacaaagctagattcagtgaacaagatgcactgagaatgaatatggatgttatcatttaaagaaattattctaactaatttagctgaaaagaaacaaggagctgatatagagcatggagaacagaatgaagaaactggaagcagggtgaaaggatttagagaaaatgattatttaaagatgtaaatggaaaataaatgttaaagataaccaaggtttaagattttgtctaactaatacggaagattatcttctgggcagaagtaaatataaagaagaacagtaggttatatagaaaaataggttatacttaagcagatatacttaatataattagagcctatgattattatttcatttgaatatacaagtacagatggacaccaggcagaaagatagatatggaactcaggaagatggctaggctatgaaactataaaaagctaatacagacttccagtttctagcccagcgtgtaaagatatcagaagtcgccactcagtcctaaaaaaaataaaataaaaagctgaaaaaactgaaatatcaacaagtcttctaaagtctgtgagagaaatgaggttacagggcaaactgctgcctccaaaactggaaaaaaaggataggtagaaacagaggttcataacctaataaagcaaaaacccattagtagaagagccagggtgggaaaatctgtaactaatgaattgctagagacttggagtagataaatctgagagttaaaaattccacggggacccaatcatacaggaggtttccatatgtctgtgagttttacctccaggagtgttctacaagatcttcagtgagtatcagagaaaaatcccctcctgtttctggcagggggaggggaaaaggaaccatttaaaatatgccagagcattctgttcttaaaaatgcctgccgtcaggagaaactattttaccagagcctaaactgctggggttttatcagagcttaacgtagttggggtaaagggaataacccaactccagccaactccagccttccacatagaggagggttaatacacaaatcaagctcctttggccttccctgtggaaataccaactccatcgccctcctgccatcctgtcccgcctaagggtggggaaagaaaaaatcttagaaaactgaagttcacaatccagaggaacaaattcaccaaaagactgagacctaaacacaggactatagaatacttccccttccctgcacactttaccactgcattactaaagctctatttaccacacttattaaaccttggacatcatgtctactttcaacaaaaattacaagacacgcaaaaaggcaaaaaacgcagtttgaagagaccacaaagcatcagacacagagtcagatatggcaagaatgtcagaattatcagaccagggatttttgacaactaggattagtaagattatgatagaaaatgtagacagtatacaagaacatacagataacgtaagtgtagagataaaaattctagaaaagaataaaaaagaaatgctaaagattgagaacactaacagaaataaagaatgtccttgagggactcattagcagagtagacctggctgaggaaacaattcctgaacttgggatatgatgacagaaacttccaatactgaaaaagagaaaaaaaaaaaaccttaaaaaaacaacatgccttgtttcacatgaggcttctgacttggactttcgggttaatgctggaatgagttaaggctttaggggactgttgggaaggcatgattgtgttttaaaatgtgagaacatgaaatttgggaggtgctggggtggaatgacacggtttggttgtgtccccacccaaatctcaacttgaattgtagttccaataatccctatatgttgagggactcagtgggaggtaattgaatcatgggggcgattacccccatgctaccgttctcgtgatagcgggtgagttctcttgagatctgatggtcttacaaagggcttttccctctttgctcagcacttcttccttctatcatatgaagaaggatgtgtttgcttccccttccaccatgaatttaaatttcctgaggcctccccagtcacgcggaactgtaagtcaattaaacctctttcctttataaattatccagtctcaggcagttctttatagcagcatcagaacagactaatacaaagccctttactgttggtgaagaggtgatcctgcctgctgccaagcacatttgtcatgaactcttaggagacgctgcagttcaaaaggtgacatgtgttcatctttcatctttcagccatcacaacaaaatgaactgatgaaacagcagaggatattgaggcacagttgttaaagaggatgaatgagtcactgtggtatgcaatccaggttgaaaagtctatcaatgttaacaaggcaacaaggcttgcttttgtgtgatatattttcagaaggatgtgcaagaggatatgtcatacgcacttttattgccaaccaacaccacagctgcagaattattcaagtctttgaatgattacatatcagaaaaatggaattggtcattttgtgtcagtatacgcacagacagagaggcttccataactggatgtccttctggcttcacaacttgggtcagatggtcacttctgcatgtgactccacacattgtgtcacccatagagaaatgctggctagctgaaaaatgtcacctgaatttagcaacattttgcaggatatccttaaaattatcaaccacattaagtacatgcccttaacccacatctgatggtgcagctctgtgaggagatggacgcagggcacacacgtcatctcttatacacagaagtgattgctttgtgttattttattttatattttttattttattttattttattttattttattttattttatgaggctggagtgcaatggcacgatctcggctcctgcaacctccacccccggggttcaagcaattctcctgtctcagcctcctgagtagctgggattacaggcatgcgccaccaagcccggctaatttttgtacttttagtggagattgggtttcaccatgttggtcaggctggtctcgaactcctgacctcgtgatccacccacctcggcctcccaaagtgctgggattacaggcgtgagccactgtgcccggccagaagtgattgctttctaaaggtagattactggccagagtttttgagttacaagagccactccagagatttcttttagaaaaacagtcaccactggcaacacatttcagtgacacagaatggctcacaaaacttgcttacttatgtaacatattcaacctgctcaatgaagtcaatctgttgtcacttcaagggagaatgacaacggtgttcaagtcaacagataaaagtggctgcattcaaagccaaactagtattatgagggcaatgcataaacattgggatttctgacatgtttcaaacattagcagaaatcttgaaacagactgagccagggccttctttctcccagctggtacatggatcacctatctcagctttttaaagaatctgagcattaattcccaaccataaaaaaacccgaactgggaagaaatggatagcgacccacttgtaaattgccaggtgaatcaactttgtccacactagaagagaatcaactgcttgagactgcaaatgacagtggtcttaaaagtatgtttgagacaacttcaagtctccatacattttggattagagtcaaggcagaatatcctgagattgccacaaaagcactgaaaagcctgcttccatttccaacatcatatctttgtgaagcagggttttctgcaatgatagcgaccaaaatgagattacagagtagactggacataatcaacaaactttgggtgtcactgactcccaacactcccagatgagaccgtctagttgtggaaaacaagctccgggctcccactgattctacattatggtgagttgtacaattatttcattatatattaaaatgtaattataatagaaatgaggtatactataaatgttatgtgcttgaatcatcccaaaccacaccccctccccaggtctgtggagaaattgtcttcctcaaaaccagaccctggtgccaaaaaggttagggacttctgctatacactctgaagttatccttcaagagcgaaagagaaagacttccacagacaaaaattgaaggatttttgtggccagtatatctgctttgcaagaaatgttaaaagccttcagagagaagggaaatgacacaggtcagaaactcacatctagacaaagaaagcaagagcatcggaaaaggaataagtgaaggtaaaaatttttaaagctttattattcttaattgatctaacaagtgacattttaattacagcaacaatgtaatcatttatgtatgtttctgtgtatgtgtgcatgtatgtatacatatgcttatgaataagtgaaatgactgataacaatgatacaaggatgagaaggaagatggaggaattagaagtattttgctattatatggtacttatcataaggtacacttcattaccttcaggtggtgtagggttacttgacagcagacttggattagttataaatgtaaatgaaaactatagggcaaccactaaagaatgtaaaaagagaagtgtaataaagtagaaagagaaaaattgattaatataaaatgctcaattaaaatgactgggaaatggttggctcatgcctgtaatcccagtactttgagaggctgaggcaggaggatcacttaaggtcaggggttcgagaccagcctaggcaacatagtgagacccccatatctacaaaaaataaaaataaataaatacaaatgataaaagacaaagtgtggaacactacaaaaaaatctacagctaagcatcaaaatacatcaaacaaaaactgacagaactacaaagagaaacagattaatctactatcgcagttggagattttaacaactgtatcagaaatggacaaatctagcagcttgggaggccaaggcaggtggatggcttgagcccaggagtttgagaccaccctaggaaacatagtgagacccaatctgttaaaaaaaaaaaaaaaaatagagagagagaaaggaaaggaaaaagggaggaaagggaggaaagggagggagggagggaaggagggaaacagaaaagaaaagaaatggacagtttcaacaggcagaaaatcagtaagggtgtaatttatctcaacagccccatcaatcaattaactgtaactgacatctgtagactactcatccaaaaatggcatcacacattcatctcaagctcacctggaacattcaccaaagcggacaacattttgggccataagatacaccttaaaaagataaaaaatcatccaatgtctgctgtcagaccatagtggaattaaactagaaatcaaaaacagaaagacagctgggaaatcccaaaatacctggagattaaacaacacacttctacataatacataggttaaaaaggaaatctcaagagaaatttaaaaatgtcaactaaatgaaaaggaaaatacaacctatcaaaatttgtggtatccagtgaaagcagtacttagaaatttatagcattgaatgcatatattagataagaaaaaaaggatctaaaataaatcatctaagcctccacctaggaaatcagaaaaagtagagaatatcaactagaaaaagtaaatctgaaataaacaaaagaaactaaaagttcaatgtttgaaaattaattaaggtactccatcaccaacaggctaaaaaagacaaatcatgattatgtcaaatccacgaaatgcacttgacaaaatctaacacccattcatgattaaaaactcttggccaggcacggtggctcatgcctgtaatcccagcactttgggaggctgaggcgggtggatcacaaggtcaggagtttgagaccagcctggccaatagggtgaaaccccgtctctactaaaaatacaaaaattagccaggcatggtggcagccacctgtagtcctagctactcgggaggctgaggcaggagaatcacttgagcccaggaaacggaggtttcagtgagcccagatcgcatcactgcactccagcctgggggacagagtgagactctgtctcaaaaaaaacaaaaaacaaaacaaacaaaaaaacaactctcagcaaactagtaatagaggaagcttcttcaatttaataaagaacatatacaaaatacaagtatagctaacattatatttatagtggtgagaaacttgaagcttcgccaccaagatcaaaaagcatgcacgaatgtcccctctcactactgcttttcaacatcatactggaagtgctaactaatgcaataagacaaaaagagtacataaaaggtatactgattggaaaggaaggaagaaataaaaccatcattgttcacagataacatgatcatcttttataaaatgtcaaaaagaatccatacaaaaaaactcctggctaggtgcagtggctcatgactgttatcccagcaccttggaaggccaaggcaggaggatcacttgagcccagaagttgaagaccagcctaggcaacatagtgagaccttgcctctactaaagtatttttttttttaattagccaggcatggtgacacacacctgtactcccagccactcaggaggctgaggcagaaggattgcttgagcccaggagttggaggctgtagtgagctactgctgggagccaaaaatgccaaagggaccgtgaccaactcagcattccactggtggctatatgatcaaacagcaaactatttatcatgaacgcaggacgtgggcaaactcacactgcacctgctgctaaaaggtttcctgaggaccatcactccctggcgctgggctccttgaagttatctactgggaaatctagcacctattgttcgaaggatgcagtctcacaagcctgctgtgaaccaaacaggctgactgataattactcaacaatcaccctctctttctcgttatctcttttacctaatacattcagagggctgaaaaagctcaaggaccctgtccactagaggcaaggtgcccccgaccccttcttccaattatactcttttgtctttgtcttttattcccacgttcaccccctttgttcagtctcccaaggtccatgcaggctacaagtactgccccaaacagcaacaaaatcgggtgctcaacaagctacaattgcacatatgattgtgcaactgcatgccagcctaagcaacagagcaataccctgtctcaaacaaacaaacatcttgaagggacatctgttctacttcttcttgtttggataaacagcttgtgagaggcttctcaggaggcaagtctaatctcataggggcatgacactggaagtctttttctgcctcattctccacatggtcttgatctcgcttatttttgtcctcttcaattctgctttctccccttttcttcccccagaactggcttctctcctttctttctctttttccactttctgtccttgtgtttgtcatgattgtttttgtctttgaagaggctggagcagtgctccaaactgcccgtggagagctcagtaactgctttccctcctactttgaggaccagcttcaagggcttttccacatactctttgtagaggtgcttctctgacttgtgctccttgcccatgtctgaccaggccctggtgcccacctcccatgccaggcccaggccttggggtgccacttctggtccaggccaggcgaggtggaggacaggagcagggcctaccaaaccccgcacgccaatgcagggggttagcatgtgtgccaggtggcacaaggcccctcttgagaagacagcccatgagacctagctggggcctgagaacatgaatcaactgatgagacagctgcagagaaaagatccaagtgctcttttcgttttctgtgattttattgctcctggctactccatcatcattaaacacccaatggatctcagcaacatgaaagaagagatcaagaacagtgaagaactaacggataacttcaaaccaatatgtactaatgccatgatttacaacaaaccagagaccacttattataaagctgcaaagaagctgttacactcagagatgaaaatttttagccaggaaaaaattcagagcctgaagcagaccacagacttcatggctaacttgaaaaaacttgaaagcagaaagacagaacagacatctcacagagtggggaggatggaggctgctggctgagagagagagagagagagagaggactctggagatgccgaagcacaagccttcaagagtcccagcaaagaaaataaaaagaaagacaaagatatgcttttaagtttaaaagcagtaatttagagagacagtaggagcagcttgactgcatcatgaaggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcagcaaggataattcagatttaatctatgcaatctatgggggaagactgatcttccaagcaatttcagcaaccatgagtttctggccccatgccaagattacccatatgttaagacagatagtttgctggatgttttaacaaaaggaggggattccagggccctataagagttggagatatcacctgacgatgaaggccatactaggacacttgacacagcaaaacaaatggagattacacaagtagagccagcaggacatttggactctaatactcaagataggctcatggcactgaaagcagtaacaaactttggcgctccggttgaagtttttgactcttgaagaagctgaagtattccagaagaaacctgatgagaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtatggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatgttggttctttccaatttgatctatagattcaacacaatcccaaccaaaatcctagcttattacttagtagattcaatgaactgattctaagtttatatgaagaggcaaaagacccagaatatccatcacaatactaaaggaaaagaacaaagttggagtactgacactacccaacttcaagacttataataaggctacagtaatcaaaacaatgtggtattagtgataaaatataaaattaatcaatacaacaaaatagagagtccagaaataggacacataaatatagtcaactgatctttaacaaaggagcaaatgcaatacaggggaaaaaacagccctttcaacaaatggtgctgaacaattggacatccacatgcaaagaaaaaaaaaagaaactagacacagaccttatattttttacaaaaattaattcaaaatggatcacagacctaaaacacaaaactataaaactccaaaaaaaaaaaaaaaggtagaaaatctagatgaacttggctatggcaatgactttttagatataacatcaatgctgaatccatgaaaggatgaactgataagctggacttcattaaaattaaaaactttttccctccaaaaaacaatggcaggagaatgagaaaacaagccacagaccaggagaaatatttgtaaaagatgcatctgatctaaaaacaaacaaacaaaaaaaacctgttatccaaaatgtacaaataataggccgggcgcggtagctcacacttctaatcacagcactttgggtggccgaggcaggcggatcacttgaggccagtagttcgagattggcctggccaacctaatgaaaccctgtctctcactaaaaatacaaaaattagctgggtgtggtggtttatgcctgtagtcccagctacttaggaggctgaggcaggaaaatcgcttgaacccagtatgcggaggttgcagtgagccgaaaccgcatcactgcactccagcctcggcaacagagggagactctgtctcaaaaaaagaaaaaaaaaaatcatacctacataatgaagcttacatttaaaaaaaaataataatactaggtctacagaacttctagacagctgaatatgtggaagttccctcctgaagggtggcacccctggagatggcatgggatctccacattccttatctcataccttcccctatgcatctcttcaatctggctgttcatctgtatcttttctaatatcctttataacaaatgggttaagtgtaagtaaaaagcttctgagtttcagcaagttaatcaaacccagggagggagttatgtgaactctgatttatagccagttggtaagaagcatttgggacttgaaattggcatctgaagtggagggcagtcttgtggtagtgagtcctcagtctgtgggttctgacgctatctctacacatacagtgtcaggattaaattagaagacagacacccagatggtgtctgctgaagaatatgcagaactgactgcctggtgtgtagggaaacaaataccatacatgtggtgcagaagtactgtgctgagtggagagtagagtgggaaaaatgcatctttggtttttcctatatcactacagcggctttactcataattgccaaaacttggaaattatcaagatgcccttcagtaggtgaaggctgtgcatgtgtggggatatggaggatatgggaaatcttggtacttcccatttaattttgtagtcagcctaaaactgctctaaaaaataaaattcataaattttcaaaaagttatcacaggtggggccaggcgcggtggctcacacctgtaatcccagcactttggcgggactaaggcaggcagatcatgaagtcaggagttcaagaccagcctggccaacatgttgaaaccccgtctctaataaaaatacaaaaattagctgtgtgtggtgacacgcgcctgtaatcccagctactcaggaggctgaggcaggagaattgcttgaacccaggaggcggaggttgcagtgagccaagatcacgtcactgtactcaaaaaaaaaaaaaaaaaaaaaaaaaaaaagttaacacagatgcttctactataatacaaatatatgcattcctggaaaaccactggaaaatcatgcactaaactgtgatatacccagaaagcggaacattattcagtaataaagaaaaatgaactatcaagccatgaaaagatatagaggaaacttaaatgcatactactaagtgaaagaagccagtttaaaaagaaatggtttgaatagtatgtactatatgattccaattacataacattctgggaaaggcaaaactatagagaccataacaagttcagtggttgctaggggtccaatgggttgaacaggcagagcacagaaaatttctagggcagtgaaactactctgcatgatacgataatggtggatacatgtcattactaatttgtcaaaacccttagattgcacaacaccaggagtgatcctaatataaactattggtttttgagtgttaatggtgtgtcaatataggttcactaattataaataatgtaccctaaggtacaaaacattgatagtgggggaggttgagcacgtgtgaagatatggaggatatgggagatcttggtacttcccattcaattttgtagtaaatgtaaaactgctctaaaaagtaaagttaataaatttttaaaaagttaacacaggtgcttctactataatgcaatatagacattcctggaaaatcatgcactaaaaataatagggcgtatggaacgaataggattaaaaacactcaattcaaactgatgcaattttaactagtgcactaacaaaaacagtgactcaggagataacttggacagtctgaacaggtggtcacagtgatattttaaaaccacatacacacacagtcaaaatgctggcggtactttaattagaggtctggtgagtgttcagatgatataggtggactctgtgatatagggcttgccgtgcaggtggagtaggagggagcataacctggcgtgaactgaaagtctataaagaaggaagtgcacttctcaaggaagagcacccaaagggcaggtactcttttacaattttcttatgtaagttggaaaaagcttctgctaatgtagtaggtaaccctaagccttttgctttgctggccaaatattttaattttattcaccatattctaactccccttgcctggggagttggtgggggaaagcacttatgaaccaatctagaaaactaagcagacatcattctcctatttaccaattgtgtatgagcaaatttgcaccatagaaatgtgttttgtagcaagacaagctgtagttgaaactctatgtgaacttaatcatatagaaaaacaaaaatctgaggtcagatgttttaatttctacatttagtaacatcttttcaacctttatctgccttctctgacttttatacaacggttccctttctatggaaaaacacttgcttgctttcctttctagaacaactccctcaggctccttcacaagttgtgctcttctgctaccttctaaaatgctgctgtttcctgtttctagttctggatcccattttcctctcattgcacaaatcctcccttggaatacctgatcatgcccaaggctttaataaccacccacctagactgacaacacctaaatctcttatctctggctcagacctgcacccacaaatattaccctcattcttcactcaaccccaaatttacaatgtgtaagtttaactcactatttttctcctctaaacagatccttaacatagtaatctctataaaccaatcaattgttgctgtatgaaattaggcaatcattctctcaccacattaaatatgtcattaaatctggcccattttaccatggcttggtcatacagatgtttaatcaacagtcttcttctcattctgaccactacagataaaattcaaatgttcacataacttttggactattgagacagcttcctgactggtttccctgcctccaataacatctaccttaaatccaatctctattatgccatcagagtaaccaaactaggatactttggaggtgaaagatggcactattaataaatttataagcacagcaggcataaactgggccagccctaagcaaacctttacacctcaggtcattgatatcactcggcccttgcttacctcttcaaccacatatctaccactacctttctctcacattacatttcatccacacagaataatttgtagttttccaaatgcattatatttctcatcattcctttaagcttctccatatgccatacactatgcctcaaaacactattccttcacccccttcacctggctcaattcatttagttcatcaggttctcaaactagattatcacttcctacaggaagcctggccaggcttttggaagattagcttctatgttcatagctggggttcccacagcacttcatacataaaccctgtgcgaatcaacacactgcaactatctcttgtctgtgttctccattagactacacattccttgagggcaaaaccagcttcattcacatttctattgctacagcataaatggaaccttatccatagttaagataaacaatttttaaggaaatggataaatatattttttggtatactctctctgtagggtttaagttccataaaggcagaaaccattctttgcttttgtgttcccagaatttaacacattagatgtttaatgttttgttgaggaggctcatttgcaaaggtgggattcattttattaaatgttcattagtacagacttggtggtggaaacaaaccaattgaagaaaaaatagaaaaaaatgatataaatggaaagaaaaagaataaaatggaaagaaaagaaatgatgcaacaatgaaacttaataatagtaactattatttggttgatctttccaaggtacacatatatacagaaagaagagacctctttcttctccaatttaagtaaagaaaaagggtccttcatatttggtttattccacaaagtcctgttaaccacagatggaaatttaggtataaatggaaatacaaactattccttggctctaccaatctaccattagaactatccagaaagtttggattttagaataaagacatggttctcattctctacctatgagactgagtgatatctacttctaaggtcatcttaattgtaaggttagtcaaatttttaataagaaaatagaagttacttattaagagtatgttttccatctataaattcatttaaaaatgttacttttattttactgacttatttactctagaatacacattaatttcaataattattattaaaagcataattttctttgtctagtgtctatagaattaggatgaatatgttatggatcagaaaaatgtacctatacaaaatgctatgcataaaaaattacatcattcaaagatccaaagttaaaaaaatccttcgctaaagaaatattttattactctatctgctgtttcttctaaccctcaccattttattggctctctgtatctatccattgatagaagtttatcttatatatttatcatacccatttagtattaagattttccttgtattctcttttacaaattgctctcatcttttaaaatcagatttctcaataatatttcaattcctcacatacttcaaaatcctactaatatttttaacaaccccttttacatatccttccaaatactaatatttttatttgtccttgcacgctggcttggagagccctctactggcctgatgctgtgtcaaaagaacatttgcttcatccttcagatacctattttttacatgctttcgataatatgataattatataattaaagcctttattccgaatgacagaatgttaaagagaaattgaacaattctactaaaatgctgttaccaaagcaagatacactacttccatagtatagaaataccattttcaaataactgtacattattctcagtactcattataaagccttgctatcatgtgacagaagtccaagatgagaccaaattataacatgatgtattcataactaaagtataaaaggcaagttggagtctctatgttaaatgcctctggcctcaagaaaatctgatagttattttctcatcaatatttcctgattttaatataccaatgtctctagtatttataaatatcacatttgaagatatgatgaaggaaacaattccacttaacttaaaatctaggaataaaggccgtaatgaagagaacaacaataacaacatccacaaatagaagtatataccaccacaaagttatcaggcctcactttagatcccaataagtacgccaacagtctttttctttgggaaataaaccaatataaagtttatataaaaataaacatgcaaacaagttttaaaggaagctctttttaaaactgagtaataattaaggaaagtagccattccagtcatataaattttgttaacgggcctcatagactctatatctgtgttccaattagactatactctccttatgggcaaaattaacctcatttacatttctattcatatggcgtagacactgtcttacctacagtgaatacaaataaatttagaaggaatagacaaacttgttttcctatatggtctctccctctgtaagttttgagatccatgaaagcaggaactatttttcacttttgtgacatcagaatttaacacagtggatgttatgtcactgtttggttaaataggctcatttgtaaaggtgagattcatttataaaatactcattagaatcagacctcattgtagaaaaaattacatagaggaaaaggaaataataatataaacaaaatattgagacaaaattggaaaatttattttcaaattaaattatagacaaaaagctaatttcctttatatatacagggctccaaaaaacaataagcaaaaacctacaacctaacataaaaaatgatcaaaggatatgaaaagaaatgtgaatgggcccttaaatttataaaaagaaatataacatcactcttaagagaaatacatattaaaaccatatgaccataaggagataaatctcccctttcttttatatagacctactagaagggcaaaaatccaagtttaataacacactctgttagcatggctgggagttggggagtgggacggtgagagttcttatacactgctctcctaaagagcaatttgacagtatcagtaaaaatcacaaactcaatacctagaaatttcacttctggaaatgtaacttacaagaatatctgcatatgagcaaaacagtatttataaaaggttattctttacagcatcatttacaataaccctaaactgaaaacaactcaaattttgatgagtagggggcaggtagaataaattatgctatctccataaaacagaagatcgtgtaactgcaaaagcaagggaaaggggtgttatctaggtaatgatagagaaataatcactgtgtgttatataattgtatataacatttaaaaaaaagcaaggtgccagataatgtacatattcttatatttttttaaatgcagaagaaggataaaacacacttatatctgcttgtgatatgcatcaactctggaagggatacaccagaaactgacaacagtagttcctgtatgtgtgtggagaggggtgtgcaatctggacagatggaaggctgtagttggacactctttgccacacatataaataaatataaatcatgtgaatacattattaagttgatttaaaatgtccttatattacaaggtaagtatattattaacacaagctttactactaaaacagctacaaaatcctctgtaatcttacctgcaaactagccacataagaatcctcacaatttacataatgtcctaacatggcatgttgagcccgtaattcattatcccttatcctctcatgcaggtgggtaatttgttgcttctgcctgcaaaacataaattaaggtcacattatgagttataattttctaatagttagaagaaccttaaggagcttattcctcttagattcctttaatattcctcttagattctaacagtcacaccttgctttcttcaacaactcatagcttgctttaagcaagttatttaatttctgtaaatatgtatgcttagaaattttaaaactgttttgtgccaggcatgatgctaagagctttgtatgcagtatctctcatcttcaaaaatttattaactctcatgatgaagttttgaaggagagagcttttaaagaataataaagatagtatgagtaaacaaatagcttgatgttttccaaaattacttacaaagtaacttttggaacaagtaagttgtatgtttcaggttgcatcaaaagaccttgttctactcaggatgatttctaaaatttgctaacctttaagaaaatccacatataaaacattaaataggagataagtcaggagagattcgtcatataacacttttcaaataatttaaagctttacaagaaagaaaaaaaaaaaaacccttccttttccagccaaggtgcagtagcaggcagggactagttttgccctcatgcctgaaacaattttttaaaaaagacaaaatataggaagtgaagactctcaaggcattgggccaccaggcaattaagaacagtaatctcttagagataggtaactaatgaggtgggccctatgactgactgcacttcctgctgagagagttttcaagccccagcacaggaatggtggtctccctgaattgaagacacaaagctgagaatctggagaaaccaaggcagctgtagttagttcacagtactcgataacccttgggcactcggttgaatactaattaatacaggcatgaggaagctaccgacggtgtgtgtagagtggaagggcaaccaaaaaaaatattacagggaacagtgcttcagggtgccttggaattactggctattcccaactgccagaataaaaagcttcatgattcccagggcatcagcaattctcaactggggacagttttgaaaccagttaacatttagcaacatccagagacattttcaattttcacaactggggcagaatgttactggcatctagtgagcagaagccagagatgctactaaatgtctacaatgaacaggatagccaccctcaatagtgaattatctgatccaaaaaaaatcaacagtgctgaggctgagaaacccagggtttgtaagatgagtcttgtctcagtggggaaaaaataacccttgataaaacagctctaatgccacctaacaaaacttaaaagcaagtacaaaaactgcttcctagaataaagttcaggaatacaaaaatgtaatatcaaaaacaagttaaaattcataatgcctggcatcaaaaaattattgggagtacaaaaaaagcagaaaaaatgtaactcataataataagaaaatccaatcaactgaaagtgagctagaactgacagagatgttaaaatagacaaggatagtaaatcagttattataactattcatatgcttaagttagaagaatgaacgaacatgttaagaggagacatacatgacaaacaacacactgaatggtgattaaaacattagacattacagcacaaaagtacagtaaatttaaaaacagcaatagaaactatctaaaaagaaacactagagaaaaaaggacaaagaaataaaacaaaaaagctcatagtatcagtgagccgcgagattataagaggccaaatacatgtacaattggaatctctaaagaggaggtaagaaggtggcagggggtgggagtaggggacagaaaaaaaatatttgtgtataacaggccaaaattttaccaaatctgatgagaactatacacccataggttcaggaagcccagtgaaccccaaataaaagtaacatgaagaaatctaagacaaggtacatctaaatcaaatagattacagtgataaaatcttaatagcaaccagagggaaaaaagataaatccattcaaggagacaaagatgaagaggatggcaaatttctcaactgaaataatgcaatcaataagacaatgaagtactttaagtactaaaatttaaaagctctcaacctaaaatttttgacatgagaaaaaatttgaaaacaacacaaaaagcatacaaaaaaaacctgttaacctataatacttcacccacagaaaatatttttttaaaggttaaataaagatcttttttggaaacttaaaagctgaaagaattgatcaccccagacttcaactacaaaaaaaatgataaaggaacaccttgaggtaaaagaacaatataccagatgaaaacctgaatttacacaaaagaaagaagaataccagaaatgataaacacatgggcaaataaatacataagatatttttcttattatttaaatctcattaaaagatcataaattgtttgaggcaaaaaaaaatttatatccacgttgtataacctttgtagatgtagaatgtatgacaaaacagctcaaaggctagaagagaaaaaaatggaactatgctttataagattcttacattatacataaaatagtatagtattacttgaagatagactgctatactttaaaatatattataaactctaaagcaatcattataacaatagaggtatagctaacatgccaataaagagataacaggaattgtaaaaaaatattcaactaattcaagagaaggcaaaggggaacaaagatcagatgggacaataagaaaacaaatagcaatgccaggcacagtggctcacatctgtaatcctagcactttgggaggctgaggcaggtggatcacttgaggtccggagttcaagaccagcctggccagcatggtgaaaccccatctccactaaaaatacaaaaattagctggtcatggtgatgcatgcctgtagtcccagctacctgggaggctgaggcaggagaatggcttgaacctgggaggcagaggttgcagtgagctgagatcgtgccattgcacttcagcctgggagacagagcaagacactgtctcaaaaaaaaaaaaaaaaaaagaaaacaaataccaatataggagatttaaacttgaccatatcaataatcacaacatgtaaatggtttagatactcccaaacaaaaggcagacattggcagaatggataaaaagtaggacctaactatatactatctacaagaaagaaaaccattctgaacataaggacacaaacaggttaaaagtaaaaagaggaaaacctgtgctaaaaataatcaaaagagagccagagtaactatattaatattagtagaagcagattttttttttttctattttagagacagggtgtcactctgtcactcaggctggaaggcagcggtgtgattagagctcactacagccttgaactcttgggctcaagccatcttcctgtctcagccttccaaatagctgggactatatataggatccactgtgcccggctaagtttttttttttttaattttgtgaaggtgaaatctcactatgttgcccaggctggtctcaaactcctggcttcaagtgatcttcccgcctcaacttcttggtgttggaattacagatgtgcgccaacttgccaggccaaaacagattgttagagcagagaatattgccagggacaaaaattataacttaataataataaaaagatcaattcattaagacgtcatgacatttgggcctaagagcacagtgtctaaatacatgaagcaaaaaaactgataaaacagaaaagaaacagatacatccacaattgtaattggatattttgacacctggatctcaataattgacattaatagaacaagtagacagaaaatcaagagaatataaaagacaaaaacactatcaactgatttgtactaaaaggaatttctagaatactccccacaaaagacaaaagcagcagaatacacaccctcttcaaggatacatgaaacacttattaaaacagatgatcttctgagccatgaaacaagcaccaacaaacttaaaagaattcaattcatatagaatatattcttggaccacagtgaaattaaatcagaaaacaattacagacagaattctagaaaatcctgaagtatttggaaacaatgtaacataattgtaaataactttagggtcaaagaagaaatcagaagataaactaagtattttgaggtgaacaaaaatgaaaaccaaacaaattaaaatttgtaagatattgataaagaagaacttagaaatttattttttattttattatactttaagctctggggtacatgtgcagaacgtgcaggtttgctacataggtatacacctgtcatggtggtttgctgcacccacatcatctacattaggtatttctccgaatgctatccctccccaagacccccacccccagataggccctggtgtgtgatattcctctccctgtgtcagtgtgttctcattgttcaactcccacttatgagtgagaacatgtggtgtctggttttctgttcctgtgttagtttgctgagaatgatggtttccagcttcatccatgtccctgcaaatgacatgaactcatccgtttttatggctgggcatagtattccatggtgtatatgtgccacattttcttcacccagttgtatcattgatgggtatttgggttggttccaaatctttgctattgtgaatagtgctgcgataaacatacatgtgcatctgtctttataggagaatgatttataatcctttgggtatatacccagtaatgggattgctgggtcaaatggtatgtctggttctagatccttgaggaattgccacactgtcttccacaatggttgaactaatttacactcccaccaacagtgtaaaagtgtttctatctctccacatcctctccagcatctgttgtttcctgactttttaaggatcaccattctaactggtgtgagatggtatctcattgtggttttgatttgcatttctctaatgatcagtgatgatgagctttttttcacgtttgttggccatataaatgtcttcatttgagaagtgcctgttcatatccttcacccactttttgatgtggttgtttttttcttataaatttgtttaagttattgtagattctggatatcagccctttgtcagatggatacattgcaaaaatgttctcccattctgtaggttgcctgttcactctgatgatagtttcttttgctgtgcagaagctctttagtttaattagatcccacttgtcaattttggcttctgttgccactgcttttggtgttttagacatgaagcctttgcccatgcctatgtcctgaatggtactgcctaggttttcttctagggtttttatggttttaggtcttacgcttaagtttttaatccatctttagttaatttttgtttaaggtgtaaggaaggggttcagtttcagttttctgcatatggctagccagttttcccaacaccattcattaaatagggaatcctttccccattgcttgttttcatcaggtttgtcaaagatcagatggttgcaggtgtatgatgttatttctgaggcctctgttctgttccattcgtctatctgtcttcgtacaagtaccattctgttttggttactgcagcgttttagtatagtttgaagtcaagtagcgtgatgcctccagctttgttctttttgcttaggattgtcttggctatctagactcttttttggttccatatgaaatttaaagtagttttttctaattctgtgaagaaagtcaatggcagcttgatggggatagtattgaatctataaattactttgggaagcataaccattttcacaatattgattatccctatccatgagcatggaatgtttttccatttatttgtgtcctttcttattgccttgagcagtggtttgtagtgctccttgaagaggtccttcatatcccttttaagttctattcctagatattttattctctttgtagcaattgtgaatgagttcactcatgatttgcctctctgtttgtctgttattggtgtataggattgtgatttttgcacattgattttgtatcctgagactttgctaaagttgcttatcggctcaaggagattttgggctgagacgacgcaggtttctaaatatacaatcatgtcatctgcaaacagagacaatttgacttcctctcttcctatctgaatacttttatttctttctcttgcctgatggccctggccagaacttccaatgctatgttgaagaggagtgtgagagagggcatccttgtcttgtgccagttttcaaagggaatgcctccagattttgcccattcattatgatattggcggtgggtttgtcataaatagctcttattactttgagatacactgcatcaatacctagtttattgagtttttagcatgaaggggtgtcgaattttatcgaaggccttttctgcatctattaagataatcgtgttgtttttgtcattggttttatgtgatggattacatttattgatatgcgtatgttgaaccagccttgcatcccagggatgacgccgacttgtttgtggtaggtaagctttttgatgtgctgctggattcggttttccagtattttattgaggatttttgcatcgatgttcatcagcaatattggcctgaaattttctttttttgttgtgtctctgccaggttttgtcatcaggatcatgctggcctcataaaatgagttagggaggattccctctttttctactgtttgaaatagtttcagaaggaatgataccagctcctctttgtacctctgttagaatttggctgtgaatctgtctggtcttggactttttttggctggtgggctattaattactgcctcaatttcagaacttgttattgatccattcagggatttgacttcttcctggtttagacctgggagagtgtacgtgtccaggaatttatccatttcttctagattttctagtttatttgcgtaaaggtgtttataatattctctgatagtagtttgtaattctgtgggatcagtggtgatatcccctttatcattttttatcacatctatttgattcttctctcttttcttctttattagtctggatagcagtctatctattttgttgatcttttcaaaaaaccacctcctggattcattaatattttgaagagttttccaggtctctatctccttcagttctgctctgatcttaataatttcttgtcttctgctagcttttgaatttgttcgctcttgcctctctagttcttttagttgcgatgttagagtgtcaattttagatctttcctgctttctcttgtgggcatttagtgccagaaatttccctctaaacactgctttaaatgtgtctcagagattccggtacattgtgtctttgttctcattggtttcaaagaacatctttatttctgccttaatttcattatttacccagtagtcattcaggagcaggttgttcagtttccatgcagtcgtgtggttttgagtgagtttcttaatcctgagttctaatttgattgcactgtggtccgagagactaaatgcctataccagaaaaaaagaaagctctcaaattatctcagcctccactttaagaagttagggggaaaaaaagggccaggtgtggtggctcatgcctgtaatcccagcactttgggaggccgaggcgggcagatcacgaggtcagaagttcgagaccagcctggtcaacatggtgaaaccctgtctctactaaaaatacagaaattagctgggtgtggtcgcgggctactggggaagctgaggcagaagaactgcatgaacccgggaggcggaggttgcagtgagccaagatcgcgccaccgcactccagtctgggtgacagagcaaaactctgtgtgtgtgtgtgtgtgtgtgtgtgtgtgtgtgtgtgtgtggcgggggggggttgtgaaactccgtgtgcgtgtgtgtggcgggggggttgtgaaactccgtgtacgtgtgtgtgtgtgtgtgtgtgtgtgtgtgtgtgtgtgtgtgtggcggggggggggtgtgaaactccgtctcaaaaaaacaagttagaaaaagaagaacaaatgaaacccaaagtaataaatagccctatgtatattacagaaattgggtttttcgttgacctttcaatacagaaagatcaggagggtcaggagtcttcactgaagaattctgctgaaagtttaggaaataaaaaatactagttgtacacaaggtaccccaaaaaccagtgaataattcccaactctatgaggccagcatgaccaatatctaaaccagataaatacattacaagaaaagaaaaatacagaccaatatctcttataaatataaatgtaaaaattcttaacaaatggaatccaaagatagataaaaaggaaaatacatcataaccaagcgggtatatcccaggaataacatggtaggttttacatctgaaaattcatcagctacctagaatagaagtagtttccacaatctaaaaaaggcaactacgaaaaacagctaacatcacacttaatggtgaaaggctgaagactttcacctaaaacaaactagggacaagagaaggaaaaggatgtttactctcactgcttctattcatcactgtattggaggctctatttacttcagtagaaggcaagaaaaggaaataaaaagactctatactgaaaaagtaaatccacctttaatcacagacaacatgatcgtttatgtaaacaatcctattgaatctacaaaaaaatacctacttaaactaataagtgagattagattgcaggatacaaaaccaattttatttctatatatttaagaacgttttgaaaatatgcattttttaatcgacataattgtcatatttgtggggtataatgtgatatttagatacatgtatataatgtatagtgattaaattagagcaattagcatatccatcatctcaacctttatcatttctttgtgctgttaacattcaaattactctcttctagctatttgaaaaaaatataattattgtttattatagttaccctatagtgcaacagaacactagaacttctatctagctgcaactttctattccttaaccaacctctctgtattcgctacttcccccagccttcccgcctccagtaaccactatcccaaactccacttttacgagctaaactttcaaaaaacttcatttttgcttaagtggtgagactccttcacccagtcagttaaggagatcgaaatgcaaaaggtcaagcactactcaatcacctaaatggttatagtggcaaatgtttttctgaattgttcctgaagttaatctatacactttttctcatgagatggggagcatttaggaacagtttctatagcagttatttttcccattttctctgctttaacctaataatccagtctcctcctatgaaagttatacgcagtgtgaaaaaaaacacattttttctcatgtaattttggataatatattttcagaagtaatatacaacatataatttttacttaagtgatttgaaaggtatcgctgaccacaccatatcccaaactaaaaagttcggcaggtttactttcaattccatccaattggacaccaaatcccatgaagtctggctctgaaatagcctctacatgtgccatcaacattttaaaggccattactctcatctgcttcttcaaaaacagaaatgttatatatttgattccaatttaagtactatatatgttatagaaatttgtatatacaaacatttttacttttaaatgacagttatgctgctttagaaacaaaagctgcttagtttctcttctgttttatacaatatcaaatgcactgattatcaaaaactttataataaactcataaagaaaccaaagattatttaagatactgggtaggttatttactaaaatgcctccattattacccttcctatattactaatgcctcctgtcaacgtgattttgctgtttccactggccagaagtgaagtccactactggtctagtgactaacagaatataatggaagtgatgttgagccagttctgagtctaagcttcaagagacttcgtatgcttcattctttcttagaatcccacccagccaccactcgaacaaacccaggctagcctcctgcaggatgacagaacatgtggagtaagacaagccatcctgccgtggcccatcctatgccacccagcccccacctgctaccacagacgcataaataagcctagctaaagaattagccaaatgagcaacttgagttattttgaattattccttagtctgattctacaatatataaaattgagaaatatatattttattatattatgtcaataattttctgcattttctattaacttatatccaatggaatggtattcaaaaaaaaataacatcaactgatttccattgtttgagggagggcaaatccatgtaagtaaaactgaactttagtccattttttaaaagtattaatttcaggccgggcatggtggctcacacctgtaatcccagcacttggggaggcagagactggtggatcacctgaggtcgggagttcgagaccagcctgaccaacatagagaaaccccgtctctactaaaaatacaaaattagccgggcgtgacggcgcatggctgtaatcccagctacttgggaggctgaggcaggagaatcacttgaacccagaaggtggaggttgtggtgagccgagatcatgccattgcactccagcctgggcaacaagagcgaatattaatttcaattatataaaattgcacctatattaaattataggtattaaaaatacacatccaactgggcctgtacttattcgtatataacattcacttgtaccagaaacaactaatatttttaagtagctttttcctaaaatcaattaaaactatcttccacaatccttcatttatcaagtatggaagtatcaagttttaaggcatatactaataccaggctcttttcaaaatgttgggaataggctgggcatggtgactcatgtttgtaatcctagcactttgagagaccgaggcaggtggatcacttgaggccaggagttcaagacaatactggccaacacggcaaaaccctgtccctactaaaaaatacaaactttagccaggtatggtggtgcacagctgtaatcccagctactcaggaggctgacgcacaagaatcacttgagcctgggaggtgaaggttacagtgagctgagatggcaccactgcactccagcctgggcgacagactgagactcccaaaaaaaaaaaaaaattgggggaatatagtggagaacaagaaaatgcagatatctgtggtctagtttatattccagtagatcttcattaacaatgctaaatttctaagcaaaatcttgtgaaatttcaactattaaatgcgtttaaaggttgaaattagaattttaaggctaaaacacctactgcgttatcctatgcaagcatatgaaaataagtaattacgagcactggttaagaaaaaaagcctcctggaattgcttcccaattatcatgatatacaacatatttaattatcccaaaagcatacataaatgatgtagaatatacgttaaagaaaatataatgatgtaacatgaaggtttactgctcacaatactcaggagactgtctattaagtataaataattttttttcagagcttaggtactcaaacccttaaacattttagaacgtcccccaaaactgccataattcttaactataagtcatttcattttacacattcgtcatttttgtagtttctgtggcttcagacctagcatacattaaaggaaatgactgctttaaattagctttccaactggatagttctcaagggttaaaacacgaagacattatcttgtagctctaatagctgattagcattgcagctaacccgctacacgtacagaaaagacagaatggagcttccaaataatgaaataattcactaaaatgaataggagggatgacagaaatcagacagataaaccatcagttctaacagtacttctttaaaggattgggattgaggaggggcagagatgtgacatcaatgaatctgtaaggttctagatcttaaattctatgtagtggacataaagttaattgtttcattaatctaaatttctgtaggcctgaaatatttaataatttaaaatagactcaccgatcgattacaatttctttctgccttagaagtccttcttttattttcaacattgattcccacttactgaaatcctgatagccaggtgaataactttgacgagatgatccagtcaaaacctgcagaaacatgtttacacaattagtatactaaaatatttaaagaaaatatttatatattatcatattttcccaaagatttatattaaaaaaaaagaactccctctttgattttttaatactttcggaaatcacactatgaatacaacataacttggacaatttcaaggaagttctaaaggaaatgtatacatctaatgaagaattaatgacaacagaacgtttatcctggcaaattataaaactatataagatcttggccaggcgcggtggctcacgcctgtaatcccagcactttgggaggccgaggtcaggagatcaccaccatcctggctaatacggtgaaaccccatctctactaaaaatacaaaaaattagccaggcgtggtggcaggcgcctgtagtcccagctactcgggaggctgaggcagaagaatggcgtgaacccgggaggcggagcttgcagtgagccgagatcacgccactgcactctagcctgggtgacagagcaagactctgtctaaacaaacaaacaaacaaacaaaaccatataagatcttattcccattaccttgtggaagtggaagtggaagttttctggaaatgagattaatcattaagggagtaatacaatgtaggaatgtgccatggcttaactagacaaacattagcaggagattttccacaagaaaataaaagcagtatctgtagtattcagacttcaagttgacatgcatcacatcatcatttagttacattagaatttcaaaatcacaaatattttcactcagtagtgagacaaccaaatgcctaggcagataaaaaggggtccttggagaatctctgacccactccacaagtgtgcagatgcttctgtgcagatgaggaaacctgcccagggctcatgtgggcatgcccatagctgactggagcccagcatgcgttctgggggaaatgggtggagccatggggaattcctgccttatgcgggggaggagcctgctctcttcagctcacctggtgacctggaaatcaatctgtgaggtggaggacctgttagcagggctctatcttgctttgatgattgtttgtttgtctgtttcttttttccttttcacccaataaattcctttccaatcacccttcaaggtgtctgcatgcctaatcctccctggtcgtgtgacaagaacccaatttttttctacaacagtagtaagtatatccatagaaaatggaaaatatataaccatctactaagtagataatttggatgaaatatatcacttagaaaaaattgcttagaatgtaagaaaggtttcagatatttaaataaaccaacggtagaaactaacatggcagatatccttatatttcttccgttgaaaaagcagcaaacatttaaaaatattggtgttataggtttgactgtattccttaaaaagataagttgaagtcctaacctcttgtaacttcagaaagtgatcttatttggaaatagggtctttgcagatgagtcaagctaagatgagctccttaaggtaaggcctaattcaatgtttggtgtccctaaagaaaggggaaattttggacctacgtacacaaggaagactatgtgaagagacacagagacaatgccatgtgaatatcaaagtagagattggaatgacacatctacaagacaaggaaagccaaagaccaaaagctaggagagaggcatgggacaaattctgcttcacagtcatccaaaggaaccaactctgccaacaccttgatttctaactttcaacttccagaactgtgagacaatttctggtgtttaagctagctcatttgtgatactctgttatatcatctctaggaacctagtataactggtaaatcaaataggaacacagttctttggcaagccaaaagatgtataaacaccacaaagcaacttcaagagaattcaaatgtgtagtgatatttttatcctttactttccaaaaatgctattaataagaccttcaaaataaaccagtaattgcataacatcaaccagtcacagattaactctttgagatgactgtcaagtaatattaggatgggatgtttcatgcaggagacaggataggatgaacagactaaggatagagatcagttgaaaagaaggcacatacttttgtcagatgggaagatatttcaaaagtgacacatagtgttacaggggcaggttagacatctgcctctgaatttcattctctcccttgcctaatatacaataagggctgatattcagccagtatgcatcagtacagataatgttagctgttagaatactgaagtagtttcactgtggttggtaactaactgctgtttacaccactgtgcggactgtctctttcactgtccaggccactctccagaatgccccatgatccaacaaataacacagttactccccagcacaagtgaccttcaggaccccgctccatccataaataggcatcctttctgattagctagttcttgtacaagtcagtcccgcaaaatcttcccagttaaacactacctacaatcttatttatacttaattggcagagctaacattcaaacccaggcagcccaacaaaggagcacctgatcttaaggaccacattattccactgcttctactattgagacaggtttgcagcagaactggtttcacaagatacaggtcacaaagacctggcttataaaataggatggggtaaaaaagctggccaaaacttgccaaaaccaagacagccatgaaagcgacctctggtcatctttacttctcattatatgctaatcataatacattagaatactaaagtaaactcccaccagtgccataacatagtttacaaaggccatggcaaaatccttaagtcaccctatatggtctgaaaggtgaaggagaattctgggaattccttgccactttcctggaaaattcatgaataatccacctcttgtttagcatatgatcaagaaacagccataaaaatagccaaccagcaaccctcagggctgctctgcctgtggcgcagccactgtttcattcctttactttttcttttttttttttttttttttttttttaattgagacgcagtctcactcttgttgcccaggctggagtgcgatggcgcgatagagctcaccgcaacctctgcctcctgggttcaagcgattctcctgcctcgccctcctgagtagctggctgtagaaccatgcccagctaattttgtatttttagtagagacggaggtttctccatgttggtcaggctggtcttaaactcccaacttcaggtgatctgcccgattcggcttcccaaagtgctgggattacaggcatgagccaccgcgtccggctctactttcttaacaaacgtgctttccctgtactgtcggctcgctgttttccttcccgcacaaagccaagaacccatgtggcctcccaggctgaaccctagttttggggttttccctgtggcactatggcctaattaggtgttccaaatttcatcataaggactagaaaactgttttgaaagtaactgttctcagactgtgagaaaaaatttaacactataaacaatattattaacagaaactctctacttaatgaaactccgcattacctactgattatcaatttaatgggtaagtcatttgataaaatctcttttgtcaaactgtggctcaaacaggaaatttattaaagctagtaaaagctaaacaaaagagcattatcactaattccaaaactcaaagtaggatttggaaatgcttaaaatgatgtggtgaattattaaatctgctataatttataatactaatatttcatttacttgggagattaaaaataaatatctatttttatttacctactgagttatacattatttaaatcctaataacagttgacatgtactttaagtattggtttttgtatattatattattttgtatattattagcatgcctaacaaaaatcttctaggctagattaaggatttatggtctcctcttccaaagatctaaaataggtagattctctatttccaatgaccacacaccagcagtcatccacaccatattatttgaagctatatttcaccttatacatcttgtgcctatttcagtaagacaagtacctaggcaacagatgatgatcttctcaagaagacattaacactattttactcttcacaagtcatctgctaaaaaaaatttcccatggctgacaattaccttaagaaagtggcttttcttttctttttctttttttttttttaacgtttcttggcatcaagaaaaagattaaacagaaggaacaactaggcataaagagaaacagcaactgacaacactatttgctttcatagcactttgaaccattggcaggatggactgctaaagtacttgccaaatacttccataaatatacacaaaacaaaatatgagaatgtattattctgtgttgtaactcccttgatctaaaccctttagaaataaacaaaaattgagagctctgaaactgggaaaacaggaataaagaaaaaggattcctttccctgtaattaagatacaatatatttaaaatttaccaaaccagcagcagtcttccttatgatagtcttccttactaaacttaaaccctgattcataaaatagttaatagagagaacaaaacctgacatcctaccaaacgctgtaggttgacttaaaagtaattttttaaatccatgtgtatctacctacctctaaacatgacagttacggagacattttaccttctaaggagaatggcttttataatgaagccagcatctatactacattaaatgaagttatagaatggaatttgaagtacctagcaaaattcaagaataaaaaaatcatattgtgaagtctcaaacagcaaggcaactatacctttatgattttgcattctctataaacaactgatacactactaaaggcatacagaaaaggaacaactaatgaaaatgtattttcattataattgacagtctaggttccagtcttgacagagctaaaagaaaatctgatagaaataacacagaatcattttgcactaaatgtggaaataaatcaggtatctaccccggaaccatttatcttttgaaagtcctaaacaaaggtggaatagtgataagggaattagatgtgttcaaattgattcttcctcacatttccacattacaatcttacagagaagttattcaaaaactgtcaatttaatgtgtctgcaaatgttaaaggttttctgcctttatttataagacaaaattatcttctcttacacatttgatgagtgtttttatatgtatcacataggctaacaacttataaaatcttactagtatcagccaggcatggtggcttgtgcctgtaatcccagcactttgggaggccaaggtgggtggatcacaaggtcaggagatcgagaccatcctggctaacactgtgaaaccccatctctactaaaaatacaaaaaaattagctgtgcatggtggtgggcatctgtagtcccagctactcgggaggctaaggcaggagaatggcgtgaacctgggaggcggaccttgcagtgagccgagatcgcaccactgcactacagcctgggcgacagagcgagactctgtctccaaaaaaaaaaaaaaaaaaaaaaaaaaaattcttactagtatcaattatctattaagtttcaagtattatgcccaaaagcagtgaggagaaaaagccctttccctctgactatgatgccatagcaactttgagtatacataaatatctacttttaaagttctagatggcactgtcttagctttagtacattaatatatgattgtggaaaaggaggaaagccaagcgcaattgccttaaaaccttcagactaaaagttattgaaaatgaagcacaatataaatgttaatgttttcttttgttttattatagaccaggagctactgtggcttgcaaactatgttcttgcacaatactggctaacatgaaaaaatagatgcagagtgacagtatcactcttggatgtaataaaatccaggccaaaaaaaatcattaaataaaaataaagttttataaaactttataaggtaaaagataaaagttaccacgaagataaaataatcacaaatgtttacacatttaatagcatatctcatatgagaaaaaactattaagaataaatggagacataaacccacaatcatattaccaactttagcacacctctaagaaagacaccatgtaaagtggggatccagttcactcttttttttcacagcctgcaaactaaaaccggaattaatattttcaaatggttgaaaaaaatcaaaagaaaaatattttgtgcaacgaactaggcattgaaggaacatacttaaaaataataagagccatgtatggaaaaaaaaaaaaaacacagccaagatcatactgaatgggcaaaagctggaagcattccccttgaaatccagagtaagacaaggatgctctctcacaccactcctattcaacatattactggaagtcctagccagagcaatcaggcaagagagagaaataaaaggcatacaaataggaagagagaagtcaaactatttctatttgcagactttatgattctatacctagaaaaccccatagtttctctccaaaagttatttgatctgataaacttcagcaaagtctcagaatacaaaatcaatgaacaaaaatcagtagcattcatatatgccaacaacttccaattaaagaacacagtcccattgacaatagccacaaaaaagaataaaatacctaagaatacaactaactagggaagtaaaagagctctacaacaagaattacaaaacactgctgaaagaaatgagatgattccaaaaaaaaaaaaggaaaaacaacccatgctctggataagaaaaatcaatattgttaaaatgttcatactgccaaaagcaatttacagattcaatgttattcctatcaaactaccaatgacattccttacagaagtagaaaaaacttgtaaaattcatatggatccaaaaaacagcctgaatagcctaggcaattctaagcaaaaagaataaagttggaggtataacgttacccaacttcagactatgcaacaaagctacaataaccaaagcagcatggtactggtacagaaacagacacacagaccaatgaaacaaaatagagagctcagaaataataccattcacccacaaccacctgattttcatcaacgtcaacaaaaacaatcaaaagagaaaggaaaggactccctgttcaataaacaatgctggaataactggctagccatacacagaaggctgaaattgcaccccttccttatactatatacaaaaaatcaactcaagatgaattaaagacttaattatgaaacctaaaactataaaaaccctggagaataacctaggaaataccattgtggacacaggccttggcaaagatttcatgatgaagactccaaaagcaatcacaacaaaaccaaaagttgacaaatgggacctaattaaacaaaagagcttctgcacagcaaaagaaactatcaacagaataaacaaacaccctacagaataggagaagatatttgcaaactatgcatccagtaaaggtctaatatccacaatctataaggaacttaaacaaatttacaagcaaaaaacaaccccattaaaaagaaggaaaaagacatgaacagacacatctcaaaagacaacatacatgcggccagcaagcatatgaaaaaacattcaatatcactaatcattagagaaatgcaaatcaaaaccatgagataccatctcataccagtcagaatggttattactaaaaagaaaaaaaaatcagaggttggcgaggttgcagagaaaagggaacacttatacagtgttggcaggataaattagttcagctactgtgaaaagcaatttgatgatttcccaaaaactcaaagcagaattaccatttgacatggcaatcccattattgggtatatacccaaaggaatataaatcattctaccggagacacatgcacaacatgttcatcgcagcactattcacaatagcaaagatatggaatcaacctaaatgcccatcaacagtagactggataaagaaaatgtggtactatgtatatacatagtgtatatactatgtaatactacatagccataaaagaataatatgtcctttgaagcaacatggatggagtaggccattatcctaagagaactaacataggaacagaaaacaaaataccacgttttcacttaaaagtgggagctaaacatcgaatacacatggatacaaagaaaggaacaacagataccagggcctacttgatgaggggggcgggtggaaggatggtgagggtaaaaaaacaactacctattaggtgctatgcttgctgcctggatgacaaatcatttgtacactaaaccccagtgacatgcaatttaaccatgtaacaaacctggttatgtacccctgaaccccaaataaaggttggaataaaaaagtttgagagcaaaaagtaaataaaactgtactgtgttttataccataacaataaatctaaagatttagatgaaatggatcactttctaagaaaatatcaattaccaaaattaactcttgagatagagtatctgaatcatcatagaaaggattgggggaaaagtaagtctactcctaaaatgaagtactgattttttggatggtttctacctaaatctaaagaaaatataaaacagtagaagaagaaaaattttgagaaaggtaatagggctaggcttgaaaaataatgaagcatgttataaattgacagtatttaaaacaataatacatcttaaagcaaatacagaattcaaattaatacaatactatcattttgggggatcactgagattaaacaacacacttctaaataatacacaggtttaactgactgaaaatgaaaatatcaaaattttaaggaagcaggtaaagcagtactgagaaggaaatttacagcactaagcagttatattagaaaaagggaaaaagctctcaacctaagcttccatctttagaaactagaatataagcccaaagcaagcagatggaagacaagaaggctgagaacaaaaatcaatagagtttaaaacagaaaaaaacagaaaaatctattcagaaagataagctagttcattgagacaatcaataaaatttataaaccattacctagactgagaaagaaaaaaagaagaggcaagttattagggagtaaaatagatatcactacagaccatcagacattaaaaagataaggtaattactaggaacaattctacacacaccaattcaataacttgaattagaccaacttcttaaaaaacacaaacttacccaaattcattcaatatgaaataatctgaatgtcctataaactattagagtaattgaatttataattttttaaaagctcccaaaaaaatctctaggtccaaattgttacactgtaggattctaccaaatgtttaaagaattaacaccaatcctccacgaactcagaggcggaaaaaaaatgaattatttcccaactcattttatgagttcaacaatgctctgataacaaaaccagacaagacagtaggaaaaaagaaaatgacaaaccaacatccatcatgaacatagatacaaaaaactttaacaaaatcaaaccaaatccaatccagacatagagctatacatagataatacgtttggcatacggttttcccaggaatgcaagttaagtttagcatttaaaaatcaatgcaagctgggcgcagtggctcacacctgtaatcctagcacttttggaggccgaggcaggtggatctcttgaggccagcagttcaagaccaacctggccaacatggtgaaaccccgtctctactaaaaattcaaaaattagccaggcgtggtggctcatgcctataatcccagctactcgggaggctgaggcaggagaatggcttgaacccaggaggcggaggttacagtgagctgagatctgagatcacacgattgcactcccgcctggagaacagagtgagactccgtctcaaaacaaaacaaaaaaatcaatgcaatttaccacattaatagaccaattaaaaacctactagaaccaataagtgactttaacaagattatacaattcagggtcaattttttttaaaaaaccaattatatttctatatattaacaacaaaagggcaattaaaaatgtattatcatttacatcaaaaacattaaaagcttagaaataaaaatgtaataaattatgtgtaagatctgtacactgaaaactataaaatatcactaaaaaaactggccaggtgcggtggctcacacctgtaatcccagcactttgggaggccgaagtgggcggatcatctgaggtaaggagttcgagaccagcctgtcaaacatggcaaaaccctgtctctactaaaaatacagaaattagctgggcgtggtggcacatgcctgtaatcccagctactcaggaggctgaggcaggagaatcgcttgaacccaggtggcagaggttgtattattgacataaggatagacagaccaatgaaacagaataaagatccacaaatctaatgatgcatagagtaaactgattttttaacaaaggggaaaggtaattaaatgggaaattgaatttggtatttataaataccaaataaaggccaggtgcagtcagtcatgcctgtaatcccagcattttgagaggcctaggcaagtggatcccttgaggccaggagtttgagaccagcctagccaacacggtgaaaccccacctctactaaaaatataaaaattagccaggtgtggtggtgcacacctgtaatcccagctacttgggacgctgaggcacaagaatggcttgaacctgggaggcagaagttgcagtgaacaactgcagttacagttgagccactgcactccagcctgggcgacagtacagactgttttctctaaataaataaataataaaaataaatactcaaataaaactaaaaacacgtccacatagaaccataggcaaatgtttactcataatcatccgaaactaaaaacaacccatgggtctgtaagataaacggataaaaacggtactacatccacaaaacacagtactattcagcacacacaggcacacacacaaatttataacatgcaacaacatggatgaatctcaacagcagcatgaaaagtgaaagaaaccacactcaaaggctatcaactatctgattctatacatagggcttctgcaaaaggcaaaacaataagaatcagatcagtggttgccaagcggggtagaggactaactacaaaggggcaaaaggtagctttctggagtgatggaaatgtcgcacacttctcttgtagtaaaatgatcctcatataatcgcagtttcactttctctggtttcagttacccacagtcaaccgttgcctgaaaatattaataatggaaaattctagaaataaagaaaattcacaaattataaattgtactccattctaagtagtgtgatgaaatcccacaccattttgtttcctctcacccaggaggtgaatcatccatttctccagctcatccacactgtatatgctatccacccactggcgtgtagtgccatcttggttaaaggaccaactctcagtatcgcagtatttgtgttccagtaatccttattttacttaataatggccccaaagtgcaagagtagtgatgctctcatattgttataattattctattttattattagctattgttaatttcttactatgcctaaattataaattaaatcttatagatttaatttattaaaggactactgtatacattcttcaaaactcaaattatagcattttatgtaaatttaatctttaaaaatcttaaaagttgcatgtaaattatacttcaattatcatattaaaatttgatttttctaaaattgtaggtaaatgtttacatatctcccactcaacaacagtagaagcaaaaagaacttatcataataaaattgaaacaacccaaatgtgttaacaaaggaatagataattaatggtggtagaagtatacactagaatactatatagcaataaaacagaactactattatacaaaacaacatagattaaattcagagacattatgctaaacaaaagaatgctagcacagaccatacataatcaataatggtaagtcagaacagtagagatgggtaggatataaggtgtcaccataaagactgagaagagtcacaagctaaacctactgggcattagaaattttgtatcctgacctgagtggtgattataaggggagatgtatgtgggtgtgtattggaatggagctattattaaagattaatattcctatgtactttactgtatgttagacatcaacaaaaaatataatacaggaaatacttatactttatttcactttctaccttagaagaagtattgaagggaaataaaggcctcatctgctagaagagaatccttaagtcccaaagatgcactatagatgacagaatgcactgtcgtggctgtaagttcctatctcatcatcactttggtgcaactccacatctgcaactagccatgagataagagaaaaggccagatgacatatataccctacaccaagaatgcatggatgaagaatgaagttgataacaacctacaagctggttcttaggcgctgtcagaactctaggagaacaaagaagccttctattaaggcagaagacaatcctgcttcctaatatagaaaagaggaaaggattttatattcaaataacttctcccctatatccctttagtaacacattttttcccaagtagttagaaaacaagaatttttattcagtaaagtcataactggctttgagaagcataccattgcatggcagttatatattactagtaaaatatacatcttgacaatatcccagaaaaccgaggtacttgttttgatagaaaaacatgtatcaaaattcacatattgataaatcataaaattactgttgctatgctgttctacttagaatttcaaagtaatctatcatgtttctacatcactgtaaccaatataagtaatctagaacatgttaatttaagcatataatttataacttattaatgacaaaactttgacatgaacatgcaatgtaaaaggtagttataaaccttgtaactatgtgagttaatttgaagaaacaaagtatgccatcaaagtaacatttcaaaatgtgtaaaggtgaaacagagacatttttacaggtaaacattttatatatatatttagtagctgccaaactcagggagcactgggaaggcctcatttagatgttttacctaaaaatgcatatgacacactgttctctaccctaatgtaggcatgtagaccctaaccatatagatttatagacccagaaaatatacataggtacctcttcttggaaatggcagattccactctcaaaattgagtaaggatagcaggcatctacaacaatcccaaacacatgctacttagatgagatccggatactatgaaaagttgccaaaatatgtcacttaatggccaaacatgctcctaataaaagtttactgtagtgcagctgaaaatagttcaaaattctttggcctggacaaatactgttaaatttagataatccagtgctaccacacttgactggaatacaacctctgcaattcttcaagtttgttatctctccttcacttgcctttgtctctgagcttattcatcactcacaacatgtcacgtaacacagtaaatcttcctctgtttcctggaatagtctatctgaagagatactctacaagtgttttctggtaagagtcataccttaactaaaaagtaaataaattcacaaagctcagtaatgaagatgaaaataatacaaataacataaaatttaaagaatctttattcaccaagagaaggaaaatatgaattatgttattactaaaagaactgtgcacttaatataaaatctacgtcttaactaagcccatgtaattatttatggagtgcattattacgtatttctctaacaacaacaaaaaaaccattctatcagtcaccccttcctattatactgaagtctgcatcttgaccctcaaagtttatattatagaagaaactgtttttaataatctaattatttcttcaatgtgtttttgttactaactctgtaagctttttgacatcctaatatgatttactgaaataacaattcaagtaaattgagttacttgaaaggtaaaagaccctgaaaaaatgataaaaagaaactgatgatataaatatatatataaaaaacatcttaagaatgcatatgcatgaagataaagggaactcaaagtatttctgatttccaacatgctaaacaactaaattactattatctcttttcttttggagggagaaaaatttttcctcttaaaaatcaatccagtttatatatcatcggttagtattatcatgtctttaaaaaattccaacaaagaaatgagccatgcatgcaacatgatctcattacaatcatagtacaaaagtgaagagaagaaatggtttatccaagacagacagtaacttactttctttaagcaaatcaattagaagattaggtaaaacaaatgaagcttaagtattcaaattaaggttaatcatggactttacttataaaacaaatagaatgtaatgttttccaagcattttgttgctataatttactttttaaatttttagatgaaatataaacagaatttaatgaatcaatcccttgtaattaacaaaccagacaataaaaatggaaaaaaaattaatgatataattgacaatttatgaaacaggtatctatgaaactgaaataaaagaagtttatcaaaatgaagtacttaatacaatatggctctattttggatcttgcccaaggttatgaatagcaaatttactacactatataaccagcttctactaaaacaaagctatagtacaggtgctaacattttaatttattttaaaaatcagactaacaacatatatttaatcaagtctttatcatattttactctcaagggataaaaatatttgatagtcatgcactgcataataatgttcctgtaaatgctgcacccttaagattatacctcattcttactatatcttttctatagatatatttaggtacacagtaacactgtgttacaaattgtttacagtatttagtacaataacattctgtacaggtttgtagcttaggagcaaataccatatagcctaggcgtgtagttgttagtcggctataccatctaggtttgtgtaagtacactctacgatgtttacacaataaagaaattgcctcatttctcagaatgtattcctgtcattaagtgacaaatatgttaagggaccaaagcactgcctacattatcttgaaatgtagcaatgaatttttctaaaaggatataaaagaaactattttttacttttttttgttaaattttattttaagttccgggatacatgtgaaggacatgcaggtttcttacataggtaaacctgtgccatggtggtttgctgcacctatcaacccatcacctaggtattaagccccgcatgcattaggtatttatcatgatgctctccctccccccaaaaaaagaaactactaaagggagctatcttgaggggagagggagcatgcttttactttctatcaattgggatttatctgacttttcctaccatttacatattacttttttcttttctatctgtgcagttatgggtcactaatgttttcttcttttatatgttaaaaatatcatttttaaaatggtctcaggagtcaacaataatctcatggtgaaactgttgagtggagttcagacagctccctgtatatgtataggtcataaaacaggaacaagttgattgctgatgccgatgtctttttttttttttttaaatctccagagtccagttcatcactggcctatagtacacaattaacaaaaagaggatgagtagctagaacaccctagggatatttatcagccttgaaaaaaatccaaaagtatttccaacagcaaaaacaggtactgtaattagcatactgtaatagtaattatggcagtggttcctttcctgtatcatgataagttgggtcttattcatttgtgccctgatactcagcacagcacctgacaatgtttattaactactgactgatatgaaaatttggagatttctacagaaggttaccattttgttagcaatgatatgtgttaacagtaagaaatatctacacttaaaagattatagctcaaagatcagtatgcaaacctatgtttgattaaaaatcatgctttctggccgggcacagtggctcacacctgtaatcccagcactttgggaggccaaggcgggcacatcacgaggtcaagagatgtagaccatcctggccaacatggtgaaactccgtctctatactaaaaatacaaaaattagctgggtgtggtgatgcacacctgtagtcccagctactagggaggctgaggcaggagaatcgcttgaacctgggaggcgaagcttgcagtgaaccaagatcacgccactgcactccagcctggcaacagagcgagaccccatcttaaataaataaataaataaataaataaataaataaataaataatgctttctgacccttgcggtctagcctcatttcagtcagacctagggaaacttcaactaatctgcacaactaattttagtttgctattaatatagagataaatttgaaagacagtcttcaatggccatacttcgttctattttggaagtgtgaagtttcaggagcatgttttcattgtctaacattcattatacggactcatacttatccaaatattgaattttgggttatgttactttttcaagttagctaagggaaaaaaaatcaatgtattaatactggagtcaacaatcaacttttcagatatccatagtaccctcaattaagcaataagcccattgagaaaagaatacattaacggggcagccttacaaatgactttgccaaaggcatcctcttgatcctaatgttggtcctggagcccactcatcacctttgaccaactgaagggcaaattaaatcagcagatgatgagatgttcatgcccttttgctatgctatgcaagcttttaatttggagatgagttaaggatgaagtatggctttcctgaaatatagcaaaaccatgtataactctcagtagcgtaattaagttgccagtaaaaagttacaatgcttacatatcaggaagttgggtttatttccactggaacatttttacatcttttgctttataaagtaaatatgaattccacatatcaaaatctattttcataaccttctcaagaatgtatctgctgaaaaatcaaggttcagttctaattttactctacaaacttaaagagggctaactgtgtaactgaagcatagaagccattatgttttagaggttctccacctgaagcaatcaagaacctatcttaaatgttgatattatcaaagtctttaaataaaagctcagatctacattaaggtaggattacctccctcatccttagagcaggagcactgatcaaaaagccacttgatcttaactaaaagtgcaatttctttagttgcttagttggtacagtcatgtcactcaggatgtttactaattcagagtttaattctcaccccaaaaatgtataattttagctcattttctcaaagaagtttctctaattataaggaaatgtaactgaccaaatcttgaaaattattacatttcaaaaacaaatcaaattcatttacaagcctgatcagccttacatgaactaatgtttaggaataacaagtttacagaaccaagagaaaaaagagaatttaacagatttatttacatagatggaatcacagtgttgttttttaaggtttataatggcaaaaattatatcccctgatattcaataagaaaattcacaaattatggtgtattatatgccaaactcacatttacatagtaaaaataagacattaaaatttgtaacatatatttttaataaacagcacacaaaaatgcccaagcatatttaaaattattctccaatgaacaggtaatgttttagggttttttagagtttttaaaagcttaacatgcctgaagataaggactttttttttaagtgcattccttacctaatagagtgcctgacaaccagtaaaccagtagtttaaagaaatgaattaagaactggcttcttgtgaaatttacatgtttaacaaaattagctaaaattaatagctactttcaaaataaccacatttttcaagctagtttagtataatcagaacatttgggcttcaaagagactttagaaattaattcgatctgccttccatttatttacgagaaaactacagtacagaaagattcattttctgaaaatcatagagtaaggtagagagaggacaaaaaaatgagaatgacagttccaattcaactcctcattaatattccttgaccaaccttcaaccactccaaaaatctcttatattatggttacacaaaactatggaatgccattgttttggactgagacttaatagcccacgccaaaccacaatgcagtcactctggtttgttttgggctgagtcttaacagaccagaccaaacaagaatggagccactcctgctaggagccacataaccaaactgaacttcaacatcaccaagttttcccaaaaaaaaaaaaaaaaaaaaaaacaggatattcacagcaaccaatcagaaagggcccagtttacctgaattagcatgataaagaagtctgttttaaccttataaggaaagtaacttacaataaccaattcactttttgttccttctttctttagcctctttctgcctagaaagcccacctcctccacttagctcatctgatggcctatttttatagagacactgcccaattcatgaatcattaatcaaagccaattaattaaactcaatttgttgaaattgttttttgatgttacacacacgtcaaagtgtgaacaagttaaagaattaagtgcaagaaaaatctcaacttttcagaggcaatcattagggacaaagaaaattagtttatctaagtttctgagggcctttattctctcttctttcaacttatcctttttaagagttcacttgtaatagaaaaataatattctaaatatccattaagtataaaaatatcttattgagccttctaagggataaacagtgtgtagagcttaaaaaaatcaatcagtctctattcatgaagtttatggcaaggaaaataaatagacctatataatataaaaagtcccccaccaacttcagatttatctgacttttctgaattataagagatattcacttattacttgtataattagaaattaagaacaagcaaaacagggcttctccccacctacttctgaataatgaaggagttctataagaacaagacagtaaggaaaataattcggatagaagaaataacatataatggcagagttgtcaaatcgttatggtaggcatacatggcaatggacagatcaggaacgatgttttatgtaattctgtaaagagtgggtttttcatctcgaaagagaaatcaataaaaagttctcagcatgtgaatgacaatcaaatgtgcacttggatatcagagtaaaaactgagtaggaaagagtcacaacgaagggtagaaaaactagttaataaacgtctatgaaagttaagaggagagttggtcaggctatgagaacaaagacatatttcacaatctgcatttggtttctaagtgaatggggagtctggcagaagacagaaaaggtatgagcctccaatttcaattttgtatcaaaatcagtgatagtgccaccacaaagtttgcgaatgcgaggagctcaaagggctgagatatcaaccacaaagataagaaatttaatatgtctggagaaatactacaatcattaaattgaaatagaaccttcttaacaatgtaacagcatcatgatcgggaccctatagaattttgaagcaagtatttggagacctaagggttggtttttgttgttaaatttgttttgtgatgtatgtgtttccctttgttatttttggctttggttctgtccgtttcctttgtacaaaacatgcacttctcttagaagtcatactgcttattattacacgtgctcatttgactctcaattgggaatttctttttctcctggtgttatcttgcactagtggttaccttctaaatgttaaattttcatttccatattatttgtatactgataaaccataatttccttgaagccacgtagcatgctatagcatttctatcacttagaatgtttaataactttccaaaatttatgtagacctatatgagtccttttcttaatccatctggcctctcttaatgtcaatgctcttctccacccctcatcaagatgaggaaagagaatttgcccagaattcagatatttatgaaaaaataaaatgtttgggtctccaggttatctggcaaatcaagtgaaaagtgaacctacctcccccaaatgacccctaagctttataggttactttatcactgggttatatcaacagccccccaactccagttgatgagtaaatcttattttcttttccctattgccctatggagagaatttccatcctctcaatctcagaccactaattcttattcgcagttttgcttagatgttttttgaaccagtccttccctacgtagctttaaaatttaaggcagtaattatcaaaccctcaagtaccctcaagagataggtaaaatcttcttcctgggtgtctaggagatctaatctaaaaaaagctccttatctttgatgtattgtgaacattacaaaaattgattcaaagcttgcattttactgtatctctgtctaaatattaaaatgctttaatttagtcatcacttatattaacttctggtcaaaaatttccaaaaaccgattctattttgaagcttcttcgccctccggatacaccactacagactggagtttaaatgctcaatgtaaaagattactacatacatcacagtgcccttcacaaaacgttagtaatatagctgggcgcggtggctcacgcctgtaatcccagcactttgggaggccgaggtgggcagatcacgaggtcaggagtttgagaccagcctgggcaatatggtgaaaccccatctctactaaaaatacaaaagttagctgggcgtggtggcacacgcctgtagtctcagctacttgggaggctgaggcaggagaatcgcttgaacccgagagggagaggttgcagtgagctgagatcgcaccattcactcggggctgagtaacagagtgagactccgcacccccttccaaaaaaaattagtaatacttttgaggaacacatttaaaatgctacaaaactatataaaaacaaaagtaaagacatgaactcatgattcagttgaaactgaatactaaatttcatttagagcttagtaaaaataaatttgtaattattttcccatccaagttcaaagacactttacccttaagaatccaccttctaaaggaaaaaagaaaataagtgctaacactaaatgaacactgttgcaggatctctgataatcactatgtacacttcatgtcattaaaccatcacaaatactattccacagattaggctgcttaggaaagttatttgtataaagccatgtgaccaaaaatacattcaaactatagtgtaactccaaatgaagactgtgacaaagcacctcaaaaaaattttctagcctctagctgaggaatcattgaggaacactctactgataacactataactcattaatactcctattaaacaactttctgtttgggcaattaaaaacaatgttcagttaaaactaaaatctaatacttcctagagttccacatgagatcatcaccatcatcgtcatcttcactagctaacccaaaggaacaaggtaaacacaaaaactccccactcttgtaccaatctaaaaagtaaatttttgaatccattttccaactgtgtcacacacagttgttagtatccttctaaggtgtgtatatgcctatgtatactttttaagtaaacttataaacatgtggtaactagggcatattttattctgtctacggcagcttcttggtttatccaactaagtattactaattctattttcttagaatgagaagttctcagaacaatgatctatcacctaaatttcaaatgaatgtgtaactggtagacaaacttaaagcagactttctaaaactattaacagtgctcaagaatgcatctatttacatcttaaaaatttctcagttactatatgctactctaatgaaagctatattcaaattataattttttcccacagcatgccaacagattaggaattataaacagacagatctggatttgaatcctgtctattctttagcagctggttatctctgacaaattactgtaaacctcgttaggcttctcggttttgtattatcaatcatcattggtaactgatagtactgagagatcctcattatgtaaggattgaaagaaaaatggttgtagcactgagaaaagtatcaaacattattctgcaatttccttaacttgggttttacttttaagttgtaaattttcccttggcaatgttcacaggatatctttgctaaaatattatttttcagttagttttaagctgactctttaaatatcaaatgatttgctctagagatggattttctttctttggaagaagccaagatcatttccatttaagggcatgtaagcagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcatttttatagtaattttcaggaaagcaactgctagattaaatgaggcacatcctttcaaaaacattacaaaacttaaatttcaacacatcaaacctataaagcctcattaactgagatgtaactgatttggaatctgtaattatttcttttttgccataaagttgcccttaatactgcatcagtttattaaaaatttggtaagattgtgtaataatttaatgcaattgtttttaaaaaatcttaaatacttaaagtagcatattgctattttgggggtgttgtatgtatcagtttaaatataagtattactattcacaaatatattgttaaactgctaattgaagaaaacacaaatgaattaaatacatttattagttctttaactgtaagataaaaataattttttaaaacaaaaagcaattagcctgattttctcatactccttctcccatacacacaagaacaagaacaaaataagaaaacaggtataaaattttattgtgtaaaaatatttcactttcactaaaagctaacattatgaagacacgtattaaagcaacagcagcaagaattcaatgaaagttgttttgcttatacctgtgtttatttttctcataattaaaattcctgcagtaactattttagctcttcaacatcttcaccattaatattcaattatctctaagcctgaagatgcatgaatctttaacaaaagctttccaccacctcaagtttacttatttttttcatttatctaccatatactgttttaaattaaaaacaaaagatgaagcacaaagtgttaatgacttttccatacctaaagtaagaagttctaaagtttggttgtgataagactgagactgtggctaaccaatcgaaacttcagaattcctatgtgacatcataagacctccctagaacactttttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactcagtggggctgctctataatacacttacaattgatactaacgataaaacgctctaattatagttttaattttataggggtttttttggtgactttccccaaataaaacaaaatcaagacgcccaagtccagacacacaagagggcagacgtatataagataacaaattgctactacatagcgattatttatcttttgattatttttgagacttctggcaaagtaggactataataaattttcagaaaagatctgctcttctgctaagtaacagcacacttcaaaatgtccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatttcatgttagacaaaaaacaagtcattttactttaactcattttatcaattttttttttttaaatcaagagacagggtgttactctgtcatgcaggctggaatgcagtcacatgatcattgcacactgcagccttgaactcttggggtgcaaaggattctccaaccttggttcccaagtagctggcactacaggggcacatcaccatatatggctaattctttttattttttgtagagatggggtctcattgcccaggctggtcccaaactcctatcctcaagctatccaccccccatcagcctcccaaagtgttgggattacaggggtgagctaccatgcttggtccaaattttttgtttatacaagggaaaatctccagtaaaatatgtataggtgccaataccataactgttcaaacacccttatgactaaataggcacaaaatttcatctttttaatgactgccacctgaagttcagaaacatcctagggaaaaaaggataaacaacttcatcaataaagaggctactattatttcactactgtctgggagatccatcgtgggcttacaggaatccaaatggatactgccgttacgtgtagaagtgtttatcctccatcccttccaccctaccttccccaagaaaaggaactcaagggggccatggaaagggaaggagtcttcccaaaaagaccagactgtttttcctcctctgtcatagtccctatagagtcaggcagcttaggggttgcagggggtgggtagcataagtgtgatgtactaccgaggaaagagtcaaagactagcagtaggcattacacatggagccttctgtcataaaccatctgagggcataatggcttcttttcattcacaaaggaaaatgattcagagtactacactcctgcactcttgatgatttagcagaaaaccatggaaatcaaggaacaacacacacataagaatgtgtgtctggctcaataattattctggactaagtcctaggaagagcaaaccttcaatgttacaaattaacctggggagtggggagctgtgagaatcaaatgagataaaatactgtgaaagctacagaattctataacatataaatctaaggttttattagattatgactttcagccaaattccttttcttagttgtaaaaatattgttttttcatggtgagtgtttaggagttgtgcttgcaaatcacaatttatcagacggcctggtccttattaaggttcttctctttatgtaaaaattagactaaaagaaaatcagtgtttctatgatttttatcttttttcctttttagagacggggtctggccatgttgcccaggctagtctcaaactcctggactcaggcaattctcctgccttggcctcccaaattgctgggattacaggcgtgcgctacagtgcctggccagaagtcaatgtttcaaagaggcttttaagaaacaactatgatgaaagcttttaaaataaagataatactacttggaggctccaagaaggtatttaacaacttttttctgtagttttctaaggaggaaattagaagggaagcagtcatttaatgattacaacttagtttgtctagttttctttacctgaattcatctttctactccaaaacttaaaagcgctataaagagaccatcccaaataaagttaatcaagaagtagggctttccagggtatatgcaaattttgctctttagttgccttctctctctactatgcactagaaagaagatttaaaaacaaatttatctcaacagtgtgtccccaacctccctaccctcctctgcattgctttgaggctaagaaaaacaccttgtttaaaccagagatttgtccaagcagaataaaaagcatgaatcagtatttactccttgaaatttgcccaattatctctatcacacctactctagtttggaatagcatactcagccccactggacagctccaattctgtgtaaagacaccagctggagaaacaactgcctggatctctgttttcctataatgacaaacatttgaaaactaaaacttgacagtatttgaaaaattaggtttcctatttttcatcacttgaatggataaatcacaaatttctaattcaatcataatgattcttctgttttgattgtgttgtttaaatacataatcaaaattataagaactgtatctaaaataagaataaaggtacatgcgacatgttaagggttctcctatgaatgtagtatgttagggttctatgttttgagatcatactcatatttgtgaggttcctggacaagtgatttccttatcctttcatagcctatgttcatttattctatttgtttttattagtagtagtaatgaataccaattttacatttttactctagggaaaatttgcaattttttatagaattaatttgtttcagaaaattctgatgataaaaaacagatgacaggacttatatcagaaaattagtttccttgttaaaacaagctacagaaaattgtcttggaatagaaacattcccagattaagaaatttacacatttacatgctattccctagaccaactgggggctgtatactatttttctttatatatgatatcatcataaagcactttctataagctgattaatgaatgccttgacacataattttttttaaaaaaaagtacatctgatttataaacctaaataacatcatgtatcaccaaaactttacaaatgactgtagttccaccttctcattgtacagatgaagaaactgaggcccagagaaattaagtgaaaaagtcatccacgttctaaatctaacagaaccagacacaaaatctaagaccttgtatagccaagttgatgctctttctattatacctatgctagcttttttgtttctgtttccaagtttatttagattgagtatgttttgctttatttttatgcccatttaacaaatgaaaaggaaagaacaagctaggtacaaggttttcagattttcatgttaattagtctcaaatgctttgcaagtttatcaacaacacttttcggtttgtaacatttctgcctattaacttgcagggaaaaggaaatgcaaaacaatctgtgaacacttgttatatgcttactgtaagtgtgctactgtactcataacatccactggagggaagcaaacactagattttgcaccttacctgcattggtgtttcacttccttgtcgaaagtcttcaatttgctgctgttgccaaggagctaaactgtaagaatcctctgtatttctaccttccaaaggatttgtccgcagctgctctgtaagccacatctgagtccttacggaaggctgaatgggaactccacctactgcctgttgaccaagcattaaatattttggaggttcaaaagcctctgagcttgtcataatgggcttgctttcaggtaaggcactatatgtcatgtctacaggctgtctcctaagagtagaggaagaggctctaaagtcctccttgctacagctctcaaatttatacttgcagtccagagttgatgaccgttttttatttatttccttgtcctctaacctaagcatctccatactatcatgtaaacagctaggcccaattgtcctcagttgtgatgttaaagccttagccttccctatcttctccaaaccattccttgactcttctctgcatacagtgccaccctggccacagttatccggggcagtgagtttggataaagatgaccatttccgaagtggccggaagtccttcatgtctagggaagagtcctgctcccccctactgtggtttcccaatgtttgcatgaggcttgtactccattttgagccatctggtgtcaatgattccctaagtttggaaattgaagcgctggaattagacggcatcacatgggcagtaggaagagtaatcaatgattgactaggcttaaaagataatgtgccacttgaagttgaatgatctggaaagaaaaaagatggtcaaattagttacaattaacagacaaaagagaatgaggtaaaatgcaatatgccaaaagaaatatctgaacatggtttcatagcacaagcttttttttttgagacgtagttttagcttgttgcctaggctggagtgcagtggcaagatctcggctcaccgcaatctctgcctcctgggttcaagtgactctcctgcctcagcctcccgagtagcagggattccaggcgcctgccagcacgcccgactaattttttgtatttttagtagagacggggctttgccatgttgggcaggctggtctcgaactcctgacttaaggtgatctgcctgcctcagcctcccaaagtgctgggattacaggcatgagccactgtgcccagcccagcacaagcttttcaaaaagacgtcctcaaaatgagtaaattattattatccttttatctgaaacaagtcaacatagtttcagattggattttctaaatatggatacctaatagagtatatggcctttcaccatctactgtacttacaggtgaaaagtgatttaaaataggtttatatttaccctaattaaagtattgtacctttaaaaggaaaaatccaactccttactgagaggtgttattcataatccagcaatgaagtctcagacacaactttgtcagaaaaatggtatttttcagtgtctttcctgaactgtgaaaatctatgccagatctaaacattttagaacctccccaaactctaattcaaatgagaaatatgagtaaaggtgctcctgcaataatgaaaaatagtcccaaagggttcacttccagtctcatttaatggcatatatatatgtgtgtacatatatgtatgaatatatatgtatgtgtgtgtgtgtgtgtgtgtgtgtgtgtgtgtgtgtgtgtatatatatatatatatatatatatatatatatatatatccatattcaccccaagctagaaccttagagtctacttttattcctttctctctatatttattaaatccccaagttgtacatttttacctccaaaatagttgagtttctattactttaggtcaggccctcacatcatactcttctatacaaatgaatagttttagcagactaaatgaaaggctgaaagataaataatggcttaaatactcaataaatttaccatcaagtgccatgttatcatcatatatatcaaattaaaaccaaagactataattttgtaatcaagggatatctagaaagggggtagcaatttaaattggtgtgtggggaggaagtaagcgatggagacctttgcaatttattctgtatctccccacactgtttgactcttataccagaagatacttattacttgtattctcttacattgtcttatggaaaaagttatgttgataaagttgtaagaaaattcagattaaaacgagccaggtagactattcaaaaaataaaattccagtgggtctttgcacagaatgtgttaacttggacatgaaaagggaaaaacattacaaatgaaggaatataaacagaagtattgtagtggatagttatcatattcaagactgcctatcagcttctgaagaaacttcctgcatttaggaaaattctcacattactgactccaaccctcccaaaatatatttcagacctcaaaatcccagtacaccctgaaactatgatgcagacattcagaggcagcagcacaagattgcagttttggaagtaagtcacatgataaaatggactcggtgtggagctaccatttttgggtgatacaggcaacagcagaggcatcacctttccacaacagcagtgacagacgtggccccgtagtggctgcagaatcaaaattcctatcccagaactggcagcagctagacagcttagtggtggaagactgacagttctcatatatgatttgaggcatattacttggaagcttatccttaagcctggctctccagccttcctaaaaattctgtgaagcaccaaatatatttaagtaaatttcctatgtgctcaaccagccagtaaacaacttctgctgactgaaaacactgaatcgtccaatcatgaagccaaaagaatgtggctgtataacaagaaaaataaatccatgtatctacagtatggagttaaagtgccaagaaaagttgtcaaggtaactcttgataggtaaaggtgaagcagaattatacacatcttcaaacgctctgctaagtaaagagcctggccttcattcagcatgaaatgtggtatcactgagcttccaaacaaaggagtgaatgatatgatcaaaaaaattgtacttaagatgactgattattctgacagcagagttgccaatggattaaagcaaaacaactggcaaacacagtgattaacagactattctggtaatcaggagaacaagaaaataaaggggaatatgctactgagggttggttctaaatagaaacaggacagacgtccccaaaagtttatggaatatttgtattcacatattatagcattatatatattttacatatatttgtattaatattactaaaggagtagttatactaaaatcatcatagcctctaaaagatatctttaaattaaaaaaaataaaaaattagtcttgtatcaagttgcaggtaaaaatacagaccaaaggttaagtataacagttttaatttcaaaactattatatagagtaaaatatagggctgggggcagtggctcacacctgtaattccagcaatttgggaggccaaggcaggcggattacttgaggtcaggagttcaagaccaccttcaccaacaataatgaaactccatctctactaaaaatacaaaacttagccaggtgtggtggcaggcgcctgtaatcccagctacacaagaggctgtggcaggagaatggcttgaacctgtgaggcggaggctgcagtaagcagagattgtgccactgtactccagcctgggtgacaaggctagactctgtctcaaaaaaaaaaaaaaaaaaaaaaaaaaaggagtaaaatatacagccttttcatggcacatgtatacatatgtaacaaacctgcacgttgtgcatatgtaccctagaacttaaagtataataaaaatatatattcaaaaaaataaataaataaaaataaaaaaataaaaaacatacagcctttttagattcaaattctggctctatcactcagtagttatgcatgctcaaacatgttatttaatagttagttacctcctccatacaatggagatgacaacagtgagaattaaatcaaaacacataaaatacacagaagaattcctggcagaaagcaaaatgttagttattatgatgtcattaaaaagctacaagtaaatattaatttcaatgtaacagacaaaggctaaatacccatacatataaagagcttcaacaaatcaacaaaaaaaaaacctagcaactcaattttaaaataggccaaaaaaattcaataagtaaataaacaagaaacacaactagagaatatatattttttaaaaatcctcaaacgcactaatagtaaagatacattctctatcatattcagaaaactattaaaggctgcaaatatactacagtaatgggaacacaaactgttatagtctttgaaagaagggaggcaatttgtacatatcactgtttaaaatatgaatacacatatgtgaacatacatatctagatatgtagatgcgtgcatatctatatataaatacatatacattcattagcagagaaaagatccgaaagaatacacacaaaacttaataaacaaaggtaacctctacatagtggaaagggggcaaaaggagaaaaatacttccacattttactttatacaatgtcttattttaattgcttccaaggaatataacttgaccatatggtcaaacttctgcaaaggtattttgttgttctgtgacctcaaaagagtttaaaatacttctaaagtatgaataataaataggtaattgtctcactttccatatcacagcggaatcctctaagacccagtttggctgcttcttgtatccagtaatgggctactttccaatctgcctttactaactcagtactttccaaatgcaaagaaaaatcagcaatgagtgaaaaatcaatttcacatcagactagtgtttattccctaaatctgaaagcagctgatatatgctgtccatagactatgatactgaatatagaatttattcctaaaattcccttattacaaattctcaaatcttggcataaaaaaagttgcctgagagctggtgccctactccaagagattatgatccagtaagagtagagaagggcctaggaaataccacttctaaataagtgattttgctgcttcatttactataacatcattccatatgggtctgattccagttctgaaggctttaagcttaaatatcccaagttcaaccataaccagtatctgagttctagtgtaaaatctgattaactgtgacattcagaattcattactgtcaaaactaaggatcaaagcttagtctactgacatacatatgcacacacacacacatgcacacacaacatatgaataaatgaaaaaagaattatttgaaagaattaaatatttagtatttataagagaattaaatataagaattaaaatttttaaattaaatatttaagaatatatgaacaaagaatattttcccccagtatgaatatctaggtgggaaaagggtcattattataccttagaaatgagtctagaaaatgttaactttaacaatttcaacacttaaaaatgttattttaccctgaggaaacacagttaattagaggtagatataatgcaattcctaatgtgcttgattaggctacctaattgtagccacaaatcccaaatgcaagttattactatctatcccacatctaagtcacaacagtgatatctgaaaccaacagagggtagtccttttaaaaacaagaatgtggcttatagcattgacagtaggcatagatgagctaatggtttcagacagatttaagttttaaaggccagaatataagaaagggacgctgatatagtctgataatgcaagtgagttgtatttaagacagcatatttctcaattccaaacaaaatcccaatcttctgtttcgctatcatgttattctcatctggtattaaatgaaaacattgattctatcttctcttatatacagggatggtatctctctctctctctctgtctgctctatccttctgatagtaataaggaattaaatgcaaaaaaagaccactcccaccctccagatctacattaaagaataaatcatcagtcttcacagtttaaaaaataatcagtaaactatataaccctgtatcaaaacactgatttaaaataacattttcatacttatcagtcaacataaaatattataacaaatattttattttttaaataaaattgttaaccctaaccacaaaggcaataattttgttttgttttgttttcttggagacagttttgctcttgttgcccaggctggagtgcaagggaacaatctcagctcaccacaacctctgcctcccaggttcaagcgattctcctgcctcagcctcctgagtagctgggattacaggcaagcaccaccacacctggctaactttgtatttttagtagagacggggtttctccatgttggtcaggctggtctcgaactcccaacctcatgtgatctgcccgccttgccctcccaaagtgctgggattacaggcggaagccaccactcctggcccaggtaataatttttatacaacacaatgagttttttttcccttcctgctaacgccatgatcatatcatgttacataggaaaaaaaaaacatgttatgccacatgtaacccattctttaaaaaaaaaaaaaaaaaaaaaaggtgtattcctagcactttgggaagccaaagttgccaggtgacgaggtcaagatatcaagaccatcctggccaacatcgtgaaaccccgtctctacttagaaaaaaacaaaaaacaaacacaaaaaaattagcagggtgtcctggtgggcgcctgtagtcccagctacttgggaggctgaggcaggagattcacttgaacccgggaggcagaggttgcagtgagctgagattgcgccattgcactccagtctggagacagagcgagactctgtctcaaataaataaataaacaaataaataaatatttcaaagtattctctatatttttaggtaaatatattttaatattctaaaccacacactgctaggagtggggctatataaagtaattcatctaaagagtctcctaggaatgtatcatgtacaaggcattatgctaggtagaaaagacaatacaaacatattaatctcaataaaaatatgaggccgggtgcggtggctcacgcctgtaatcccagcaatttgggaggccgaggcgggcagatcacctgaggtcaggagttagagaccagcctggctaacatggtaaaacccatttctactaaaaatacaaaaaattagccgggcgcagtggtgcacgcctctaataccagctactcgggaggctgaggcaggagaatcacttgaacccaggaggcagaggttgcagtgagctaagactgtgccattgcactccagcttgggtaacaagagtgatactccgtctccaaaaaaaataataataataatatgaatcaggccttcccctaagggcttacatttcacagctgcagagcaggactaaagctcatgaagaaactgcaaaacatcagacaatgagaagtggtgagccatggagaaagggcaaactattaataaaacaactatcaatgatagccaacttctcaacagcaataatggaatccagaacacaatggactaatatcttcaaagggttgggtaaataactgacatccaaaaattgtttttgcagggaaactaaactgtctttccagatagaaaaatatattttcagctaagcaaaaacagaatttggagactcactgaaagaactgctaaagttccttgagtttatttcagaataatgaataatgaattctgagttgaaaaaaggaagagcaaagagacaaatggtaaacttgtgattaaatctaaaaaacagtaacaatgcatacaacaataaaaacaatatctaacatgtggttaaaagtaaaaatatatatacttagcaaccatgacatataactcacaacaggggtgactggtattccaacgttttatagtcctcatatttaccagtagagaataaagattctgattaccattatagatagatgggtatatattataccattatagatgggtatatattataatttctatattaaaaaccagaagatacgtagagatggtgtgactggatagccacaggcaaaagaataaagttagacccctatttcatagcacccatgaatattaattcaaatgaatcaataggcctaaatgtaacagctaaaactataaaactcttagaagaaactaaataaaattcataaaagaaatcttcatgaccttgtacactgtctcttagcaaccattaataacaaactaagaaatttattcttatatgcttacataaagcaagatgaaaagctggtgttaaggacaataagttcttcttcaaagctcccttggtctcttgctttgtacacagcccttcctgctcaatctgtaatgagcatgtgttcctcagcgtaatctgtaactagcaaacctcttactctgtaaacaactctttgtcagcccagacatgtccagacatgccttgaacttgttctgtaggcaactcttcccaccttagcaacaatctcctcctcccctcctctcttagcaaattgcatgttcaccatagttagaaaagtttaagtcttagccagtcaggttagtttagatggtttggtccgaccccagccaatggggaaataacacagaaacaggaactgcattagggataaaaacccttctctcctttgttcaatgtgctcttgcgatcgttactgacgcaggcaccacccttctgcagaagtaaattgccttgctgagaaaacgttttgcctgagtgctggttcttctttgtagcactgagcaaagaattacccatctgggatatcattctcctccgggaaagggtctccaatcacctctcataaggagacatgtcctgctgcctcactgcggtggcctcaggggtaaggaatcagaacccacccagtgtgaagaataaacctggactctcggcaacacaggaagaaaaagcctacagtacagataccacggcgacaaggtaactctgtgcacagaccaaagtaggaaaagccagggggcagcaggagtacttccttggtggtggggacatcctggaggttgaaagtgtgtgaatgagacatacaattaagtgcgaagcgagtgtggagtccagatccatggttccatggtcacctgatatgccttagggtagctttcctgtcgagggtttataccaacctaaattcctgcgagggaagtgaccagagaaggaagaagtgaaagcaaaggagtgcaagaaacctccagttggttggggggcgggggcagtggtgagcctctagggaaaaggtgcaagaaatctctagtaaacagaggttgagccccatacacacacaagaaactcgagttgagccgtagagaaagggtgcaagaaatttctattaggagaggttgagctccactgactcaggaaaactcaggaagcacctaaaacttccaggatgggaaataccccagacaaggcagggaatcaaaaggaaaagacagacaatataattccctctgatagctctctaggtctcatgttaaaatattggagagaaaatgaaagcaccaaacataaaaagaagcaacaaataataaaatattgttgctttatttaaaccaaagaacctactctcaaacattcagttttctggccaaggtttgaatccagttaggactggatttgtcaacttttaatagaatatgtcaatgacaaaagtcctgtttcccaggaggaaataaactatgccctgtgttggcggcaagtgcctgtcatcctatatcccctaaaaactacaggagacaagccagaaactacttaccctttagatcaccttcccccgccaaacacctctaacttccctccccacttcaagcaaatgcagaaaaaattaggagctgaagaaaacacagaaggaaagtgtgtattaccagatggaagggaaatgttgtctaaacctcttgagagaaatactgtctcagcttcatcaaggaactcattggggtcctcaagctatatgtgatgcagtccttagagtctatgggtacataggaatacaaaccctcgctaagcaagtagtggatagttgcatagtgtgcagaaaaactaatgagtaaaccctaaaaaaaaaacctcccgggggaagaaatccagggttaaggccatgccaaagcatccaagttgactatactgaaatgcccccaacaggccgcctcaagtatttactagtaatagtagaccaccttacccactgggtagaagctctccccttcccaaggacaacagccagtaatgtagtcaaagccctgttagaacatatcatacccaggcactagaaataaaatgggaatattatactccctggcatctgtcctcatcagggaaagtagaaaaaaaaatgaaccaaaatctaaaaaatcacctaaccaaattaattctggaaacctggttaccatggacaagatgccttcctattgccttaccaagaatccaaactgcccccctcaaaaagaccttagcctgtctgtctctttcctccctcaggactcaaggcctcctagcgagattacatccttgtcaaaggttggaaagagggaaagctcaaacccacctgggaaggaccttacctggtactcctaacaactgaaatagcactccggaaagccgaaaaagggtgaacccaccacacaagtgaagaaggccccacctctggcaaagtcatggaccatcactccaggaccaacagcctcaaaactaacattcaaacgggtttgtctttttcttctccccttagctactcaaggatatcttactgttaatgtaactatgcttgtctagtcttaccttgtggagatctccaaagtcaaagacagttagcttgtacagaaaagtacttctgcccctctgtggaaagagttaatactcctgtgtcttgcatatggggggaatcctcagaggaagagttaggcaattgggggttatggtctcagtgggcagttttagggcactgccctaaaaccatacctacacttcaccaaaggggccaccccttctgactgtcaatctaatcattgcaatccagtacttatccattgtaaaaattaaagatctaaagcaaaccatagccattgaaacacggtaccaagatgcaaatgcctggctggaatagattaaatattccatctgcacgctaaacaaaagcgattgttacgcttgtgcgacaggtaggccagaaacccaaactgtcccctttccacttgattgatcctctgatcaaccgggcatgaactgtatggtagccctcttccaaaatcccacagcctggggcagtaaggcatgtcaaaccctcttgctgctattcctagaagtgaaaagccctgcaggtcggcccctgagggctatccaaccccgtactacaaatatcaatttcacctcgtgtctctcacggcaaggggaaaatttggcattccttgggagtctaatgggatgcagtgaatctaagccttttcaacagctaaccaatcagtctgcccttgttcatccccaagcagatgtatggtggtattgcagtggaccactattggatactctgccaagtaactggagcggcacttgcgctctaatccaattggcaatccctttcactctggcatttcatcaactaagcaaaaaggacaatcgtgaaaaaagaagtaccccccacgggtcctttgaccctcacatttatatagatgccatcagagttccacaaggggtgccaaatgaatttaaagcccaaaatcaaatcgctgcaggatttgaatctgtattgttctcgtgggtaactataaagaaaaatgtaaactggataaattacatttaccataatcaacagcagtttgtcagttatactaggaatgccattaaaggaacagctgaacaattaagttctaccagccagatggcctgggaaaacagaatagccctgaacaaaatattagctgaaaaaggtggggtctgtgtcataattggggcccaatgcttacagagccttaacaccctagcaaatgaattagccaaaaattctaaaatagaattctagaattcttctctagtctcacggaaaaatggtttagaaaatggaagggactcataacctttactccccttgcaattattataggtgtactcattcttgtaggttgctgcatcataccttgtattcgtggattagtgcaaaggcttatagaaaaagccttcaccaaaacccctcatgattctcccctgccctactcacataagttcgtactcctaaatgaccaagaggaacaacaaatctaaaatatgttaaagaaatttgaaggggaagaactataaaatcaagagagggaaactgttaaggacagtaagttcctcttcaaagttcccttggtctcttgctctgtacacagcccttcctgcttgatctgtaacgagcacttgttcctcagcttaatctgtaactagcaaacctcttactccgtaaacatctctgtcacacccagacatgtccaaacaccccttaaacttattctgtaggcaactcttcccaccttagcaacagacagtctctccctcccctcctctcttagcaaactgcgtgttcaccatatttagaaaggtttaagtcttagccaattgggttaatttagattgtttggtccaaccctagccaatggggaaaggacacagaaacaggaactgtgttaggaataaaaaccctttggccgggagcggtggctcacgcctgtaatcccagcactttgggaggctgaggcgggcggatcacgaggtcaggagattgagaccatcccagccaacatggtgaaacttgtctctactaaaaatacaaaaattagctgggcgtggtggtgggcgcctgtaatcccagctactcaggaggctgaggcaggagaatgacttgaacccaggaggcggacgttgccatgagccgagaccgcgccactgcactccagcctggtgaccgggcaagactccatctcaaaaaaaataaataaataaaaatcctctcttttgttcggtgtgctctcgcgagcgtgactgatgcaggcagcacccttctgtagaagtaaattgccttgctgagaaaactttttgcctgagtgctagttcttctttgcggcaccgagcacttgtttctaacactggttttttgtttgagtttttttgagacaaagtctcactctgtcacccaggctggtgtgcaatggtgtgatcttggctcactgtagccccaacctcccaagctctagaaatactcccatctcagccccccaagtagctgggactacaggcatgtgccacaacacccagctaatatttgtatttattgtagagacattgtttcaccatgataccaaggctggtcttgaactcttaggctcaagcaatctgcctgccttggcttcccatagtgttgggattacaggtgtgagccaccacgcctggctgaaaagctgtttttaaaaatcaaaaaacaaaaaaacaggcattctgatctctagccagattactgccaatttaaaggacaatttgatgtatggttcaaagaggtcaacaattcaaaataaaatattttccaatttggtcaaggggtggggacgggcgggaagctggtcagaaaaaaaaaaaaacagtgactttttacatttaccaaaaaaaattagaatttttttcttgcctgccttttaaaatttcattcaactctactattttctggacatctcacactagtttcaacttaagattaagtctcatcaggcagttgacctgtagagagctgtaagtgttacttctctcctacaaaaatttttacaaatcaaactatcatgggatgtaagttttgaaaacacaaagtttcttagaaataaaactattactttatgataggacagataataaatgataatctggtccttaatctacctgcactgtttggagagatatggagtcaataatctccctatgttataggagttattaagaaattattttaggcagatagagaagacaaggggtccttggcaagtttcttttcttttaaggcagctccagatacatttcttgcatagcagaaaaatggcctgaagggcgggccagcaagctttgatatgcaaatgccagccattagaaactgggtccactcaatatggcaattcccaccttcttcttgtcactacaagtgcctagcatcatggccacccccacatatccccacgtgtgtagaacatcatggtgccctgcatttgcatattaaaaggctagggtgggaggaccagatttttgtgggctacatgaatgacatacctggtcaacccaatcccctggactctatgcaaatcagacaccagctcctccagcctcctaatataaatggctgttttctgctgcactcagggttccctctctcagcttggagccccctccctctgtctctgtatgggggagccccttccttctttcttgccgatttattaaactctctccgctccttaaaaccactccacgtatatccatgtcgtcgtatttaaactggcgtgagaaaaggaccctggtattcccctccagtcatcagagtcgtatcattttggtgcactggccgggaatccgaggtacaacattcactgaagtggtgattatacaagcgagcttaaaatctgttctatcattctgaggtgctcttggcctctattttaaaatcaaatcaaatcaatcaaaaggcatctatctgtctgctggttagctacacttatcgttggctgctgttctaaagactcagatgtgaggcttgctggtgagaacatggagaaccccccaatacccacaggtgattgggaatgttggccgtatttcgaatcagcttcctttcatggggagacctcgccgttgcgcaaggctgggaaaagttctgaggcaactgagcatctctgggcagggcacaccctggtgtgactcaaagacctctggaccagacccagcctccaacagcccatttcaggtgctggcagagaatcctcagctatccggtcatgaaactttccttccttttctatctgtggtctcttactctgtgtgtatgtgtcaactgtgtgggaatttagtaaccgggagtttaactcaagaatgccattgcaatctcctgaacagagggttcctccgggacagtgagcctctctctctcagccccttggtctggagagcacacggcatttccaggtctctctaccgcttgtctgaggagcacacagtatttctaagccaacagtgccacctagaggaaacagaaatcctctacatgaggcactttttttaatgctaacactgcagcttccttttgcactgctagaaatcaggctctaagcctcttccaggaatgggaaaattctgctttcaacagttagaaattaaatgtcttccatagccaaattttagtctcaatattgtcccatcagcaggaaaacagccatttggttcctacatttctttaagtcacctattctgtctccaacagagacagtacttaattagtaaggggattttaagtctggaagttaactgaaaccatttttctaagggtaaatgctttagcatgggccataatagcaggatatagagttcaatctagcataacccctccattaaaggggccttccccaattacacagttttccctgagatccatttttttttagggaggtacacaggtcacacaagtctaggaggtcaaagggaaataacaagcagaggactgggactacttgggtaagtgtgactaggcctcaaaagtctagtttctctggtgccatggcttggagggtcacacctacagccacaggcggcacatttaactgggtgccgggacccaggaaccagggagggagactagttagaggaatgccccctactgttttcttctccaccctgagtcatacaccaaaaggaaggagactaaaaggacacttttattctcacttctctttctagatggccaacagatcgtcttcagcatgcactcctctggaatgtattttaaagcactgggactccttcaaccctgagactttgaaaaaaaagtgactcatattctattgcacaagagcatagccttcttactatcttggggacagataaacctggcccgctgcggggagccttgattttaatattatccaacagttagatcttttctccaaacagaagggcaaatggactgagatcccctatgtacagactttctttgccctgtgaaacagcccagacctttacaagttctgtacaattgacccagttcttttagcggccacagggaatcgttccccagagctaaagcaggttccagaggagcaatctgaaacagctattgaatgtcccaatccttccagtccccctccaatcatactatcagctcctccagctccactatctccagtatatcctactctccccgcttcattcttacctctgcaggaaatggctgataggaatggtgccatgagggttcaagtttccttctcattacaggaccttaagcaaataaacagagacttggcccaattttctgatgactccgataagtatatagaaattttccaaaatttaactcaggtgtttgatctcacatagagggatgttatgttgctgctaagtcagaccctcactggggctgaaaagccagcagttccacaggcagcagaaaaatatggatataagcaacatgcctcctgtagcagaccaaggagaaaaagaggagacaaggaaggtaaggaagaagtggaaactccattcccactaggaagggaagcagttccagcggacaaccctgattggaaccccaataacgcaggaaatgaatggaaaaggaagcacttcttaaggtctatgttagagggcctatggaagaccagggccaaacctctcgattactctaaactatctatgatagaccagatgagaatcccacagcctttatggaaaggctaagagaggcactaataaaacacacctctttatcatgattcagtcgagggacagctaatcctgaaggacaagtttattacacagtcagctcccgatattggaaagaaactacagaaacaagctataggaccagatagcaccctagagaacctcctgagaatagccacttcagtcatttacaatacagatcaggaggaggcccaagaaaaggaaaggaaatataagtgaagaacagaggctctagtagcagcattgcacgcttgtaaagtccaggatccctgaggtgcatctgctagctgttatcaatgtggcaagtcagggcattttaagagggaatgcccaggcagcaagacgaagccaccttgaccctgtccagcctgtggcggagaccactggagatggatctgcccccagaggcagaggtcgctgggttcagaaccagtctcatagatggtccagcaggactgacgggtcccgaggcttaaacccccggctccagcgactcagactgccattacagcacaggaaccctgagtgattctggaaattgaaggaaggaaggtagatctccttctggatactgaagccagtctcttgctcctcctctctaattcaggcctcccctcttcccagagcacaaccataaggggtgtatcacgaaaaactctaacccaatatttttctcaaccccttttgcagatggggagacttactatttaaacatgcctttttaatcacgcctgaaagtcccactcctttattaggtagatatattctagcttgcatgggggcctgcagcatctttacagccccaggacaaactctatctccccctgatggaagctaacattaatgtggaagtgtgggcaacttaaggaagaataggttgagctataaccactacgccagtccagatctatcttaaggatcccacttcttttcctaaccagagatattatccctaaggccagtggctaggaaagggctagaagccattattaataacctaaagatgcagggcctcctcaaaccctgtaatagcccctgcaacaccccaatattaggagcacagaaacccaatggggaatgaagcctggttcaggaccttcgcctcattaatgaagctgtagttccaatccatccagtggtccctaatccctataccctgttaactcaaatacctgagggaactaaatggtttacagtcctagatttaaaggatgcctttttctgtacaccgttacatcctgactgtcaataccggtttgccttcaaatattcctccagccagacgcccagttaacactgacggtgctgcctcagggattttgaaatagtcctcatctgtttggacaggcactgtcacaagacctctctgagttctctcaaccttaagttaaggtcttgcagtatgttgatgatattctgctatgtgccccaactgaggatgcttttcaggaaggcactgaagctcttctcaatatgttagctaacagagaatataaagtttcaaaacccaaggcccagctctgcaaaacctcagtgaagtacacctaggcttagtgctgtctgaggggaccagagcattagggaaggagggagttgagaatatttcttcctttcccctccccaaaaccctcaagcaactcagaggattttggggcattacaggattttgtagactatggatacctgggtatggtgaaataggctgtccatgatataacctcataaaataaactcaaggaactaaaactcatcttttaacctgggaatctgaagctcaaaaggcctttgaccagctaaagcaagccttgcttaaggcaccaactttcacccttcctatagggaaggacttcaatctgtatgtatcagaaaagaagggaatggccctgggagtattaacacaggcccaaagaccaggccaacagccagtgggttgcctaagtaaggaacttgagttggtggctaaaggatggccagcatgcctccccgccattgcctcagtggctctgttggtcccagaagcctccaaattaactctggaaaatgatttaactatttatgccccacctaacgtggcaggactactgcacttttgggggagcctttggctaacagatagctgacttcttaaatatcaggccctgctgttaaagggttccaacatccaattaaagaattgttctcacctaaatccagccgccttccaccaggaggaaactggggaatctgagcatgactatgaacaaatcatagtacagacctatgcagccagggaagatctcaaggaaactcccctagagaacccagactggaccctcttgacagatgggagctcttttgtagaacaaggaatctgtaaggcaggatacacagtagtcactctacatgacatcactgaaagtgtgtcactccctccaggcacaagcgctcaattagctgagctaatcgctcttacagaagcaattgaattaagcaaaggaaaggtagctaacatttacacagactccaaatatgctttcctggttctccatgctcatgctgccatttggaacgaaaggcattttcttaccaccgatggatctcctataaatacctccaggaaattaacaggttattatcctcagtttttcttccatgagaaatagcagtgatgcattgtaggagacatcaaaagggaacagatgaggtagccaaaggaaacagattagctgatcaggcagctaagtcagcagcaaggaaggctcaagacaacacacttcaaacccctctaatctgggaaggctccatgagagaaattaaacctcagtactcccccacagaaataggatgggccacttctcgagggtatacatttcagccctcaggatggctacagtcacaagatggcaaactccccttgacggcctccagccaatggaaagtccttaaagtgcttcaccaagcttttcacttgggagaggataaaacttatcaatgtgcccagagattgttttcaggaaagaacttactaaaaacaatcaagcaagttgttcatgcttgtgaagtctgtcttaaaaataatcccctgaacaggcgactccttcctcctcaaacccaaagaacaaaaagatacccaagggaggagtggcaggtaaacttcacccacatgccaaagacaaagggcattcaatacctgctgtatgggtagataccttcactaactgggtagaagcatttccatgttgtacagaaaaagcctctgaggtaataaaagtattagttaatgaaataactccctgctttcatctatccaagtaccttcaaagtgacaatgggccctcatttaaggcagctgtcacacaagggatctcaaaagcactaggcatagaatatcatctccattgggcttagagaccctaatcctcaggaaaggtagagaaaactaatgatattaccaagagacacaccagaaaattgtcccaagaaactcaccttccttgggtcactcttcctcccacggccttactacgaataagagataccccttgaaaattaggtcttagcttttttgaaatgctgtatggacacactttccttaccaatgatttttctattagatcgggaaacctctgagctagttaagcatgtaacctctctggctcacttccaacaggaattagcacaattagcgaaaacccaatcccaggaaattggaccacctctatttaacccaggagatttggtactggtaaaggatcctcctctctctctcccttcctaagcccaacctaggaagggcctcacactgttcttcttccaactcccccaacaataaaaggtacaggaatcgaccgactcctggaaacatcacactcaagtcaaagcctggagagctgagggagcaacccccaacagcccagaggaacgtcctgaatagcaatgtgaagaaatggaagatcttaagctgaaaatcataaaagataagtaactatatgagaactaatcatcttattcagtctcacccctacctcaacaaatactttttgtcatttctacctctccttttgagccaaatatcagaacttctttttggtggaaattatttactactccaaccttgcaggaattgctatactcactctgctatttgcagtagaactatatactgtagcaccctcagggtggaatgtcagagagagaatctcaattactactgcattttgcttaattattaacctcacagcaggaataacagttactaacaggaagtaaacatgagcattttactatcactaaatctgttagaactctttattggacttagtaatacgtcgcaccatctagctcctacaatatctgccatggcccatttgtacagtaagactaattgttgggtctgtcctaagtggttcgctcagttcagtgacactaaggaaccttatagttacccggaactcaccatcttaggattccctttgttggctttacctttaacccttaaagacttatcaggcataaatgggacatggtatgggaacactttcaattgggtgactaactcttcccaggagaacactctgccccagcgccaaagaactttctcccaaagataagcttcacaccctcaggcttggaaaagttgatggagtaatagcaaatgcctccctctgctttaaaagtagtggggaagaaccatacttgggagtaacatcacacttgtaattgctgatagttcaaagatttgaggagagtgcaacaagggtgatatacaaggatagaagccctagtggggggctttcagaaactagtctccttctggttggaagtaccgatgggagtggcatgctctaagtaaccaacttgactataatgtaaaaaataacacatgggtctttccaaactcccccccacccatggaattccagacccttgtatgatgtttgctaacagtggcggcttactgatctgagggcgaactgaagacatctggactgacaccccttgccacaagaatcatctgagatattggccagggcatattacgtctctaatttttcaaaactccatttgtcaggtggacccttttcacttggcatgtcaaattccaaatgacatcgtaaatgactaccctaaatatggttatctttatcccaaggatgcctctattatatgtaaagaaaggaaagttctaagatatgagaaaaatctgccagtgtctctcacaagccacaacttagaaccatcccttcaaggaacagggctacattttctttgtggctcctggatacacttaatcctcccaaggcattagaagggaacttgtactatagctgcagtagttctcaacttattaaattctaccaagatgacagcatcatctggggacatccctaacttagcctcttttctagaaactgcactattctgaatacatcggacaaagggatctatcatttctatgccctcatatggagatttaactgaaagggcagcctggggagggcatgcacatgacaatctcatcttagaaaaagcatggatgggaaattctatagccagaggtatattctggtttatgggcatcccctctccttgaaagatcaatacttaatatctctattataatgcaatgaggatggaaggcaactgtatgggccatagaggcacaaccacaatctatagactctttagccttagtaggtagtagcacaaaatcgacaggccttagatgtccttacagctgaagtgggaggtacctgtgcacttttaaatgcaacatgctgcttctggattaaccctctagtagattaaggaaaatctacaggtacttaaagatcaaatcaaaattattgacaggctaagagaaaatgaaggcttcagccccaggtgactacaatccctctttaatgaattccagtcttctttatggaattggttagcccctttattaagctccctcttgcttacatgtcttacattaactcaatactataactcaatactatataacttgtataactcagtactataactagaattgtttcctatcgcctagaagcaatcaaattccaagtggtgttgcaaaccaaaccacacatggacatgccattcttccgaggatccttggatctaccccaggaggagccctagctgctgttccccattcaatgctccttttcagcaggaagtagccggaaagagtcatcacccaaaaccccctaacagcagttagggtgacatctcctccgggtagaatgttataggagttattaaaaaattatttggccactgccctcactgccgctgctgctgttgacctcgccagggctgcttcgtctccgaggtcagactgctcccaatgccatgaacggagacagcacctttgcaaagagacccagggatgatgctcagatatcagagaagaaacacaaggccttcaatgatattgccagatacttatctaataaagagtggggaaagctgaaaaactcagagaaaatcacctatgtgtatatgaagagaaactatgagaccatgactaaactaggtctctaggccaccctcccaactttcatgtacaataaatgggctgcagaattccaggggaatgattctgatatagactaaaactgcaggaatcaggatgaatatcctcagatggctttcggcatgctacaagggaactttccaaagatgatgcccaagaagccagcagaggaaggaaatgatttgaagggagtgccagaaacatctggctcacaaaacaatgggaaacagctgtgtcccctgggaaaagaaagtacctctgagaagactaacaagacatctagacccaagaaaagggggaacacgtctggacccacggactgcgagagagaaagtatctagtgatttatgaagagatcagaaaccctgaggaagatgacaaataactcccctcagggataggatgcaagcccatgatgagaagcagaaactggtgaccttctatgaacatgggcatggctgcgaacccctcatcatcaggtgtatagcaagtgaaagcaggagttcacgacagtgaaaagttgagcgtcatttttcttacagtgtgccaagagttagatattagcattttcattgtattttcttacagtgtgccatcctgttagatatttgcatttttgttgatgaatgagacatagttaatgcatatttctgtttgtgtatccatgcacctacctcagaaaacaagtattgtcaggtattctctgcatagaacagcactaccctcctctctccccagatgtgactattgaggccagttctgggtgtttcagattttttttctctgcatttacacacacacacacacacacacacatacacacgtggaataccactataaatatctccatctgcttttccccatcgctaatgagtcctggtcaagcccccctcactctgtttcctgttcaacatgcactccctgctgcaaactcccctcatctgattcccctgtgttggtcactgccagttaataaacatttacaaacttaaaaaaacagataggacaaggggtccttggcaaggtttttttcttttaaagcagctccagaaactttattgcctagcagaaaaacagcttgaggggctgagccggcaagctttgatatgcaaataccagccatcagaaactgggtccactcaatacagcgattcctgcctcaacttcttgtcaccacaagtgcctagcatcatggacaccaccacatatccccatgtgtatagaacatcatagccccctgcatttgcatactcaaaggctagggtgggaggaccctttttttggcgggttaagtgaatgatatacctggtcaaaccaatcccctgggcctcaaatcagacactgcctcctccagcctcctaatataactggctcttttccacactcggagttccccctctcagcttggagcccccctccatctctgtacaggagagcctcttccttctttcttgcttattattatttgtgtatccatgcacctaccccagaaaacaagtattgtcaggtattctgtgcatagaacatcactaccctcctctctccccagatgtgactactgaggccagttctgggtgtttcttggtattaaactctctctgctccttaaaagcactccacatgtgtccgtgtcgttttatttaaaccggcgagacaaaggaccctggtgttcctccggtcatcggagccatatcacctacattcacgattgtgtgacaagagcccttccaggtccatgggttcttcacacatctctaaaatcaattcagttcagttcagctgggtaagggtccagcaatcacactctctctaccaggctgagaagcaaaatgatggcaaaaatgaatgaatgaatgatatatactgaaggtaaaactgaggtccataaagatacaaaaatatgcctccaacaattttaatttctgcaaacttactagagctgaggcaggagaacagggtctggaggcagggaacctaaggccaattcacgctgacttcctagaactaaattaagatgaaaaccccaacttttcacacccaagtaacaaaagtaccagaggctactactccctttgcaaaggccccctcccaccctgccttttctgtgtggcagatgaaaaactgaacgtacctctgattggtcccctcctgcaaccaatcaggctggtcatgggccaagtcttcatttgcatagaagtgtaattttgtaacttcacttcagcctctgacaggtcactttccacaaccaatcagacgtctgcatagggtgtaactttgtaacttcacttcagcctctgattggtcactttctgcaaccaatcagactgatcatgggacactacttcatttacatagggtgtacacgaagtaacaaaatgggaaacctctagagggtatttaaaccccagagaattctgtaaccagattcttgagctgcttgcttgagcccactcccaccctgttgagtgtgctttcattttcaataaatctatgcttttattgcttcattctttccttgctttgtgtattttgtccaattctttgttcaaagcaccaagaacctggacaccctccaccggtaacagagctataatgacattatacatcatgtttaagaatttatgattcaaatatttaattttcagcaataacataaattaacgagaatttagagataaggaacaaagttacttgatttacaaaagaatgtaaatcaaattgttttgaatactgccttgaaattacgatttcacaagcaaaaaagttctttgtataacctctgacctgctaccatctataaataaagaactaaagtacaaagaggttaaattacttgaccaagaacagagctcaaaataaaatcctagtatcctgtttctcaatctagtgttacctatattatcctacactatatctctcagggcttttctccctttggattctgccttccaaatacagacatctagcaccaatggttaaagaacagggcttggggctaaacaaacagactaagagaaactcgtctccaccacttgaaaagctatataaccctgaatacattaacatcctctaggtctttttttttttttttttttgatcagtaaaaaggagataattgtattttacctcaaaaggactccataataaaagaattttaaaataagttatatataatgtgtaacatattgcaaaattttatgagagatattttctgttaattttaaggctaattgaccaaataattcactgtcatatctggaagtgatgttatttgaatatccattatcagagtcctgaaagtttcaaagttgcaaaaacatagtattattcaccaatgaattgactgttaataaaaagcagaacaggctagaaaatggttgaaatatcacctaccttatatataaaatgggtttataattgtaccacattaaattttttaattaaatgaaaaatttatgcaaacctcttatcatgatcatgatgccctgtaaataaatagtaaatgctcaataaatgttggtatcattattaccaaaaggttaaaaaggagttctctatttgcttaaaaatagtaccaagggtatacgtggatgagcagaagtaatggctgaaataagattgtcatgtattataattgtataaatttggtgtgtacaaatataggttaccacttttgccttctttctactttggtgtatgtttgaaattttatggaaaaaaaagaaaaagatagtgagaacaagaagatattttacattaagatgagttgttttaaagaaaccattcagcaaagtaaactaatgaacaaatgaaacctaatcattgtaataaaatacataagcaaggaaaagagacagagcccctgggaagttttcatattgtccttcaaaattagtagttgcctacagctgggaaaatagagggtttgaaggataatggctaaaggggatataatttctttttggtgtaataaaaatgttctaaaattgacagtggtaatagatgtatgactctgtgaatatactaaaagtcattgaattgtacacttcaaacgggtgtatggtataagtccattactgtactgctataaatacctgaaaaagaatttaaaaaaaaaaaaagaaaagaaaagaaatatcgagcctgaggtttttataaaagaaagaggtttgattggaaggcaaagcaggagtaggtgtcttacatggcaggaggaagagagagaggagagaggtgctacacacttttaaacaacctgatcttgtgagaagtctatcacgagaaccgcactagggggatgatgctaaaccattcacgagaaactgcctccatgatgcaatcacctcccaccaggccctaccaacattggggaatacaatttgacatgagattggtggggggaggggcagcgcatcgcaataatgctgtttaaaaaaaaaaaaaaaagtatggtcttgatttcccaaatatctccgaaatcatctagttgtctttttcctgtctctttttatgaacaagtcaccaccagcttctacttcaacagcaagtggtctcctaccttccagttttgttttctgggatgtgatccatcctcaacacatcatccacaatgttcttttacttcccagcctttgaccaagctactctctcagcctagactactctcctcccaaaccccttttaccttgctggttcctactcacctttttgggcctcaacctaaacaacatttctgccaggagtcttttccctaatcccctggacttctgtatgtccctctgttgtctatccctaccaccctgtgtacttcgcctatcgtaacgctcctaactatttactgtcttctcctctagacttcatatatacaatgattaggggaaatgtctaattcatacccccagcacagtgcttaacatgcaacagacattcaattaatattggctaaacaaataaataatccaacaagtccttatctttataaggcttttgtttttacacaaaatgaagatagtgtaccaaatgataacttgtttcttcctttctgatatatatccacaggatgacctcaaaatttatagtattcaagagccctacgatttctcagtaaaaacaaccaactaatgaagatatgattaaattgaagttcatttttatcagcccctatttaaaataaaataggttaattagataagaaaattatctctaatacaaattagctgttgggaataatcaaaagaaaaaacttaacactatctgtacctttttaaaataaaatacataagtacacttaaaaatcagcccaaaacagacattaaaaactatatttaagaactcgccgggcacggtggctcacgcctgtaatcccagcactttgggaggccgaggctggtggatcacgaggtcaggagatcgagaccatggtgaaaccccatctctactaaaaatacaaaaaattagccgggtgtggtggcaggcgcctgtagtcccagctactcggtaggctgaggcaggagaatggcgtgaacccgggaggcggagcttgcagtgagccgagatcccgccactacactccagccagggcgacacagcgagattgtctcaaaaaaaaaaaaacaaacaaaacaaaacaaaaaaaaaaaacctcaaatttttgaaaaagataaatgaattgcctgagagcctgcctatcaggagccacatgatacaggagagaaagactgtcctgaggaaggttacgagccaagcctaagcaaaaagtaagtttcttttttttgcctcaaggtcctatactcccagtttcctcttacaatccctctgtcactcaactctggtcccacagcaagattatgctatgtacaacaagtgctgcatacttcaaaaacaacttcctcaaactaatatctgtggcaacagtagctatttaatggcctccaggtctcagcaaagaaatcctaggaaaacactggggatcagctatgtaccttatgttacaatttggtagcctggtagacacatctatcctcattgtcgtagatctatttccttccaacctggaatttgaaactccatgaacaaattacaacagctaaaaagtggtgctgctaatgttagtgtctcaatttagcattatttgaaatctcaaaataccctggctaaacgaaaattcctcaatggtaagtctagaataattttctgtactagaatcccttcgctgctgagattctcatgtaatcctctcctccatgtttatctccctgcaattctgccattcttggaacacagtaagtattcaataaatatatataagtgaataaatgaatgaaccttctaaaagctccaggttaaaaaggaagaggcaaccaccacctcaaatatctcctaaaagtaactaacagtgtcgtacatataatgcatgaagtataataagtgtgtaaattataaggtatatttgtcaactcccatgtagcatgtaaattgtgtcattatttaatatgtacactgaggtttttacaataatcagtcttttaagaatttaagtgcattcacacatttcacctaaaaattatcacaacaaaccaaattaatgcagcacttcatgccacagtctcaccaatcaagaagaaatgcttactccaagccaaatagtaatagtaataaagttgaaggcagctaactaaaatatgttgtagatacaatctaaaagtaaaattatatttgataatacacaaatttcatgtacattatttagaaattaatataattatgtgacatggtaattctcagctgggtgttgtaataaaaggagataaacacattttaggttattctaaaatgtttggaatttagctagcatagatttgtttaattttataaatgagaaaaaaatgaacatcttatagacctgtggttaatggatgaccccaaaaaattatataatcaaagaccaaaggataaaaaacatatctgcttgacacggatatgacataatctgatatatggcatgttttaaagttgctattatattataaatatcaacctattccttatgttctgatgcaggttattcccaatattcagtaatcttccacagtggttattttcctgagtgctttacaataaacagataagccatgaggcaaacccaacaatgaaaaacaatgtttatcaactacaagactcaggacttggtaagcacacttaccaaagaacagataaggtaaagaacaaatagctcccataaattaaaaatcatgaaaacttcagaaagacatgaattaaggaaggaaagcacacactaattggaaccaagcgttacatcaacacacatagcaggctttccttctaaatagtctttattatgcctgctaaaactacttatattcaggtaatatcttaatacaactgatttttttaaaaaaaaaacaagagtacctttccaggcaataataaatgcaaccagtatcattcattaccagcaccaatcactcaaaccacaattctaattcattttccacagaagtctcgatttcctgttatttattgtaagtcttccagcagtcttactattccttcttatttttatccaccattccttatgcctctttcctagaactatttgccctttgatatggtttggctgtgtccccacccaaatctcatcttgaattgtagttcccataatccccacatgtcgtgggagggacccagtgggaggtaatttcatcatgggggcggctgccccatgctgttctcatgatagcgagagagttctcatgagatctgatggcttcataaggaaatttttttccccctttgctcgaaacttctctctcctgacaccctgttaagaggtgctttcccccatgattctaagtttcctaaggcctccccagccatgtggaactctgagtccatttaacctcttttctttataaattacccagtcccaggcatttcttcatagcagcatgagaacagagtaatacacccttgatcttgaaactctgacactgctttatctatgtagaatagcttctaaataacagtacctactaatcatgccttaaactcaggattcttttccattagaatattctgtattctgactatataacataccagtgcaatcactcactgtttcatacattaataaaaaattgttggggaaaaagagtcaaagttcagcttggaggtaattgcaagaactaatgaaagtaacaaaaattttaacatatttacatcaacccaattcaaggaaaaagtgaaaatcatactctcccatctctgaaagattatagaaacttatatttaacatttgatgaattactcagtgagaaaaacaaggatatttgctactgctaactaaattagttttaaattaattcaaagaataaaaagaaaagacagttttctaaatagcaatagaaaaggtgagtataaaacaatgcacaacaggatcaaagggtttctggagacttatgaaaaagataacgactatagtcatctattcagtggtgtttttcagttcttcagctagccattgtcatgaaaaaggcagcataccagtctggataccgtgtggggcctagtctgagaacaggagagagttattttttaagctctcctcagccaaactgaggaaggctagttcctgactggacccaggttaataccgtaatactctattgaggttgaagtcagtgactataagaagattattgagttttgaagccaaagcttcaaaaaataaaagagtttgtctgtgaatctcaagtaaatttttgagaagtcatgacacaggaacacagttttaaaaagagtatgatttgcttacagcagctttacaataacactaagaaaatctcagagcatctgttcttcaacttctcaatcctcattccccacatcattcttccctcaaaaagttaattttaatgtttattaatgagaccaaacagctagaacacatttttaaaaagatctccacgcacttctgatttattctcaactcaactttgttcaattactgtccagcacttttttaatgattttctgtttaaccacgtagtgtgtatagagggtgctgtgggttgaattatgtcctccataaaaatacattaaaattttaacccctagaagctgtgaatgtgaccttatttggaaatagggtctttgcagatgtaatccgaggtaaaatgaggtcatgctggttcagggtgagccctaagtccacttactggtatccctatatggagagagaaaagatatgaagacagaaagctcagggaagaaggacatgtgaaggtgacaaagactggagttatggtgccacaagccaatgaataatatactaaggactgccagtaagcacccgaagctagaaaaggcaaggaagaattcttccctagacccttcagagggagcatggccctgccaacaccttcattttgaaccttatagtctccaaaactgtgagaaaaaatatttttgttgtttaagtcctctagtttgtggtaatttgttatagcagccctaggaaactaatacaggggagtagaggttaacagttctgaacctgctttatacacatatactggggactgagcaaacaagtaaatggatggtagatggtgggaggcttctaactgttggagagggaagttatagataagcaagggagaagggctaaaataaatcctgctgtctggattagagtcaaagacatcataaggaactcatgtttggctcaatactaatactgacgaataaacagataaataattctagatatatgtgtaattataggctaatatacatacctgcataacctagccctgtcctctgaaagggcctaaaagcaatgacaacccaataataacaagtatgtccagcacccagatcttggtttctgaataccactctccaataaaaagaaccagagctcattggtgaaatgattgattcaagggctaaggtaggactaagatgaacatggagcattttgtggtacccaaaagtaaggaagtgctcaaaaaacaaaaggatggcagggtggtgtccatgtcaaagtgtcaccagaacaaccctgaaagagttctcaatggcaaaatttgaacaacaaaatattattactaagtcataatcaaaaatataaaacaaattcacatagtctatactggcataaataaatgattgaataaataaataaatgagagagaagaggttactttcttacagaagaattccaaatcatatatataagtatttagtcctccaggatgtagaacttagtgcctctaactcctattttcagtgtgggcaggactcagtgacttgcttccaaaaaatagagtatgattttaaaaaataatagaaatggtaaaatactgttttatagaagagaaacctggcaaacatatcttaaacaagcgaccaaggtaaatatcactaatgatgtcgaattattattatgtacccctgatatgatatgatgaaaagaatattttcatatctgtagtattcttgccaaaaacttacaaccacagtctaatcatgagaaaaacgtaagacaaatctaatttgaaagacatctataaaatatttgactagttctcctcaaaactgttaaggttatgaaaaataggaagagaatgagaaaccgtcacagaccagaggagattaagaaaacattacaattaaatgtaatgtggtgtcctggataggaaccaggaacagaaaaggacattcatagaaaaactggtaaaattctaataaagtctatggttaaaaaataaatgtgtacatataggagtccacattgatataaataaacaattaaataaatggaagagaagtggaagtggcaaatatgtcttaaagaagaattccaaataataaattcacatattctccctcacaggagatggagttaaaccctccgttcttgacttgcctccaaagaacagaatatggaaagaagaaaatttgttactatacaatgcagagaacttgcaaacctagtactgcctgtccctgagccttcctgggggtgtgtgtgtgtgtgtgtgtgtgtgtgtgtgtgtgtgtgtgtgtgtgtgtgtgtgtgtgtgtgtgtgtgtaacgccatggagcaatctcagctcactgcaacctccgccttccaggttcaagcaattctcctgtctcagcccctctgctgtaggtgggactcaggcacttgccaccaggcccagctaatttttgtattttcagtagagacggggtttcaccatattggtcaggctggtctccaactcctgacctcaggtgatccacccaccttggcctcccaaagtgctgggattacacatgtgagccaccacacccagccctggggtttttttaatgatataaattaccagtcaagctaccaacctggtccttaatttctctggtgctggctgaaaattcagccccttggggtctgctaacaaactttcttacatattgatctgacaccatttctagaattttgtcattttctccctgccttcagagggttgtcttttttaaaaaaaaaaaaaatcttgagttttagtgggatgccataaaggaataaaattgaggcgtgtgttcaatttgccatcttaccctagaaatttgcttgaatttctttctaggttggtacatatatagctatctaattagttttaactggatataccgtggaataaccatttctccattggtaagcatataaagttgtttcttatttttcactaaacgatgttgcagtgaatattcttatacatattatctttgttcatctgtgtgcctgtgctgagttaagaacatatacactttatgtaagttattcatggttaagctatttagcctcttagtctcactttcctcatttgtgaaatgcagagaacagtgcctacctcatatggttattgtgaagatcaaatgagttaacatgtgtaaagtgcctaaaacatagtaacagctatataggttgttagttattgtcaaattgccctctgtaaaggctatcagttattacagagccgcatttcccacctttgctcaaaccctggttattacagtctactttttgagaaggaagggcaattttattggtaaagacagcatcagcacctcattgtctaaactgtcgcttcactgtgactgagtttgataatcttctttccaatgtttatcgatcaatttcccttttccccatgcttatgtatatcttttacttataaattatgaaatatttgaaatgatatacatgaatatctgttttggggtatcatccttatttatttgagctttttcttcccaaagtgaaagcaagtttattaagaaagtaaaggaataaaacaatggctactccacagacagtgtagtcctatgggctgctggttgcccatttttatggttaatttttgatgatatgctaaacagggggtggattattcatgcctcccccttttagaccatatagggtaacttcctgacgttgccatagcatttgtaaactgtcatgacgctggtgggagtgtcgcagtgaggacaaccagaggtaaatctcgtcgccattttggttttggtaggttttggccagctcctttactgcaacatgttttatcagcaaggtctttatgacctgtagtttgtactgacctcctatctcatcctgtgatgtagagtgccttaaccgtctgggaatgcagcccagtaggtttcagcctcattttacccagctcctgtttaagatggagttgctcaggttcacacgcctctaacatttcccccctcccttttataagagaacccttaatcctaatgattgcagagggatgaagatccatcttcttctgtaacttcttcaggctgaataggggcaatgatattcctgcctaagtatgagggtctcttgcactcagggtagagaggagctcagtcagaaagcaccagtatggtaaggtccattcataactctttaagtttcaacagaaggtaaatgtttaatttatgaaaatattcagtaagcttctcctatattcctacacaaagagtgtaacagcaatatattccacaagagtacagcaaaataagtaaagttattccaagtaaactaaactagaaggttttccatgaactggacaactgttgaaaccaagttgatatggggttgctagctgattgcaatgtgcccagaattagaatactgattcagatttttacattacccatcccacttgttctgagcaacagtcagagatcacctggttggttcacaggaattagttcacagggttagcctacgttgcagaaacaaacttaaaaacaattaatgagactagaatttaacaacaagtgtaccatagtttttgaaacatagtatttccctctccagtttctcatttttactaaagacaaattatggtaagaccgatatgctttataaaacttggcctgattatttgcataaagtgcagcaagaataattatttttgacataagctcttttttaaattggctttgatggaactctgttccatagatggaatttcagataagactttttttttttttggagatatagtctcgcacggtcacccaggctggagtgcaatggcacaatctcagctcactgcaacctccacctcccacgttcaaacgattctcctacctcaaccttctgagtagctgggattacaggtaccaaccaccaagtccaactaattttttgtatttttagtagagatagggtttcaccatgttggccaggctggtctcgaactcctgacctcatgatccacccaccttggcctcccaaagtgctgagattacaggtgtgagccaccacgccaggccccagataagactttttaaaagccaagcccagccttgggtttctaccctcaagtagctatgaattgggtaaattcctctcctcttggggtcccaagataacttggagctcctggacctgatatgaaagtgacactctttacttaccacaggtcagaaatcctgtttacagggactgtgtaggcaaggaatgaggccatttcctcaagggactttaattggctctgtaagtcaagtttaatttcttaaaggaaaacacaccattccagtcaaagccttggtaaaataaccaatttacccaattgtgtcctgttacaaaagaaaacagattcttactgcacctatgcaaataaccatattgccataagttaagaatactcgcaactagtttccaaattctggagaaatcaggtagagagaaataaatatgctccaaagtttgttcataggagtacactcaactgttaaaagctgtaaaaagctcaaaagaagttttcttgactctgaaaaacaaaggatcagcaacattttaagcaaagttaaaaagactaggcttcttcagtttagtccatgtcgttatcttctgttggatagttatgaacattttagctctgagagttctgaaagttttttcctttattctgatgtcataatctccaaagctatcagaaaacttgcacttaagaatacctgctagagttctatagttgattataaatcgccttctaaagaggactaaaacaagacaacaattgtctgtggatagtaaaaagttttaggccagcccctattaaagccacagtagataaggaaatttggttgattttgtggtacacagaattttacataacaattataaataacatacattaagtcgtattagaattataggagtttcccataactttggaacatattccaataacacatttatgcaaatatagtacaatgcaaacaaaacaccattttacatttgataatgcttcctgtatgacttttacaccaaataagccaaatttcacctttatattaatgttctattaatgttaaacccaattcttaataaaattttacaaatatgtctatccaatcttaatcggtttgaccataaggtaagattcttataaccctttacatttttttgtgaaagagcagattagtgctctaagaaaaacctgttgtgcttttattccaatgtttaatttacggaaaaactgagtaacacccctttaactttagtcaatatgttcacacacagaatctctctcaatttttttcacaccatccacaactgttcaaacttttagctttattctaacttaaaataattatttaactctttaggcaaaaaaatccacattcccgtgccttcttataatcttttaccaaaagtacattttattttccttacacaccttgcatatagaactgtttcttcaatagtctcaattacatgttacgatgttaacttttacgtttggtgaaaaccctggttagtaagcaattttaattgtgttactaggacacaccaggcagaactgcagataagaactgactctccagcatagctagggggcatggctaactccacatgtccccaggccttatctagaatctaatggctttacggtaggcaaattgaacagtttccaaagtcaaccagtttgaccttaaagcatttagcaaatctaatatctgaccttaatttagaccaaatgtctacattttcaagacattttattttacctataatttttaaaactgtctttatttccaaaagattactaaagtcacgtgaacaaaaaggcattaaagtttccatttttctgaaaaaatattaagtgcttatttttctaagccaatcaattagagctcttttatacataaacatacaacacatattaatacatagaagattccgcacgtgtaagatttttcattgccagtttcttaagtggattactggcttcagggtggagcccttggaggaaaagcgccaggaaagcatgcgtttctggggccaaataagcagctgaaggcaaagacagatccccaaaattaagggtgccattttatgctggttcctggatccccaaaaggagggaaatactacagaagacagtacagtgcttctactctgcatttcactgcaaggcaacccaaagccaatcagcccatttcgtcatcagcccatccttcatggaagtctcatctcccagtggggggtggggatgtttccttatcttccaggtggccaagagcatacttctccgatccaagtgtgcaaagagtcaagtgcccctccctaactactattagccatcccttaaagtatatttcctacctagttattacacaccaaagctctctcataatgcaaagtaatttctgatacccccaaaactcaaaactgtcagataacacaatgcaaaacagaacacagcctttgattttgagagggatccatgtgcttttaattcctggggtttcatgaggaaaagagggttttttccctaaacagggtctgtggcacttcctctgtttttcccaaggggtcttaggctaccagaagttatcttagggcctctcatgtgtgcattaagagtggaaagacagctgggcaccatggctcgggcctgtaatcccagcactttgagaggccgaggcgggcagatcacgaggtcaggagatcgaggccatcctggctaacacagtgaaatcccgtctctaccaaaaatacaaaaaaaattagccgggcatggtggcacacacctgtagtcccagctacttgggaggctgaggcaggagaatcgcttgaacccgggaggcagaggttgcggtgagccaagatcgcgccactgcactccagcctgggcaacagagcaagactctgtctcaaaaaaaaaaaaaaaaaagtggaaagccaaaaaacaaatggagaaaaataatttagtcgactgaaaagaaaaaacctttttccataaaaacaagttccaagaagagaaaaaaataaaggcctgttaaatatatctatagcttgtctatccatttttacgtaagctgacttttaaccatagtgctctttaaaaaaacaaatcctttcagatctcttattacctgactttagccttcccaaatgaccaatatttctagcttctgaactttatcaaaggtgctgagagaaaggaaaatttaagacagtccacggaggagaagagaatagacaagatcacacagatattaaaccacagaaatgacttacttcctagtggagaactgaaccaggactgccagtgtgaaagtgcaaaatgtcagctactgagctacatacagtaaggggtagtccccatttcctttcccagaacaagtctacagtagttaattttgagcttgcagaggcttttaactatttaatatgatttttagagctaactatgacatgaaccctaaaattcctgttccctggaaaggggagaccaaaagtactgccacgtggttacaaggtcaagctcccaaggacgtaaaacaaggtggagacttcatccagtatttgtgtttgtttcagagacctgcagccaaatttgttactgaccagcttgctggttattcttgaaaagcgggcttacaggtgttctaagcccgtgttttatcctgaagtacccctcaacacagaaaaacaaattcatagcacaaaatacaccagcttaagactagccttagaattcttttttgcattaatcaaaactttacagaggagataaacactgatttttttttttaaccattcagtcaaccgtttgcacagagagagagagaagcctgaaatctgactggtaagaaattcttactcttttgccggcatgccaggcttctgggttccctttccctgagcagccctagtgatccagcttgtggcaccatagccatgggggccaagctgcatcataaaggaaaattttttttttcgttctggccagagcaaagtccatgtgataaaaacagagacattagccactctgcttagcacccaatatcaaactggcaaggcttaaatttgtccccagatgggccccatcatctttaatccaaactccgacttaagagtttcaacacgtggtctctgggcaagatggtcaccctgagtaatagaaaagataggaaaggaaaagtagagaaggaaagtattgcctgtggcagggtggggaaggtgaacagcttagggaggccagagaaagacccacccattgcagcaacactgaaaagttcaggcggctgtttctcagtaccaaagagatcttttccagccagtctcatcagctctcatttccccttttagggaagaaaaacctccccatgtcctacgatcctgtacatgcctaatcctgccacccacagccatagcaaagagtgcaaggcagattaatccaaagagaatagcagttaacatccaatagtgacgagaggggactctaatcctcctaagttgggcctctaacccaaggtcagtcaagcatccttgccttttattaagaggggctccaacccactgtgtcttaggagagactctaactcccctaagttgggcctctaacccaatcccatcctttacccaggtaccccactacttacccaaagttgtccaatcagtgctgcatctatttcctttgggtcgggggtctcaatattgtcccttttgtggttcatgagaaagatgttactagaccccaccacttacccaaagttagcctttgggtcaggggtttctgcagtatagtcccttctatggtcgccagaaatatgttacaggaacgaggtcctgatccagaccccaagagagggttcctgtatctcgtgcaagaaagaagtcagggcgagtccacagtgcaaaatgaaagcaagtttattaagaaagtaaaggaataaaaggatggctgctccacagcctacaggagctctttaggcactagagatactatttcctggtcaattatattacaaatatttgcttccagtatgtgtcttttttattttgcatcttttgtcaatgttcaatttctttaaatttttattaaatgttttgtgacttaagaacatttctgctgggcacggtggctcacacctgtgatcccagcactttaggaggccgaggcaggcggatcacgaggtcaggagatcgagaccatcctggctaacacggtgaaaccccatctctactaaaaatacaaaaaattagccaggcgtggtggcgtacgcctgaagtcccagctactcgggaggctgaggcaggagaatggcatgaacccgggaggcagaggttgcagtgagcggagatcgcaccactgcactccagcctgggcgacagagcaagattccatctcaaaaaaaaaaaagaacatttctgacctaagaatataaaattaatctcttatctcctagatttttatgatttttaaaagaaatcaaaagctctttattccatctcaaatctgaggtagggatctactaccacatttttcaggcctaatacttccctgctgctttaaaatgctgtctttatatcatgtattaaatttccatatacgcatgtgttttaaaaaagtacttaagttaatatgcttgctacagaaatgtgttatacatataaacatgtatgtatgtatatgggggtatttttgccaaatagtggaacagaaattctaggtttttgttttattctctgatttgtttggctcatataccataaattggcagggattttattaattatgtgtgttctttccaacacagaaaaaaggcccccatagaagccttctttactcttaaatgcccatggagatcaaacctaatcctaggcttatcttaatggctaaatctccttggagaataaactaattctaggagcttcaggtggtgtgaattagactatgtgaatcatttcaaaataaaaattattttttaaagaaatccaatatatagatgtttttaggaaaagaaagcaaatcataaaacatgtatgggatgatcagtttatttaaaagcctgtgtgtatgtgactaaatgaacagcaaaaggtctggaagaacatagaacacattaataacactggggacctcttgaaaagcaagaattaaagaaggaaacgaaataaagggagacttctttttttgctccatataatttttcaaaataattgtatgtggagtcaaatttttcaaatccatgaataatatctgaaatatgaatttgcttttaaaacaatattcatctttatgctcttgtaaatgtgtatttattacctttataaatcagaaaaaataagaagaaatacataatagtagttgacattaaggacaagtttgacaatctctttttaagttctttttctcttcattttctttttcacttacacctatatgacaacaggacttctggttcaagatcactgcctgagtatacagacatatattccctccctttcaagacccagtgaaatgacaaaaagtaaagcatggaaaccacaccaatgaacaatatgggaccatcaagcaaaagagatcagaacaaaattcctgacaatagaaaacaaagggcgttaaatattgaagtagaatgtacactacaacctcagaaataccaggtacaaaaccaggattgaaaaaaaaacgtaggtggaaacagaaaccttaactgacagtctacatatccattgtttcattcaacaaaattgaacacccaggacataccagttcctgtcctatgatacaaacaataggcaaacccaaaataaagcagggggcacaaaattgtgagggtggcagtagaaatatcacttcagataagtcaggaaacatttctagggaaaaaaattgagaagagagacgcaaaaaaaaataagggagcaaggaaggagaacaagaatcatttcttaagcaatgataatgatgtaaactgtgctaagatatttaaaaatcatcgtattaaatcatcaccacacatagagttacctccaatttagagatttttttaaaaaatgaggctcaaagaagtcagaaattattcaaggttgtacagataactataataagtaataccaggttttaaatgcagctcaagctcttcaccaaattaataatactaattttatcttctgggaacctacacccatgctaacaaaagccaagtggggtacctagacttctaaacttgccaggctgtaataaagcaccctaaaactgccaccatagtagtatccaagaagcccaagtagggagatagggcctttactcctgtccagcaatatggtgacacctcttcccctcttccccttaggtggtatcagaggaggcctggtagagactgaggactttcaccatcactgagtagtaacaaggcaacccacactgtggtgtcaatggtgataacctgggaatcctggacttccatccctacccagcagtaacaaggtgctcttccttatccctcaggtatcagcaaaggcctcacaggaaattgggacttctatcaccacctggcaataaggagacagtgccccataactttcaactacaagacccaaagaaatccaccgaaaggcacatgataattgaatttctgaaaactgaagaaaaaaaatattgaaatcagccagaaaaaaaaatgacaacttatcaatgggggagggagggcacaaaacaattcaaatgacagcagatttgtcatcagaaatcatggcagccagaaagaagaagaaaaatattttcacgtgataaaagaaaagaagcatcagactagaaatgtgtatccagtaaaattgccctcaaagaatcaaggggaagtcaagacattctcagataaaagaaaactaagataatttgtcattggagatctaaaagaatgaagaatgactattggaggttctctaaacagaaaggaagcaataaaaaaagaaaccttggaacatacaaaggaagaaaaaacacaagaaacaaaattatgaataaataaaataggctttccttcttctcctgagtttcttaaattatgtttgacagttgttggaagtggttttaaatgtatgtagaggaaatatgtgaaactcttttatcataaatgagggacggtaaaggaatataaaaacaggtaagatttctctactccactcaaagtggtaaaaaaaatcagtaaactgtgatacatatgtatatataatataccaagagcaatgtatataaaaatacctaaagcaactactagaagaactatacaaagagagacactgaaaaacacagatgaatccaaatggaattctaaaaatgttcaagtaacccataggaaggcagataatgaaaacagaaatggagaacaaatacaaagacttaagtattaacatataaataattacattaaatgtaaatggtctaaatataccaattaaaagatagaaattggcacagcagattgatgagaaaccacgtcccaactatgccgttacaagtcatttacctcaaataataacatagataggttgtatgtaaaaggatataaaacatatgccatgtgaacattaatgaaaaaagcgtgttagctatattaacatcagataaagtaagctttggagaaaataaaattaccaaagacagagagggacattatataatgataaaagggccgacagaccaagaagtaatagcaattctaaatgtctacacaccaaacaatgtggctgcaatatataaagcaaaaacacagaaataaaaaaatacacaaatctataattatatttgtagactttcaaacactcctctttcaacaactgatagaaaaactagacagaaaatcatcaagtatacagaactcaacataaacaagatctaatcaacatttataggacactcccccactacaacagcagaatacacattctttccaagtacccacagaacatacatcaaatataccatacggtgggccctaaaacaaatgtcaacaaatttaaaggactgaaatcacatgaagagtttctggctacaatggaaaaaactagaaattaataacagaaagacagcaggaaaatctccaaacactttgaaactaaacaacacacttacagtcctgagaagcaaagaggaagtcataaggcaaataaaaaaaaaaaccacactgaactaaaatgaaaatataaaatatcaaaatttgtgggacacagctaaagcagttctgagaggaaaatttataatagcatattttaaaagtggcaaacggccaggtgcggtggctcacacctataatcccggcactttgtgaggccgaggcgggtggatcatgaggtcaggagatccagatcctggctaacatagtgaaaccctgtctctactaaaaatacaaaaaaaaaaaaaattagccaggcatggtgacgggtgcctgtagtcccagctactggggaggctgaggcaggagaatggtgtgaaccaggaggcggagctggcagtgagccgagactgcaccactgcactctagcctgggcgacagagtgagactctgtctcaaaaaaaaaaaaaagcgggggggggggggggggactctcaaatcagtaatctaatctgctaacaagaacctagaaaaaaagaagagttcaacagacccaaagcagaaaaaaaggaagcaacaaagagcagaaattgctgaaattgaaaacagaaaacaaatgagaaaattaatgtgatcaggagatggttctttgtagagatcagtaaaatcaacaaactgctaccaaaactgaaaaacaaggcaggaagacacaaattaacaataactgaaatgaggccaggtgtggtggctcacacctgtaatcccagcactttgggaggtcgaggcgggcggatcgcctgaagtcaggagtttgagaccagcctgaccaacatggagaaatcccctctactaaaaatacaaaaattagccaggagtggtgggcctgtaatcccagctactcaggaggctgaggcaagagaatcgcttaacccggcgggcagaggttgcagtgagccgagatcgcgccactgtactccagcctgggcaacaagagcaaaactccgtctcgaaaaaaagaaagaaaaacaataactgaaatgaaacaggagacatcaccacatagcctgcagacatctaacaaataataagagaatgttataaacaattctacacacataaacttgataatttaggtgaaatcaaccacttcctctaaaaaacaaatgcaacgcatccaatttgaaacagataatttgaattactttataactattaaggaaatcgaattcataattttaaaatttcaaaaattaaaaatctctgggcccactggccaggtgcagtggctcacgcctgtaatcctagtactttgtggggccaaggcgggtggatcacctgaggtcaggagttcaagaccagcctggtcaacatggcaaaatcctctctctactaaaactacaaagattagcccggcgtggtggcacacacctataatcccagctactcgggaggctgaggaaggagaatcgcttgaacccaggagttggaggttgtggtgacccgagatcgcaccactgcactccagcctgggcaacaagagcaaatctgtgtctcaaaaaaaaaaaaaaaattctgggcccagagtgtttcactgaaaattctaccaaatgtataaaaaagaatcagcaccattctatacaatctcttccaaaaaataagagagaacatttccccattcatttataaaggtattatagtattaaccctgatatccagagagtacctgagaaaaaaactacaggacaatattccttatcgatacacgaaaacaatccttaacaaactataaacaaaattcagcaatatataaaaagaattatataccatgaccaagtggcgcttattccagggataaaaagttcgttaaacattttttaaatcaagtaataaaatgcaccaccatatcaacaaactaaagaagaaaatcataaatcaattcattgaggaaaaaaaattgacaacatctaatacctattcatgataaaaaccctctgcaaactaggaataagaagtgccctcaaattgataaatggtatctacaaaaacctacagctaacagctatactactgctacttaatagtgaaaagactgaatgctatatctgtgtaatcagaaacaaggcaaggatatccacttctactactcataaacattgtgctagattcttctagtcactgcagtaagtcaagagaagaaaacaaaaggcacacaaatcagaaagaaaaaactccttatttatagacaatgtgattgtctacattcaaaattccaaggtatctaccaaaacaaactcttagaactaatgcgtgagttcagcaaggtaacaaatacaagataaatatacaaaaagcaaatgtggccgggcgcagtggctcacacctgtaatcccagcactttgggaggctgaggcaggtggatcacctgaggtcaggagttcaaggacagcctgaccaacatggagaaaccccgtctctattgaaaataaaaaaattagctggtggtggcacatgcctgtaatcccagctactcgggaggctgaggcaggagaattgcttggaccccggaggtggaggttgcagtgagccaagatcgtgccattgcactccagcctgggcaacaagaacaaaactccatcattcattcatagacagacagacagacagatagatagatagatagatagatagatagatagatagatagatttttttaaaagcaaatgtatttctatattataaatgtatttctaaacttatttctgtgttctatgtcttaaaacttgaaaatacaatataatttacaatcactccaaaaacataaaatattaagtgtaaatctaacaacatatgcatagaaaatattaaaaactatacaacgctgatgagcaaaataaaaaatctaaataaatgaagaacataccatgttcatagactggaaaactcaccaagaaaagatgttatttctccccaatctgatagctaaacaacaaaattcctatcaaattcctaggaagactttttttgtattcttttttgtgcaaacacaatttttaagagttttacttacagtagcttgattattctaagcttatttttctctttcttcctttttttaaccaaatacccagacttcaatattctaagcttatacagaaaggaaaagaaactagaagagctaaaacaatttgaaaaacaaaacagtacacataataactctacccaaaaagtaaatgggaaaaaaaaaaacctcagtctatgtctcacactgtgcaataaggattaattaactcagcaaaagtctgggtttcccacaccgtgcacgttccgagaaagatttggcccttgcccagctcctaggaagtaacctctaagcccttggaatgtccagcctagtaagaaagtctttctttacctgggggttttaggccactccatatagtctatgctaataatgtgattaatggtgggggccttggaccaaatggtatcagcttgagggctgcagacggaggtcatccatgagggcagtcaaccacacctacataccgacctaccaaaaaaccctggacaccagggctcagctgagcttacccagttttcaatattccacatgttctcatacatcactgctagaagaaacaaactgtgcacatgacttcgcagtgatagaacgactataaatttgggtctggtgtctcctggaccctgtcctttgcttctttttccatcactgatttaaatctgtatcctttagctgtaacaaaccatagccgtaagtataacaactttaagttctgtgattctttatgagaatcactgagtctaggagaagccttggggactcctaaacacacatatataaaaaattaactcaaaatggatcacaaatataataataaaatatttaagaaaaaaatgagaaaatatcttcaagatgtagaaccaggcaaagagttcttaaacttgacataaaaagcacaaaccataaagggaaaaaaccagtacagtgaatttcaaattttaaaacttgtgctctatgaggccagatgtggtgggtcatgcctgtaatcccaacacttagagaggcagaggctggaggatcacttgagcccaggagttcaagaccaacctggacaacataataggaccctgtccttacaaaaaacaaaaacaaaaacaaaagccaggaatggtggtacaagcctgtaaccaaagctacttgggaggctgaagcagaaggatcacttgagaccatgatagaaggatcacagtgagccatgatagcacaactgcacgccagcctgggtgacagagtgagactatcttcaaaacaatgaaaaaaaaaaaacagggagtatgggagggaacctgtgctctgtggccaggtatgacggtatgcaccactacactacagcctgggcaacactgcaggaccctgtctttaaaaaaaaaaaaaaaaaagtccaggtgcagtggctcatgcctgtaatcccagcactttgggaggctgaggcaggtggatcacaaggtcaggagttcgagaccagcctggccaacatggtgaaacgctgtctctagtaaaaatacaaaaattagccaggcgtggtggcgtgcacctgtaatcccagctactcaggaggctgaggcaggagaatcacttgaacccgggaggcggagcttgcagtgaaccatgatagtgccactgcactccagcctgggcaagagagcgagactctgtgtcaaaaaaaaaaaaaggctgaggtaggaggggatcacttgagcccaggagttcaagaccagcctgggcaatgtagcaagctccagtctctaaaaaataaaaataaaaaaaattttaaaaatagtaaaaccttgcgctttgcaggagatacaattaaaagtgagaggtgatgccagctgggcttcctgggtcgagtaggggcttggaaagctgtaaaactcactcatttcctgcatcagggattacttcggttctggataaataatattgaggtataatatatgcttaaaatattcctaacaccaggatttacttatatgttttcttccccaagaaagctataaacagcgagaattttaggtgtaagttttcctgtgtgccctcccccgaaaccagagttaaagaaaagattaactgcccatttttctgtgatcagtgggccttatctatcctcccaattccttgtaaacactgtttgtaagttctataagatcctgcttttttgctgtgcagctgcaaggccataaatcaggtaagcgtaagtcgcaatttcagtttttctcaaaatctaaagcatgtcacaaaataatttactgcctttgtttctcgctcctgtactggaacatacttcccgcctcacatatctcccgccttaaagagtttaaaaggcaatcacccgagctagcagtggcaacccattcgggaccccttccatgctgtggaagctttgtactttcgctctgctcaataaaacctacagctcattctctctcttggtccaagtatctgtcactcgccatggtcagccgccacaccaattctttggcgtggctaggcaaagaaccttgggtgttacatcttagtgagccagccaggagactccaggaagagcatcccaactgccacgcagtgagtaccctcggacctcttttgcttgctattctgtcccatccttccttagaattcggaggctaaacactgggcacctgtcagccagttaaaggcgattagcaagaccactggactaaaaacacgagtgtcagcctgggaaagggctctctgacaatccctgaccctttggagttgggagcactggtttgcccggaaccagttttaagtctttcactttctgtagtggtcccgaagtacacccgggagtgctcagcaaatgtcatggtctcccagatatccaggttgagaccatggccccaccagaggctcccacagcatgggttactaagcgtgagacagccacatcttctgactcctgcgtcctgggttcaaataactgccggttagatttctttcctcacctggtaagcaagattattcccactagacaggaccaagaatccctatttaggagacttaagtttttaaggtggtgttcagaagttccttgttgatggtgccctctggaatttaggcaggtgttgccatctgatggccactttgaaaggccagttccccaccatcgtgtatggtctcccacatcaggacaatttgaagacagatctgtaattttcatgtggatggtagaggccctaggacattttcttcattgttccccagatgaatttcctttttttggtgcctctcaagtataatctgtggtgtatgggtacggcccttagagcagttgaattgctttttcaaccattcaatcatggatattggaagaaagaaaatatagtcaattgagacacgggatactggtaccaccttaagatgggggcttactcctttgatggaaagtggggacaaaaggctagagtgcagcagttgttctctcagccctggcctagaggacatcaaccatcccctttgagcttactaagcctcctgtcactaattcagagattcctccttgaagggcagttttatggccaggcccacgtaaattgggccttgacatgcaagcatcagtggtgcccccgacccaggccttgccaccccagaacagataggacgcgttggcaaagggaccacaataaatccaacagtcctcatgccccatctagtggtcaatgggtgcacggcagagggcaaggatgatttccattctgccggtaagcgtggttaaatctggtaaatggaaggctcaaggacgatcatgcgctccgagcacaattggactggacccttgggggatgccctaaggggaagatgagtccctaagactaaccaggggtgcgggcatacctgtgtttaaaattccagttgggcaccacgccttcaaaactggacactcccttgagatgtatcctgaataactgggacaagttcgaccctgagaccttaaaaaagaagcgactgattgtcttctgtaccaatgcctggccacagtactccttacaaaatggagaaacttggccccctgagggaagtattaattataacaccattctacaactagatcttttctgtaaacgggaaggtaaatggagtgaaatcccttatgtacaggctttctttgcccttcgtgacaatactgctctatgccaagcctgcaagatttgcccaaatgacaaaaacccacaattgcctccatactcagggcctccttccttagccccactctcttccctcactgactctcctccatccagccccaccaaagtgttagaggcacaccgaaaagaaaacgtaaactccgcgaaccaggcgcccaaactaagtcccttacaagcagtaggaggagaatttaggcccacccatgtgcatgtctctttctcactctcagatttaaaacaaataaaggcagatacagggaaattctcggatgatcccaataactatatagatgtcttacaagggttaggacagtcctttgatctagcatggaggggcatcatgttgctccttgatcagaccttaagtcctactgaaaaggagggagctttagcggcagcccagcaatttagggatttatggtatctcagccaggtaaacagatcaaatggccccagaggagaaggaaaaattcccccacagggcaacaggaggtcaccgctgtagaccctcattgggatactgactcagatcatgaagattggagccgcaggcatttgctaacttgtatcttggaagggttaagaagaagtaggaagaagcctatgaactactcaatgctatccacaattacacagggaaaagaagaaaacccctcagcttttctagaaagggtatgggaggctctaagaaagtatacctccctaactccggattccctggaaggccaacttattctaaaggataaatttatcacccaatcagcggccaatattaggagaaaactccaaaagtctgccttaggcccagaacaaaatttggaggcattattaaacctggtgaccttggtgttctataaaatggaccgagaggaacaggccaaaagggaaaagcaagataagagaaagaccgcagccttggtcatggctctcagacaagcaaacattggaggttcagaaaggacaaaaaatggagcaggacaatcacctggtagggcttgtgatcactgtggtttgcaaagacactttaaaaaagattgtccaacaaaaaacaaactgcccccttgcccacgtccaatatgccaaggaaaccattggaaggcatgctgccccagatgatgaaggctctctgggccagaagcccccagccagatgattcagcaagaggactgagggtgcctggggcaagcgccagctcatatcaccctcacagagccccgggtaagctcaaccattaagaaccaggaaatcgatttcctcctggacaccagcacggtcttctcagtgttaatctcctgccctagacagttatcctcaagatccattaccatccaaggaatcctaggacagcctgtaaccaggtatttctcccacctcctcagctgcaactgggagaccttgctcttttcacgtctttcttatcatgcctgaaagtcccacacccttattaaggagggacatattatccaaagctggagctattaactacacgaatacgggggacaaattacccatttgttgtcccttacttgaggagggaatcgaccctgaagtctgggcaatggaaggacaattcggtagggcaaaaaatgcctgtccagttcaaattaggctaaaagaccccaccacttttccttatcaaaggcaatatcccctatggcctgaagctcataaaggaccagaggatattattaggcatttaaaagctcaaggcttagtgagaaaatgggacagtccctgcaacaccccaatcctacgagtacaaaaaccaaatggtcagtggagaccagtgcaagacctcagaatcatcaatgaggcagtaattcctttatatgctgctgtacccaacccctaagccccgctctctcagataccagaggaagcagaacggttcactgttctggacctcaaggatgccttctcctgcattccccagcacactgactcccagttcctctttgcctttgaggatcctacagaccacacatcccgactttcgtggatggtcctgccccaggggtttagggatagccctcatctgtttggtcaggcactggcccaagacctaggccaattctcaagtccaggcactctagtcctccaatacgcagatgacttactttgggctaccagtttggaagcctcacatcaacagactactctagatctcttgaattttctagctaatcgagggtacaaggtatttaagtcagaggcccagctctgccaacaacaaattaaatatctaggcttaaacctagccgaaagaactagggccctcagcaaagaacaaattgagcctatactggcttatcctcgccctaagacattgaaacagttgcagggattccttggaatcgccggcttttgccaactgtgaatccctggatacagtgagaaggccaagccactctatattctgataaaggagacccagagggcaaataactcatctagtagaatgggaatcagaggcggaaacagccttcaaaactttataacagaccctagtacatgctccagccctaagccttcccacgggacaaaatttatctttatatgtcacagagagaccaggaatagctcttggagttctaagtcagacccgtgggatagccctacaaccaggggcatacctaagtaaggaaactaatgtagtagcaaaaggctggcctcactgtttatgggtggttgcagcagcggccatcttagtatcagagactatcaaaataatacaaggaaaggatctcactgtctggactactcatgatgtaagtggcatattaaatgctaaaggaagtttgtggctctcagataaccacctactcaaataccaggcactaatccttgaaggatcagtgtttcaaatatgcacatgtgcagccctcaactctgccacttttctcccagaggatggggagccaattgagcataactgccaccaaattattgcccagacttatgccgcctgggaggatctcttagaagttcctttaactaaccctgaccttaacctgtatactgatagaagttcatttaggtacaaagggcaggctatgccatagttagcaatgcaacagtacttgagagtaagcctcttcccccagggaccagcacccagttagcagaactcgtggcacttacctgagccttagaactgggagaaggaaaaagaataaatgtgtatacagatagcagatatgcttatctagttctacatgcccatgctgcaatatggaaagagagggagtttataacctctcaggggacacccattaagtaccacaaggaaatcatgaaattactgcacgcagtgcagaaacccaagaaggcggcagtcttacactgccggggtcatcaaaaagatgaaggagaagcagcagaaggaaactgccgaggagatgctgaggccaaaactgctgctaagcaggacttccctttagaagtgcccatggaaggacccttagtatggagcaaccccctccaggaggttaagccccagtattccccaagcgaaacagaatggggactctcatgggggcatagttttctcccctcagggtggttagcgacagaagagggaaaggtgctcatacctgaagccagccagtggaaaatacttaagaccctccaacaaacctttcatacaggttttgaaagtacccgtaagatggccaaatccctatttacagggccaaaccttctccaaactatgcggcaggtagtcaaggcctgggagatgtgccaaagaaataatcccttggtccatcataaggcccctctgggggaacaaagaatagggcactatcctgtagaggactggcagttaaacttcacccacatgcctaagtcaagaggatttcaatacttgttggtctatgttgatacctttacaaagtgggtggaagccttcccctgcacaacagagaaggcccaagaagtagttaaaatcttacttcatgaaataattcctatattcggacttcccccaaagcttacagagcaacaatggtccagcttttaaagctacaataactcaaggaatttccaaggcactaggaatacaatatcaccttcactgtgcctggagaccacaatcctcagggaaagtcgaaaaggcaaatgaaacactaaagaggcatttgagaaagtatctcccatggccactctcttgcccatggccttgttaagaatccgaaattcccctggaaatttgatccaaaatcaaagggggctcagtccatatgaaatgctgtatggatggccttttctcacaaatgacctcctgctcaatcaggaaacggccaatttggtcaaagatataataacttctctagcaaagtatcaacaaaaccttaaaactttacccaaagggtatgacaggagaaaagggatagagctgttccaaccagaagatctagtagtggtcaagtccctcccctctaccttcccatctatggatcccttgtgggagggaccatactcagtaatcctctctatccccactgaggttaaggtggcaggagtggaatcctggattcaccacacccgagttaaaccttggacaccccttgaggaacttacaggactatcagctcaggagtctgaagatcagccagaccagccttgatacacctgtgacccacttgaggccctgcttctcctatttcggaaggaagcatcccaggctaaaaagactcctgcagttaatcctaaagaagaaaaactcatctctacctaatagaggataagcagaaagcctacatggatctttgacatctctccttgctctctttaatggagtccttatactgtttcatcatattaaacagtatactaaccataccctttgcagtaggattatatactgtagctcctgccaggacaaaaatcctgaccacatcaaccttttttctatcgtccttccttttaacaatttactccttcttccctcctcctttctactaccgctccacctacagagcaccatgactccctttataaggatctcctaagcttcttttaactctcctaagtattctttctgccacctcttcatccctccccaactgcacttgcttctctagtgcatactctcctccccttcccagaaacactgatgtagtctacttcgaaaggatattgtttaaaactaaatcagggtttactacccacacctatatgagaaaggaatgttatagtgctgcttctctctgctcccacaatggccatacatatcaccaaggacaaatgacccagtccaactgtcccgatgccctagggactacccaatgttggacatattacacccatgtgggtataactgatgagagaggtgtccaggataaagccaaaaacaacatgtccaacaagtaattaaaaacttgatccaaccatctaacactccaagtccatataagaaactagacctttccgggttacaaaagactcttgactctcattcccatctctagagtctatttaacaccacattcacaggaatgcaggaggcctctcctaacaatccaactaactactggatgtgtcttcccttgcgtttccaaccacatgtcccagtagtccctgtcccaggacattggaacctatccacctcagtcctaaacaccaccgggataattggctccccagtcaccaatctgccagccacacaggcctcaaatctcacatgtataaattttagcatgactcccaatagaaacatctcccaaagtcaatcctggataccagtgacctcaggtttcacctgtctaactccagacatctttttcatccgtgctaacatagcttattgatgtctaaagggcaccccaaaagagttatgctttctctcatttctagcacccccatgtccatttataccgaacaagagttggaaagtctccttataccccagtcccgccacgcccgagcgcctattctcccttttatggtaggagccagaatactgggtgggcttgggacaggaattggaggtataacctccttcacccaattctattataaaatatcacaagaattaaatgatgatatggaatgggttgccaattccctgatgaccctacaaagccagcttaattctctgactggggtggccctccaaaaacgaagggccctagacttactaacagctaaaagaagaagaacctgcctcttcttaggagaagaatgttgctactttgtcaaccagtcaggaattattgccgaaaaagtccaggagctaagggaatgaagagaacgtagaaagagtgaactccaactctcaggaccctggagtatatttaaccaatgagtaccttggcttctcccctttctaggccctgtaacagccatcttgctatcactcgccttcggtccctgtatttttaacctccttgtcaaatttatttcctctaggataaaggccatcaagctacaaatggccttacaaatggaacctcaaatgaatttaactcaagcttctaccgaggaccccaggatcagcccactggtctcttaactggcctagaaagttcccctctggaggacaatacaacagcagggccccatcgtcgcccctaaccagcaggaagtagctagagcagtcatcgcccagttcccaacagcagttggggtgtcctgtttagaggggggactgagaggtgatgccagctgagcttcctgggttgagtaggggcttggaaagctgtaaaactcactcatttcctgcatcaggacttacttcagttctggataaataatactgaggatatatgcttaaaatattcctaacaccaggatttgcttatatgttttcttcccaagaaagctataaacagcgagaattttagctgtaagttttcctgtatgccccactcctcccctgccaaaaccagagttaaagaaaagattaactgcccatttttctgtgatcagcggaccttatctatcctcccaattccttatgaacatagttcgttaagttctataagatcctctttttcttgctgtacagctccaaggccacaaaacgagtaagcataagtcgcaatttcagattttctcaaaatctaaggcatgtcacaaaataatttactgcctttgtttcttgctcctgtaacattcttcccgcctcacgtatctcccgccttaaagagtttaaaaggcaatcacccaagctagcagtggcaacccatttgggaccccttccacactgtagaagctttgtactttcactctgctcaataaaacctacagctcactctctctctcagtccaagtctctgtcactcgccgcagtcagcctccacaccaattctttggcgtggctaggcacagaaccttgggtgttacaaaaggataaaaagacaagatacagagtgcaagaaaatatttgcaaacaatgtatcaaacagagtagtatctaaaatatataaagaactctcaaactcaacagtaaagaagaaaacttctgggcacagtggctcatgcctgtaatcccagcagtttgagaggccaaggtgggtggatcacttgaggccaggagttcaagaacaacctggccaaaaggtgaaaccccatctctactaaaaatagaaaaattagccaggcatggtggtgggtgcctgtaatcccagctactcaggaggctgaggcaggagaatcacttgaacctgggaggcagaggttacagtgagacaaaatcccgccaccgcactcctgcctggacaacagagcaagactccatctcaaaaaaaaaaaaaaaaaaaaggaaacaatacaattaaaacacaggtaaaaggcatgaagagacatttcactgaagaaaaaagaaaacagacaagtgggaaaataagcatatgaaaaactggtcaacattacagtgattaagacctggttttcaggccagcatgtgagaagcctgaaagtcattatctaacaagtaaaaagctgaacaaagtgaaaaagcaacaactcttcttagatcccaaagagaactgaggtcacagtgcaaacagctgctcccaaaacagaagagagcaacatggcaaatgcatagaatacttattagagcttgaaacttgtgtgggacacagcacctaggtgggaaaacttgaattgtattaattgctggaggctgagtatgaagaagtctgagagttaaaaattccaaaacgaccccgtcatagggagactaccagacttttacgagttttacttccaggagtttgacctggttctcacagtaagtatcagagaaaaatcccctcatgactccagaaaagggaagataaaagggtccattttgaaatataccagaacattctattcttaataaggtctgccctcaggagaaactatttaaccagagcctaaactctttgtagttttaacagagcctaacttaccttggggaagagaaataaccaactccagtcaattctagtcttccgggtggttaaagggaaatacccaactaaagctccctgtagccatcctgtcccactcaagttagtaaaaacagaaaaaaactgagaagcatctgtgaagttacaacccaggggcaccggctcactaaaacactgaggccaaatcgtaggacacttcccctccccacacaccttaccaccacattactaaaggtctgctcaccagtttcttttacccagtatatcacgatcagctttcaaaaaataaaaataaaaagtacaaggcatactgtaagacaaaaaaaaaatagtttgaagaaatagagcaagcttcaggactagactcaaacacggcagggatattggaattactagaccaggaatttaaaacaactatgataaatagggtaaaggctttaattgaaaaagtagacatcttccaagaacagacggataatgtaagccgagggataaaaattccaagaatcaaaaagaaatgctacagatcaaaaatactctaatagaaatgaagaatgcctttgatgggatcattagtagactggacttggcacagaaatctctgagcttgaagatatgtcaacagaaactcttaaaactgaaaataaagagaaaaaggctggtaaaaatggaacataattatttaattaaaaaaaaaaggagaagaaggcagaggctgcagccagccaagatcacaccactacactctagcctgggcaacagagcaagactccatccaaaaaaacaaacaaacaaacaaacaaacaaacaaacaaaacacattatatccaagaattgtgggacaactacaaaaggtatgccttacacccttcacaaaatttaactcaaaatagatcacaaccctaaatgtaaaacacaaaactataaaactcccagaaaataacataatagaaaacctagatgacattggttatagcaatgattttttagataaaacggcacaatccgtgaaagcaacaactgataagcttaacttcattaaaatagaaagcatctgctctgcaaaagacaatgccaagagaataagacaagccacagaatgagagaaaatacagtaggccctccatatccgcaggttccacatctgcagactcaaccaaccgtggatcaaaaatattaacaataaaaataatcaaactttaaaaacaatatagtatggcaactatttacacagcacttacattgtattacgtattgtaaggaatctagagatgatttaaagtatacagaagtaagtgtgtagattatatgtaaatactacactattctatataaaggacttgagcatcctcagattttggtatcaggggtcctggaaccaagcctccacaataccaaaggatgtctttatttgcaaaagacatgttcgataaaggcctctcatccaaatatacaaagaactctaaactcaacaataagaaaactaacaacccaattaagaaatgggctttataaagacctttacagagacctcatcaaagatgatatacaggcagcaaacaagcatatgaaaaggtgttccacctcatacatcatcaggaaaatgcaaattaaaacaacaaaatactacacatttattagaaaggcaaaatccagaacactgacaacaccaaatgctaagtaggatgtggagcaacagaaccctcatgtattgctggaatgcaaaatggtacagcctctttggaagacagtttggtggtttttttacaaaactaaatatacaaaattaaatatatagaaaactaaatatactcttaccacatgatccagcaattgagctcctaagtatttaggcaagagagttgggaaccaaaataaaagtcctaacccttccaacagactactggaccctcctttagctaaaagaccccaaaattttaagttagcagccatggcaagacagtaagctgttcatgatccatttgcttccaacccacttctctcctttctaatcactggattttctcaaaagccagtgtgagaaaacaaaagtccaaaagaccccttcgttcaagtcatctaaacacaccccctcctgtttttatagtttcaacatgacaactattttaggccacaaagattttcttcttgataagtggcttttggaagggactggttctggccagtcacctgaggatgcagtttatggacttcttccctacatttcaccttttacatatagaacctaactacaatgcatttaaatattaaatctccacctcaaagtgattatgggaggtattttacatatgagtaaacctaaaacgcatgtgtgtgggtctccttcatgaatattcatggttccttctgtaacctgttgaatatagctgtatgcctagccaatcatcagcataagttcttatcttaaaccctcaccttactggaccccactctgcctggaaatgcctctcaatttctgctgagactatgcctcccagcctgtcagaatggcctatacaagctgcaaacctttgtgagaaatgaagctctcctttccaaatctatgaacctcatcattcttcagctgacagagttgaaagctgacatccacacaaaaacctacacacggctgtttacagcaactttcctcataattgccaaaacctggaaacaaccaagatgtccttcagtaggtgaatgttgataaactgtggtacatccagacaatgggatattactcagcactaaaagcaaatgagccatcaagccatgaaaagacatggagaaacttaaatgcatattactaagtgaataaagccaaacccacagaatatacaacaccaaaagtgaaccctaatgcaggggtccccaaaccccaggccacaaaccagcaccggtcagtggcctgttgggagcccagctgcacagcaggaggtgagtggctgcaggtgagtgagggcagctgagcaccacctcctgtcagatcaatggcagcattaaattctcatagaagcacaaacccactgcacatgcaagggatataggttgtgcgctccttatgagaatctaatgataaatataatgcaatgcacctgaatcatcccaaaaccaaccaccccactccaccctggtccgtggaaaaactatcttccaccaaaccagttcctggtgccaaaaaggttggggactgctaccctaatgcatgaacactgggtgataatagtgtgtccatgtagttttatcaattgtaacaaatatactacactagtaggagataatgacattggaggaggctgtgcatgtgtggggacaagagatatacaggaaatctctgtacctcccaatgaattttcctgctgctctaaaaaaactgctctaaaaaatacagtctattttttaaaatgagacatcactaccacaaggaaataccattatactatcaaaatggctaaatttttttacactaagtggtagcaaagataaaaagaaaactagatcacttatacatacattgctgatggaaatggtacagtcactctagaaaactgtgtggcagtttctttaaaatctaaatatgctactacacaatccagctactacactcctaggcatctactcacccaaagaaatgaagacataggttcacagaaaaacctatacccacatgtttatagcaactttactcataatagtcaaaaactgaaaacatcccaaatgtttttcaataggtaaatggttaaagtgtattctctccaataccaccattactgaatgctactcatcaataaaaaggaatggactgttgatacatgtaacaactggatgaaaatccagagaaaaaagccactttcaaattccagttatgattccatttataaagtattcttgaaaaacaaaactatagaaatggagagtaaatggcttccaagagttaagagataaaggagagggggcagagagagaagtgggtgtgggaaacatgaggtatgtggaaatgttctgaatctcagctctatcaatgtcaataccctggttacaacactattatttcttaaaactgtatataaatctataattatctcaaagtaagaagtttagttaaaaagatgaaggaaaaactcttatgactagagggacaattttctttttttgagatggagtctcgctctgtcccccaggctggagtgcagtggcacgatctcagctcactgcaagctccgcctcctgggttcacgccattctcgtgcctcagcctctcaagtagctgggactacaggcgcccgccaccacgtccagctaattttttgtatttttagtagagacgggatttcattgtattagacaagatggtctcgatctcctgacctcgtgatccgcccacctcagcctcccaaagtgctgggattataggcatgagccaccgcgcccggtcgattagagggacaattttatttgatatacagcaacactgaacattattaaatattcaaacactataattttcagtatgaaacaataaaacatatcccctgaaaattcttgtaccacaaccactcttcaaagattcatatataaacaataagaattttagctcaccttccacgctatcagaacaggaagttccaatgccagtgtctccactgtcagaagctatactgtgtctcctgatatggttatttcgatggttagatggaacagttgtggcctgccacaatgattcattagcaggtagccatgctgatgaataatctgggcctaaaaagggaaatatgtaacagttaacacatatatctgagtaggcagaagattttttttttaccttgtggaaaatacacatagggtataaaaggtataaaaggttcttttctgcccaaaataatttaaaatgatcaacaaaattaaccaaataaatgtatatatcacacatatatcaattaagtgtgattacatagcttcctctagctgaagaactctgttttctgcttccgggcattaaacttttaaagacgtactgctgtgttattaaaaatgttggaactatccacttatcttcaaatgtcagtactctgctctagaataattgataggtggcatctgtgattatacatacatgcgttagctgaaaatcagggctcaggaaaattcaataataatgcatgataatataaataggatatccacatggaatatgaaaacaatccatttttttctgctatatatctactaaattttttctacaatcatcacttaaaatttttaaattttacattattttatttgaattatttccttaattattatttaataacagtttaatagcacagcattttcctactcttagcttgatttgtctttttttttttttgagacgagtctcgctgtcacccaggctgggtggagtgcagtggcgcgatctctgctcactgtaagcgctgcctcccgggttcacgccattctcctgcctcagcctccggagcagctgagactacaggtgcccaccaccacaccccgctaatttttggcatttttagtagagatgaggtttcaccgtgttaaccaggatggtctccatctcctgacctcgtgatccacccgcctccgcctcccaaagtgctgggattgcaggtgtgagccaccgcgcccagctagatttgtccttttaatttaaatactttttagctaatttaaggtttttcaatgttctttcaatgtttatttccacttactcacttttacttaacttttatttgactttttctgttttacccatcacttattttattgtctagtacagtgctactcaaaggatatcaatggaccagtgccaatctgtactatttgttacaagttagatgcagaaataaataagcatctagaaatgttattgtactataattagaaagagaaattttaaattcgttcaactttacataaaacctgtagaagcacaaatctttactaatgcctaatacagtaagtctcaattcagggcttacagaattattcataaaagttaagaagttcccctacatgaattttaggctctcatttcaatgacagttcttaaaaaattaataagcacattacagattatctgaacagccaacttaaaacattatttccacataatttcaatgctcccgtatctgtatagcagccttaaaaagatttatcacataattcaatgtccccatctgtgttttgcggttgaaatagcagttgcttctaagtaaagagcaaatgacatcactgggtatttaccattatttgaaagaagatagctttacagaattattcattgataccctattgaaaccggcatgcaaggaatgccttctggcagtttaaacataagggtaacaaaacaacaaacgtgcataaaattaattataccagtttttttaaccacacttttaggattagttgttctctatgtcagtattaaaatcaaaatatataaacaaattaataaaaccagacctaaagctacctctatcatactaagctcaacattaatgattcacttttaataaaacattgtcacattattttatttaatgcatttatttatttaaatgcaatttatcaattaaatttaggctttatacatgtataaagtatataagcagccttaaaagccttatacatttaaattaacaaatcaaatttgaaaaacagtggccaaagagacacttttaccagctttgaggttcagaacaaccacttaaagctttgtagattctagacttctctcagaatgagacttttcaattcaagtgattcaacactcacattaaagcaccagaagaaggtgttctgtcaccagatctattctaattctgatctgtggtctgtaatctataccaaaattttttttcaatcaggtaacatcccatctaaatgagctcaaagtcctgcctaaactattatcaaaaatggcaaccagcctagtctcacaagtgcaaacctattagctggataattatttttttttaagaatacccagcaaatagcataaataggctgggactatatgtaaatgaaaaaataaatataagaaacgatgccaaatctcactaatggtgggagaagtgaaaaagacaataaattttctggatttttaaaactatcaagttgataaaagaaagactggtgtcaaccaagtgaggggaatgttcgtatatttttgtggccttgcaaattggtacaacctttctaaagggcaaactggaaagtggtatctaaatgtcaatatagacatgaccttctactgagaatttatcctaaggaaatatcagacaattacaaataaatatgagtataaggacattcctgacagcactgcttaaagtaaatgcctatgaacaaaatataaactgttaattagttgataatgtttaagtgctaaaaatgattttatcaacctattttttaacatggaagaacatccagaatatatctagtgtgtatggaagagaagcattttatgtagctatatacataatatgattccacagctggagaagagtttgtacatttacatacatggaagaagctttcagggagctctatatctaaatgctaacactgactatgttttactaaaggaagaaatacattacaggaacatttactccatcattggttattattattattcaatctaccagtttatgtggggaaatgctgaaaattatgcatactgatttgcagattacatcaacatttgattctgagattagaaaccagctatagctcaagatacgcaaattcagattcctagtaacaatttttacaaaagctgcataaaatggctagaattaaaacccttgcttttaggcaatataactattttgagcagtataaagtcatgctccattaaagcctacaacacacctccaccctattgattgttgacaagtcttggccaataaaccatttgtggattaaaaggcaataatcattctctctctcactctctctccactcactcactttctcactccagtaatggggaggaaagcccactgtacatattaatgctatggtgttattatcacaagctaggacaaccttcaatcattagtcttgtataattaactattgccagaaaaacagttcaataaaacctttttctgtcaagagccagattgtaaatattttcagttttgtgggtcactcaatctccgtctcaactagccaattctgccactgtagtctaaatcagctgtagacaataaaatggatgtggctatgttgtaataaaactttatttacaaaaacaggtgacaagtccaatgaaacctgggggccagtttgcagactcctgagatgtggtaaaaaatcattctaactgaaaagagtccctaaaattcaactgattcataagtaactacagccagcatattaattcatttctttatttggaagaaaagtgagctcatcctagagtacatatcagcaagccaggctgcccagaatctgacaattcatgaaagcactactgaggtttttcaaggattacaaagacaaataaatgtcaacaagtgttttaggtttctttttccagaataaatgatctcagtttatccatatggtatggaactcctggacaatgtcaaatatgtgtgatggttaattttacatgacaacttgactggaccatggggtgcccagatatgcagtcaaacattacttccgtgaaggtgtttggatgagctcaacattcagattggtcgactggataaggcagactgccctccataatgtgggtgggcttcactgaaccagctgaaggcctgaacacaacaaaaaagctaaccatcccctaagcagaagagaattcttcctgcctgatcccctttgattaaatacactagtacactggctttttcctaccttcaagcttgaactgatctcttcctggggcttgagcctgccagccttcagactggaactatgctatcaacaatcccaggtctccagcttgccaaatcacctcacagatcttgggacctgtcagccaccataatctcatgagccaattcttaattaattaattaaatgctattggctctgtttctctggagaacttcaatacaatattgggaaaactagaaaaattctaatcttgcctacagatatgaaaaagtggggacagccttctatttagaaaagaacaatagttgtaatcctcaatttccattacagtatttcaatatcatctactcaatatgatacctattccacagatttccaaagcacatcagtacaatctcaactatctgttatctaacttttatacaaaaaaagctataagaaatgacagagaaaatggtctaagacatgctatcattccgcccctctagaaaccctaaattctatctttgaatcacagagcagtacatacatacttagagcctttttatttagcaactcagggaaatgatcttcctaaaatttctttcagtgtactgccaccttataaacttgaacctctgacttttacagaaggacacaaaaagtaagcaaaccacataaatcatcaaattgttgtctaggccgggcaaggtggctcacacctgtaatcccagcactttgggaggccaacgctggcagacagcttgagttcaagagtttaagaccagcctggaaaacatggcaaaagcccatctctacaaaagaaaaaaaaaaaaaaattcaaaaaaatgcctctgtgcatggtggcacatgcctgtagtctcagctacctgggaagctaagctacttgaacccaggaggtggaggctgcagtaagccgagatcatgccactacactccagcctgggtaataaagcaagactgtctcaaaaaaaaaaaaaaaaaaaaaaagttgtctatatatttaagaagttaaaggcaaacactaaaaatatttgcagatatggtattaatgcataattataaagagatcataagcaaactaaaaataaataaataaatactaaatggtttagtctaaatggacaaaggacaaaccccaaagggaaaaacacaaataaaaaattctgaaaaatagtccaagcccactggtaagcaagtagtatcaaattcagaagacatgctatttttcagctatcaatctagcaaaaatgttaaaagaacaaaacaacagtgttcctagatactcccatacactgataatggtaatgttaatttattcattacaaaaacacaaccttttgataggctattaggcaatatacatcatgtgtagcacatgcctgtaataccagctactcaggaagccaaggtaagattgcttaagcccaggagttcgagaccagcctgggcaacatagtgagaccgtctcaaaaaaaaaaaaaggaaaagaattaactatataaattgatctcctcccacctgaactaatttgccttaacctttaaacataactatgtctttaaaaagaagatctggtattgtatgtgcctcaaacactgaagatgattaacaaatgtcatgaaaataacattctaatcttttaatttaaactgaaaaaattcacagtctgaaaagaatgacatgacttgtctttagacaagtcaatccagaagcacaatacaggaagaagtacatgtgaaatatgctgaccaggtgatttaataaggaaaattttctcacagaatagttacaagactatgttactgaaatgggaatattgatatctagtatgcaatatgcacttaaaaactcaaaataaggctgaataacctctggcaataatgtcttacctaaagacaaaaggactgctgtaagaacagcaaagatcccaagaaactctacattggaactcctccttggaagacaatatgttacatttttcaatactaattttttaatactaattttaattattttaatagaatactgagtgcctgcggataacattaaaaattctgaatatttctcagacaggaagattagcattaaataaaaaagcaacctattttacttctgaagctcttttattggaagcaaaaatgcatacagtatcaagtattccacagcatttgaatatatatgtaactgcactgagaacaagaactactctcattgaatattttaatgacagctctaaattgaagaaaataaaaataacactactgacaaagcagatttatacttttaaataagctgaatacataatacaaatcgagaatacaaattgcaatgtttttcagaatgcagattatctgtcacccattagtatgttttaaaatcaacttggaaaccaacactttcaaataaaatagtagataaagcatgtttacccttatattacataagtagcacgcggttcacattttaacatctctgaaatattaacaagtacttttgcacaaagaacctattctgctgctggaataactccactcaagccagcctctactctactatcttctagaatcaagcatgtttatgttattcttctacttacatagatctgtgagccccttacggcatattaaataaattcaaactccttaagttaggcaaagttcttcaccaattgtcagcttcactttgcaacttctacctacaaaaactatctagccacacttacctaatcacttcctccaaacagatgagactctttcatgactccaagctgtttcacttctgcaccttaagagtcctagttcagaattaacttgttctgtcttccctgattcctccaggtggcattaaatactttgttcactcccaatatattattcaaaattccaacaacatttaataaattatattaacccatatgtatatgactttcttctccctcaccaaactgtgaaaaatgaaaggcaactttttttagtgtccagtacctagcaaagagctgcacacttatacagggtctcaataaatgtagtcattataaccactggatacctaacaaatgttcacagaataaaattagaattttggaagccttacaattacaactacaaaaatatctttgtgttcagaaaaaggattcaaacaagcgttttgtttggtggttgttgtctgcttattttaaaatccaggatattttaaactatcccttgagccagtatgcatttaagtatctatttagagatcagtaaatatttatcaatgcagctttttttaaggtaattttaaataatttagagatctgatggccaacattcctaacatgggaaaacagtctccaataggttaaaaagacacaaaactcacacaaaaaattagaacattaaacggtaagaaaaaaacgttcatattaacagtagccaaacagaaaaaaccaacaaatctggaactacactgcagaatatctagctaagatgacagaaacatcacatagtgttattttctccatcccaatcctccactccatttcagtactatttatctctagggtaagtgactccaatagtcttagtttgtttcttttatcacagaattaccagtatagctcagtgtgcactgtgaaaccaggctacctgggttcaagttcattctacctcttattagcagtaagtcctcataaatcacttaacctctctgtgcctcaatttcttcatatgtaagagaagaaaaaaattatagaatagtacctatattatagggttgttgtgatcaatgaacatgtaaagttttttgttgttgttattgtttttgagacagagcctctctcagttgcccaggatggagtgcagtagtgcagtctcggctcactgcaacattcatcccccaggttcaagagattctcctgcctcagcctcccaagttgtgcggattacaggcacacaccaccatgtctggctaattttttaggttttttttaagtagagatggggtttcgccatgttggccaggctggtctcgaactcctgacctcaagtgatccgcctgctcagcctcccaaagtactgggattacaggcgtgagccactgcacctggcctgtaaatatatttttgaaagtgccagacatataattaggatctcaataaatgttattatttttattactgtccatgcatagaaattttccagaaggataactaaaaactattaaaaatggagtggaggactgacatgaaaggtagataaaaaagcttacttcactttaagcttttctgtactgagtcaacattttactgagcatgtgtaactttaataatgagaagaaaaaaatcatctgacaaataccacataacaataattcttctgctcctcatgaggtacagtaccccactctcttccaagtttttaaccttgctcttttccctccctatttaatcaaggacatctacactgtcaccagcttctctcttaatatcttactagcatgtttacaactacttatctccttcaaaacacaaacccaatgcccatctctctgataaccaccacttttttaacatcattccaagagattaagcataagctttctatctctatgatctgcaaagtgaatacatgcatgccagggagtacacgagccaatccactggcaagctgctggaagaaaaaaacttgtttatactgaaaattatctttaggaaaaagtaatgcattaaattttgctataatatttaacatacaggttaacactagtgcccttacttggattatcagagcattatgttacatatatataacataaacggaggtgctctatacagagggcttgacggtgacatcctcctttgttcatttgattttttcgtatgggtatgcattgcagttcatggctggttaagcagatttgcatatcgataacattaggtagttttacttaaactagccctcacaaaatggatttgtggctctatattactgcaaagaaacctgaagttgaaaaacctgaagataatactaaaaatgtaagtataaacaaacaagaaaatagtcaagctgatgcctcccatgcacacacttcaacattccttttgcaagagaaaaaaaaaaaattacaaaattagatctgacagtaatatgtcacctagcatttctgtttgaaaaaataaccattgatccccataagggtaaagatgatgctttcaaatgaaacgttcaatatgtagagggcatactggaaatcaacatgactcttgtatctgcatatgcgagttggaaaaaataatttttaaaatatatcaactgtatgtaccactaaaaaaaaggatgccaattaaatgacaccctgaattacatgatgcatccatatatcagaaatgctaaaacatttttaaagtacattttaaaattgataaagtataataaatattgcatacataaaataggagcatttgggtgaaatttttgctgttaggcatgtctaaaaaataaggagtccattggttctctatggtctcaaaacatttgctataccctaccctttttatgaaaggtttgtaaaatgtgtcaaaaaaataaaaataaacaacaggtagcaaaacggggaggtgaattgagaaactgtgctgctccaatcccaaaagagatccaaagatctgctcagacatgaaaagttaggttctagccagaagtaaaattctaggccagaagaaagtaagaatcaagaataaagtaagatcagattccaagattgggaattaaacttaagcagtcactgaagatgctttcactcagctaaaataaggttagcagcatcaagtaagtatactttctcacataaacacactagttaaaaaatacctacattaaaatctagctcaatctaagctaataggctttcttgggttgggcacggtggttcacatctgtaacaccagcactttgggaggctgagcagggtggatcacctaaggtcaggagttcgagaccagcctggccaacacggtgaaaccctgtctctactaaaaatatatatatataataaattagtccagcatggtggtgcacacctgtaatcccagctacttgggaggcggaggttgcagtgagccgagatcacaccactgcactccagcctgggtgacagagagactccgtctcaaaaacaaaaaaagctgtgttcaaaaaagcattttggcaactattaggaataacagccacgtatttagtttttggtaagtccttgttcctgtttaaaaactgggaaaataaggtacagttaacaactaatgaggctgttcataaaaccactacaaatatatacaacttggtatttcagacgggcttatctttgtcctagaacataagaatcatacacaatacatttaaatggctaaagaaaaataaagtcttaaaatattacaaaataattgagaaaatttataaatatatggaagttttctgttcccaaaattaaagcacttaacttctagtccaacttttcagtacattattcctaaaatgagacagaatgctcagtattaatgagaatgctttagaaaagcttcagaaatgtcatagcaaggccatatatatgtaatttcttatggtcaggaggcaatctctgcctctacaaaagcaatgtaatcaactggtagaaaatgctaaactacatgaaacatagtccaaatctttcatcccaaaatctttcagagaaatatataactaaaaactatagttcatttcagaactctaaactttaatactaaaaactattttcaaaacgagtatcaataaagcaaataagtttcattcactagacattaacagtgtagaaaggcatacaacagtttctgatcttacattaactctctttaaaggaacttaaaatcctatcaacgactttaattaatttagcactacctaatgaagtctttaaacaatttacagcaggagaaaaaaaacaaaagtaggggtagagttacttttctgaggtagattctcagatcagacagaggttaagaaaagcatgaaataaaactagatacagtactaaagtctggttccctgattgagagaatcttctattctgaggggcgagaacactgttaacaccagttcagacgccctgagcagacagagtaccctggtcaagacttggccactgttcagtgtaaggaatcccagaaaacccttcagtcctaggcaacctatgacacacaacccctagttttaaaactgaaacgtcaggcaaacccagacaactggtcaccctagcttaataagtggtaaagagcaattcaaacatttattaagcacttatgtatcaatccttatgcaataaagtcagctccactggattagataatctctaatttctgctaggtttatatttttaagtatctcactgaaactggccaaatgcattgatgcattttcttctgactcatcttacatggctgcctggaagcatgagactggtgatcactactgccttcagactcctctctaccagaacacttcattgtcctgcttttactcctaccaccctggctgctccttctcagtgtctttggacggcacatcttcctctgcctgaagagaaaatgttagtgtcccagggcttagtcctctactgtcttctctattctctcggtgtgatccatgacctttaaacaccatttataaccaagtaattctcaaattcctatctctcacccagcaacctccctactgagctccagcatttatacccaacttcatattcaacatctcacctgaatttctcaaaaggatctcaaatttcacatggccaaaaagaactcttgattccatttattttccttacactctctccccaccgccctctgcccactaaccttccccatctcaggaaatggcatcactatcgattataatcacagaagccaaaatcaagatgtcatttttgactcctctttcccttaattgacaactccaaaccatcagtaaatccttaagatttctcatgtatataccaaatccattttcttctctccaaatccaatctaaccattctaactcaagccatcatctctcacctaataactgcaatggcctattagctgtcttccctactgctgttcttgccccactcctctacaatttcttcttccacagaatagccaagactgattgtaaacacctaggacaaggaatatctgttccatgtccccaatacatgggaacagtatctgcctcatagtaggcactcaatgtgctcaggagtgaaagaatgaagtcactccccggcatcttctgacatgcagaatagaatccagactccctacaacccctaacattattatcaggccttcctcacctcacagtcctgctcactaagctccagactcactggagttcttcaaacttctcgaactcatttccgccttggagattttttgttccctccacctgaacacttctcccttcacgtctggcttcttctcatcattcaggtaacaatgttacctcctcagaggcctccctgaccagctactcaaggagctctgcccatcctctgccacctcaccaatcttcttttcctcttagtacttaacactagctgcatcatctcactatctgtttacttactgatcctcccctctaaaatgcaagccactaccaggcagcatggtggttcatgcctgtcatcccaatacttggaaggcccaggcaggagatcacttgagcctaaaagttcaagaccagcctgggtaacagtgagacctcatctctacagaaaatacaaaaattagccagcagtcagtgcacatgcctgtattcccagctgagcctgagaggctgaagtgagaggactgcttgatcctggcaggtcaaggctgcagagacctatgattgcacaaccgcactccagcctgactgacagagtgagacactgtctcaaaaacaaaacaaaacaaacaaacaaacaaaacctaaaaaatgtttttaaaagtaaaatacaagcctccgtagagcaagaaccttatctttcttgttcaatgatgtatccccagaggcttatacaatgtctagcacaccatatttattgaaagaataattcacaaacatttctaatgccaaggtaacaagcactatgctaggtaaccattttttttttaattaaagaaaaacagaaatcaaaatattggtatgaaaagtaatttggggccaggcgtggtggctcacgccttaatcccagcactttgggaggccgaggctggcagatcacgaggtcaggaattcaacaccagcctggccaatactgtgaaatcctgtctctactaaaaatacgaaaattagccaggcatggtggcacacgcccgtagtcccagctactcgggaggctgaggcagaagaatcacttgaacccatgaggcggaggttgcagtgagccgagattgcgccattgcactccagcctgggcaacagaacaagattctgtctaaaaaaaaagaaaagaaaagtaatttgatgttatttttatgttgatcatgcccatccttaaatgaccctatacaataaattgctcttcttagaatattactttgccagtgtaaaatatgaaaatcctgatagtaataataataatgaataacatgttattgcttaaaaattggctgggtgcagtggctcatgtctgtaatcccagcactctcggaggccaaggcaggcggatcacttgaggtcaggagttcaagaccaacctggtcaacatggtgaaaccccgactctacaaaaatacaaaacattagccaggtatggtggtttacgcctctaatcccagatactcgggaggctgaggtaggagaatcgcttgaaccccggagacggaggttgctgtgagccgagatcgcactccagcctgggtgacagaatgagactctgtctcaaaaaaaataaaaaatgatattgcttaaaaagtgtctgatgatcacgttcttcactttcttaatgcaaaatttatgtaattaggctataactcaggaaaatactatccagaagactttatgtcttcatcatcttttcagagtataaaaatacacatttcatccagtctgaaaaatcatgactctctcaaccctttctgttcacacacataaatattacaacatgacaatagaggttatcaactcaccatttattgcttggcctcagattaatttaccagcttcattcaagccaggaagtgatcaaattccaattattaatcaagttcatttcaccaaagtcatcactaaagttaagattcaccccttaccccccaatacctattatgaaagaacatgttcagttgggtttaggccagagttatgtttcattgttaccacagtattcctagaagtccatctaattcagaaccacagcagaaaacaatattattagttgtaaccataccagttattaccactatcattatgacatcactaaacaccttatggcaagcatcaattaagaggtaaatgtaaagctcaaagcaatgaacaaatgacattttttcagctcaagtgtttcctgtaacattttattttcgcacactataaaagtataatactctacctcaaaatgttttaagagttgaatatatgttttcgcttttgttttttaaagagacagagcctcactctgttgcccgggctggagtgcaacgacatgatctcagcccactgcaacctcagcctcccgggttcaggcaattctcctgccttcagcctcctgagtagctgggattacaggcgcacgccaccacgcccggctaatttttgtatttttagtagagactgggtttcaccgcgttggccaggctggtttgtaactcctgacctcaagtgatccgcccacctcggcctcccaaagtgctgggattataggcatgagccactgcgcctggcttatgttagtattttaaaaaaattatttacgaaaaggaacatacttagcacaactaggtattaggaagtactcaaagtatcactttatcatgcttgatttcaaaagcctacgggaaatatgtctatccttcatccaacttgaaaccagtatacattctgaacaatagggtaatctcaaatgcaatcaaccaaatgcataaaaagataccaattgttctattttaaattagccttctaaccacacttgccaatacaaaaaagagaggcttttatttgatatttgtaaggaaacttaagaaaacactcattttagctgggcgcggttactcatgcctgtaatcccagcactttgggaggctgaggccggtggatcacttgaggccaggagttcgcgaccagcatggccaacatggtgagaccttgtctctactaaaaatacaaaaattagctgggtgtggtggcacatgccggtaatcccagccatttgggagactgaggcacgagaaccgcttggaaccgggaggcggaagttgcagtgatccaagatcgcaccactgcactccaggctgggcaacagagggaaactctgtctcaaaaaataaataaataaatactcattttatttttggtttataacagttactccaaaaagctgaaaaatgggaaaagccaaattaaactgaatcctaaagcgaaggctaaaagttcagtatttttcaaactacacttattattcctattttttactgccatttctttaaaaaaaaatttcttctgatttttagaaagtggttctataagccgggcgcggtggctcacgcctgtaatcccagcactttgggaggccgaggcaggaggatcacgaggtcaggagatcgagaccaccctgggtaacacggtgaaaccccgtctctactaaaaatacaaaaaaataacccgggtgtggtggcgggagcctgtagtcccagctactcgggaggctgaggcaggagaatggcgtgaacctgggaggcggagcttgcagtgagccgagatcgcgccactacactccagcctgggcgacagagaaagactgtctcaaaaaaaaaaaaaaaaaaactaaagtggttctatagtacctttggcttttcctttagtctagttatatatttgtataaacaaataaaccagtttcaggacagcttgaattaatccacatattaagataaactcattttaataccagaaattatttacttatccctgccttcacactttgttttcagacaagtccaattttagggctggaataattgctcaaattattcaaaagatatactgaacaatatttcaaaaataaaaatttccttccaattatcaggaaaaaaggtccctacatgaatcaactcagaggtcattatcttgaccttcaccatctgctcacttgcacaagaagcaacacaagtttttcatctaaggtagaactttttaaaacttaaaattatctaagataattttaaatatttatatttgctcaaaaagggaagaaacacaataaataattacattactatttcagcatgtaactgaaaaaaaactttacaaaggcatgtcctgacttgtcaatagtttattactgacaaattgagataaaatacatactttggtacagctatactgtccaaatttcttcaattagggtagtaattacaaagtatcctcttccactattattctatgccatagcaaatgtctctctagaggctgcaacataacaaagtccttcgttacctaactttaaatactaaaatgttctcttcttcctagaaaacaatgaaaaatagacaccatgcctcagtgatatacctccaaacaagctgctattatcacgaataaattttaataggttagattgcaaagacattacagatggcttttgacattttcagataaactgaaaccactccctccagcccctagggataatgaagtagcttctcaatcactgaagttacttagatgacaggatttgtgaataatctgtaaactcgggaaacctctgaactgtctccttaggacaaataacatacaatttagaaaaaaaaaatccctacttaatactgctttttactaaattcatgcctacattaaatttcaggatcaaacttaagtgaatgattcaaatcattcattaacatacattaagtgtttcaggaccaaacttaagtgaatgattcaaatctaactctggctttttaaaatgtacatatgtctttttaaaaaccacacatcacaaatatctaaactatcaaagaattgcattattcgaaatttcaatagcctgatactagtgactcggtcagtgcctgattttttttaaatagcagaaaatattaccatcaaaagacccctttccaaatgctgcttctgcttttttgttttgtaaataacagctttggaaatgtatgcaaaaatatctctaagttacacaagtcgagctcaaacactttgtggagcaaggttacttaacaggagtcccagaaacagctaaaattgtagggaaaattttgcgtatgtatatatggcattgttttttctgcgcagaatgtccatataactcagtttctcaaaaggcctcaaaactcaagattaaaagtgcctggaaagaccatcatctttagagaacatatcacaggcaacccaagacttattttttatcccaagttaggggaggatttatcctaattttgtggctcctacacaacttctgagcgacgcaagcatgaaatggctgtccgatacaaacagaccccttcagatacggaatgcagcaaacccctaattttccttgaaggggccacggaaagccaaacggattcgtaacccggttgctcaatggtccattggctactgcaggacgcgccctcctcttacgccgcaggggctgcggggcggcgaccaggttcctccgaggggctgaagttcccttgggggtggctgagagcggccgcatctctggcagcatcctccctcccgaaaacgcgccctaaaagtagcggctgcgggcgtgggcacagccaaccccagcctgcgcctaccagaagtcgggagggcgcggaactgcggcccctccgagacgcgcccgggccgccgccgcagcactgtcgcagcgaccttcccgcccgggtccccgcgagcaaacgggcaagccccgttatcacgcaggtcacacaccccacgagtaaaaggaaaaaaccgggcagacaataaagcccaacccgcgggggcccaagcgagctggaagttgggggcgctggggctgcagcccaaggaggagcggcggggacgacgggatgcggggctgatgcgcctgggacgcggcaagccatatgtcagcccgggtgctgacagcggggaggacactgggcacgcggcggcgtcggggaggcggccggggtaagacaggcctgaggcgggaggggagcggcggcgaggtcccgaggcgccgcggtcggccgtgacccccaccccagccggggcgctgtcccgttccttaccggcagggaagctgcgggctccgccggggctatcccggccgctggcctccggagccaggaagcgcccccacatcgcgggcgagagggccgggtgggccagggacgcccgactcctcacgtccgtcctcctgcttcttcggcggcggaaacttgcgcggagcgtgggcctcggcgacacgggcaggaggaaaggcgggatggctggttaacggctgctcagctacgggcggggagcgcaggggccagattcgccgcactgccggcgcctgccatggccaagccggctgggctgaggcccgcgccggggaagcggcgactcggcggtgacggctgctagatccccggctgagcccaggctcaaaggctccaggcgaagttgcagctgcgggttctctccgccccctccgccggcagagccagagccggggctggggccgcgagggggcggggcctcgggcaatgacttcaggcgtgcgcggcgccgcgcggggcggggactgcggggggcggggactgcggggggcgggtgagctaccccgaccccgcttcgcctccttggcggcgactgggctgtcccgccctcccgccgcatccctctgtctccatcctcccgccctgcgagttgagtagagggcagcgacttggcctattttgcgatactcgcccctcccttgggtaatccctcacgccctccctccgggcacctctgtgaagacacgtggaagacctgcccctggcgtcacaaccgctcgagatgaaaaagccaagccagggcgcggctgagggggcttccagcctcccttggaattaggattgggatttaaatcctcatctgtattccttcgtttatagattactttaggggcagaaaaggggtggttttcctttactaatttaatgggggcgtgggggcaacacaggcaccagaatatagcaccgggatgtgcaccggaaaaggcccgggggtaattagtacccgagggggagaggggccgtcattgtaatcgcacaacgtttcagattagcaagcagaaagtaaaaatggcaccaaagtctgtaaagggagccctttcctccttgccccctactccttcacgttcttcctcttcttggccagtttccacccttcacctgaacccttagtgcaggaggagacgtcctaaggaagggcgaaaagggacagcatcgttttatttttaaatcttacttctcactggcaatatggtgatgcttccaacgtttagttacgaactagttcgtataaaaaattctgggccagcactgtggtgggaggcgggctctgcagtaggcccatcactcagaggtaagtcggaacgcaggtcgcttaactagagaggctttgagttccgcttttcctgttctggaatcttgctaacaaaggcctcatatttgcatttttcccttaaagacattttaattgggaaatactacttaaaattcttggaagttaaattagatttaggtgtgtgttctatcacttaccacatccgtgttgtaatttatctgattggagttttacatttagtctccctgtggtagacttccaattatttctccaaatcatgtaatgttagccaagggtcagctgtttctgatgataaaaagatacagaaacatgaaagacgaatgtgattggttcctttttattattttaatgtgcactagctcgttttatctaacacttgaagaggatagatttttttaagtcccaaaaagaaaattagcagaagctatagcactatgtatagatttttttttcatgctttgtagttaccacagtctcaggaacagaatttttgaaattcatttgtgatgcagttctaagaagtgtataaaatattacagaaatatcttggcctttgcgagtttaaaatacacttattatttcaaaactgccaatttcctaattctaaacagtgtttaaagaaaatcgtttactcgggttttctacatctttttatcaatataaagggcatgctactacacacaaaaaaagtacatgcgaaggtgaaagtatctaaaatatttcaatatctattacagagtaaaagcaaacagtaaaaacatgttgctcttttggcacttggcaccaaatatgaaatttttgtgtccctagtaattaaacttgggaggatagagggctaatgcaattagaactaattgaaatactaagtgagaatattatgttgctaaagtatccatttcttttaatcatatgaattctgagtatatactgaactaatgcttccccccaaatccatgatacatggatgatatgtacatggtatgatacagccatggttttcagaatgattaaaatttatcataacacaagttggagaacctaaggactatctaaccattactaaaccccatgtggtaaactgccatatttttgttttgttgtgacagtgtgttaggactacaaggagaattttaaaagcaaagacagttatcgttgaacctcaataaacctcaatcttggcagttgttctgtgcagatataagtaatgaaaatagtgactctgtgtatgtgtgtgtgtgtgtgtgtgtgtgtgtataagtatcattgctcagatgaaattaggatatttaatgttttgggaggggactttttaagaatataaactagatcacaaaagaagaaaatagtactaaaaatgccacatttaataccaaactatattaaactatttgtttaaaatgtctcatttcaaaaaaagacattatttaaaactgaaaaataagtgttgcatttataattcttaaatttgtatataaatctttgaactgattaagttgagctatcttacatgtgtttttctgattcaaatttatcagattgtgcaaacatcatctacagaactgaagagggatatgacaatgaataaaagtgatatttttaaattagaagagccaggtgcagtcactcatgcctgtaatccagtgctttgagagaccaaggcaggagaatcacttaagcccaggagttggaggctgtagtgagctgtaatgattgtgccaccgcactcaagcctgggcaacagagcaaaaccctgcctctaaaaaataaataaaatgagaaggaaaccccatgcataatatgaggaaagctcaagagagctttatatttacaaaaatataaaatatataaatagcaaaagaacccaacaatatgtaggaaaagtaaaccaaccaataacaattgaaatagttcctaaagaactattgctactacatagaaagagatttatgaatgaattctaaaagattccaaggactagacaattcttgtatatcaagtgtgtatcaaggaccatgctatacaacctcttccagatcacaaaggtgacaagttatccaattatttgtggattgttgtaatcccaaaaatcatttataatttaaaaaaacactctttcttttgaagatggatttgactatcttaattggatccctggcaggtagaattcaaataggtgaatggaaaacaaataggttacttaacctgtgcctcaattcccttacctgtaaattggggattataatgataactgcctcacaggattgctgtggggtttaaacatgttaatctttgtaaaatagttagaacagtgtatgtgtacatcctatattggtaatacagacaaacatacaatttagaaatgtaactgttatagctcaccaagaaaaaataacattcattggtataggccaggtcagttgtagatgataatttatatacatgtatcagaataaagtagtgactgggatcttttcctgaccctttggggttactaattagtccaggaattatggtgaaatagtacactcttaacaaatatataccaaatttttgggagccaagttcatagaaaccttcattctaggctgtgatttcctacccagtgctaccaaaataaaggaaggaaaattagggagaggtagctaggtggtatggcgaggccaagacaaggacaccttatctcaagtccctgattcctgggaggtacagaaaatgaatctcacctgtacctttgactccagagttgggttgcaataaccaataagaaagaaggtatgatatggaccactgaagcagtccttgggataggaagtgggtgtgggagggatagaattctgccaacagatgaagtcttccaaaggaccatcaatgttttcaggaactgcttaggactgacatctttgtcaatggaacttattatggtaaccacctggtcatcctgagcgtatgaaaagagacaagatcatttacttgtttgggacagcaacctggacagtgcataagaagacaaattcttccctccctgcctgctttttcagacactggaacagtaaatagaaggttggaagtgtggattcaagaaagcagatcatgccttcacacacaaacccacacacagcctcctacctgacctgccctggtggggaagaggactgttgaaagctgaaaatgttcaaaatgttggggaattggattgagatgtactcagtggaaaaggggattttcaacagtgtacagctggcagtgttattgggggagaaaaaactttgagtatatacttccaatgatttgagacttctcactaaaccagttacctattttatgttgagtagttagtaatacctccattttacagatggggaaaaaagaccaaagagaagttagggaaggtcacacaggaagtaaagagctagaattcaaatctgatccatgtgactccaaagcccatgccttttccgccatgctcttcaacatgctgtgaaataaaaattagaagatttcttttcagatgccatatgagaaggaaatacctaactataggatttctgtatagtgttagggttcagctaagactggaaaccatgtgacattaatctgcggtggtatatggttttctttagctgtagccagcagtttgagtgtaggaagaaagaaggcagatagataaacagggttttgcagtgtgggcactcaaacaggaaaaaggggcaaagaatgtaaggatattggcagaagaatagatgaagtgatgggaaactgggtgtagcctatctggaaaaagcagttaaatcaaggcaaagctgaaatgtggagagaaggtcatgggaataaaggagtggaacttttacaattgaaaagcaaatataatgagagtaagggagtaaaagttggaaagatacgatgttagggtgggagaggaggatgctgaagtttgagactgcagagatgagacagtggaggaattgatctgtgaggtgaccttggagtgtgtctctctgatctcccttcaagaaagaccttgatattcagccatgaggaatgtagttggctgacagcctccaacttttagtgcctgtaggacctgcctcagcctttttatttaattttattttttattgatacataatagatgtacatattttgggcatatatgtgataatttaatacattcatataatttgtaaagatcaaatcagtgttattgggatgtccatcatcttaaaaattttctttatgctagaaacattcaaattattttcttctagctattttaaaatataacaatagattattgtaaaccacagtcgccctactccatgcttttcccagatatccccagccagtgacaaagctcagccgagatacttgggcctggccattctttgcaatgcagagcccttctaatcatcagtccttgttctctagcttgctgttgagttgactgggaacttgtcagatgtgcattgtggtctgagcctttcctttccagtcctgcttcctgtgcctttcatctttcacaggtgttaccttccaataagcctcttacacccctagttccattttagcatccgctttccagaaaagccaactgacacattctgtgaggaagatgaagattgggggttttgttttaaaaaggaaaacaggaggtctacacagcatgatgaaaatgtttcccagagaggacagtatactgaggatgagttaccaggaaggcagcatgtagcagcatagactgagactatacaggagtataaatgagtaaatgtcttaagttctgaacagcagagaaaggcagaattgagagaactgggcctggcacagtggctcacgcctgtaacctcagcactttgggaggctgaggctggcagaacacttgaagtcaggagttccagatcagcatggccaacatggtgaaaccccctctctactaaaaaaatacaaaaattagctgggcatggtggcacatgcctgtagtctctgctactctggaggctgaggcatgagaactgcttgaacccaggaggcagaggttgcagccaagatcacaccactgcactccagcctgagcgacagagtgagactgtctccaaaacagaaagacagacacgacagtttcaagttggactcagaataccacttgggcacatggaactctggaggagaaggtcctcaatgcttctgactggactgggccagggagctactgccccccaattaaaaaagtttgccactattcagagtacttccaggagcaaattacaaacttgtgaaacttactgagttaactgatgtcaataggattttaattcattaattaagaataattagttacaacttcactactcaaataattttaaatcattaagacagttttcatagtagcttccttacttctgggtactagaagagaattcaattcaatatactctgttcccgttggtaaggtttttttattccaaagaattttcagcgtattgcttacccagtggaagaatgtagggatctctggaactgtaaatagagttaacatcacttaaacaatccctagaggaatctgagctaatttaaggagtggacctttttgctaagatttcagtggaggtctggaattttaacaagttattataataaactcagaaaaacagacaagtctaactacaattttcaggtttatgggagaactaatttctttatggctttttttctggtcataaaaataatacatataaaaaacaaaaagatgatttagagatattattattcatctggcaattatttgttgagtaccaaagtaggggagaaaaactaaaaccagacacaagtgtgaaggatcggttacttcactataacatttcaagctttttaattttctattgtgtaaccagtataaaatagctatatgggaaggcttctttgttcttttgtttttaacacaatagagttactttgtcctgccgtccttataatctctcatgtatgggtcactcttaattattttattttgttcaacagtatcctgattgcagaagtctcttagcctgacataaattcaagctgtaaaatctagaacctgtatttttaaaaataaataaacttttaaaagaccactttaaaatggaatacaataattacgaaattatgattgtaaatatatgttaaatataaaagtggaaaaagcaacatttaaatcagtatatttaataagtgttataagtaaattaataaatattttaagttgacatttaactattttgcttatatctcaaaagtttaacacatcaggttgtcccaaacacacttttgaaaatgtgctttagaaaaacgggaaaatcatattatatttggacatatctagaccaaattaaaattggtcttttttcctctactttgcggcataaacaaggtatttcttaaacagccctaatattttgtagtgttattttgggggaatctatttttaacatactacctaaaactgaactcagaaaaaaatcttacagactttttttacaagcaagacttaaaagtttttaaaaccctagtagaataaccaatctctactttcattatagtaattgacactagttttttaatgttctatgcaccttgaatcaccagttactacaatgaaaacacaaagagccacctgaatatcaaatacatgcattattacaagtgctcacacggaatatgagatgaattactgatgaacaaagcatctaaaatcaacttatactcctcatgcatatgctgtggatgatgacaaaagaaattatgaaaagatatatatatgatatacatgaatctatattctctaattgagacattatacaaatctttataatagactttatattaattaattaggtacttttttccattacagtaatctcctaatgaagttatggagcaaacttcagctttagcaaagttgggcaagttatttatactgcgaaagatagctgaaggataactgttttcaactgagaccaaaagacatagtagttagcatttattttcataatcttaaaaaggcatacaatttcggtaggaggcagtagttatagtgacactaagggagatggtagattgggagcattcaatcagcattcggggagaatagagagaaaaggcaatatcaagagaattcgtcaccacagttgtctggatgctgttgccttctttgctcacccttgaaggtcagtctggttctggcccaggcccaagatctaagtttcagatcacggcaggcttaggagaacagtgcagactggaacatctaatcccaccccagcttgccctaagatggcccctgaatttgttcagctcctgggcctgccgccgtcctaacttgcctgaaactgttttccaaaaaattagagcatagatgagcaatgccacgttagcttcagttttgattttgggtgttaccacataatttttttaaaagaatttttatcttcccacataccaacttttagaacagatggcttaaaatgtcttagaggaaattagttgtaatcagcagatgagagtgtgtctccttgttttcgtggcagaggtagctatcaccccttaagtacctatctgctacatgtgaactggcaccaggcattgtagtttttctgttgcattttcatccagagggttatgatgggcttcgttaaaatgatttggtacacatgtgggcatttgcctgcaagtataacctctgtgaagaggtaaactgtataggcttcaaggtggctttctgctgaggtggctgccagcctccctggagaaggtgtcagctgaagacctcaagtaagagccacagtgaagctcatatgccttgatctcttttctgatcctggcaaaaggccagctgtggagtactgctgcagtcaggagctgggggagttggcagattgccagataaggggccatactgtcatttataaggcaatggcttttatagatctctagtaacccatactcctacttacttgaacactatgatttctgggagaaaaaagagccagataactttcccattggaataaaaccaaaacaaacactgtatttaggttcacaggatctatattgaatgtcttttcaaagtacttcatacttatttcagtcaatatcctttgcctgatcctgtgtccacaacacacatgcctcctgagtcttaagatgctccttgctcctctagacacctttgaagatactctcattccactacgcctggggccatgtaatgtctgtaattgcctcattaactctcaccttgagttctctgaatctggttttctcaaacatatttgaggataaggagactgtcacttaatgtgaaaggtgtcagaattttctttttttcttttttttttctttttttgagacggagtctcgcactgtcgcctggactggagtacaatggcatgatctcggctcactgcaatctcggcctcctgggttcaggcaattctcctgcctcagcctccccagtagctgggattacaggcacccgccaccacgcccaggtaattttttgtatttttagtagagatagggtttcactgtgttggccaggctggtctcaaactcctgacctcattatctgcccacctcagcctcccaaagtgctgggattacaggtgtgagccaccgcgcccagccaaggtgtcagaattttcaaaggaaaaatggaatattgataaactgagtaaaatatgattaccatataatgtcatcttaagatgttcttgtagtttcaaacttgtataaacaaaattggtatttatacatgtgtcctattaatgcacacgagagtagattagaacctatatccagagtattttttcttgtgccttgaaaaaccaacttaaaaataaggtatttcaaaatttggtttctaaatacgtttcaataaggtttgttattattctttttcttttaaaattacatttttataaataataaaattttaattgtgctccagttaactattaataaatattcagaatccttaagggtttattttagttaaaatgtttaggactaatgcattagtaaattgaaatttggatacaggaattgcctggatctttgttttacaaaaaaaatcagaaaaaagtaataccaaccctataaaatcctaaatctctaataatgtaaatatattattagtggtaatgttatttgttgagtttaagagtatatttaattttatagaacaataaaatattttgatatagaatattcagggaaaaaatagagaaggaagacaattgtaagtcggagagaaactgggatctgtctataatgactgtgttaaagaatagcactaaagccacctcataaaccaatgacgttgtatcacgaaatgacttttaagttgatggagctgcagcaaataagttcaaagcaagaggtgccagcaccagagacttgggttttgatacagctctgctccctactggcttatcattgggatcaaataggatcattgcagtactatctcataaagccattgtgaggaataaataggatcatgttggaaaagtgcttcacaagttttaggtaatctaatcttgctaagaaaaggggcgaataattcacaagaaaaaccagagtaatgataaaaggtattattgcatgctaagtgagcactgtgccaagaatttcacatgcagcttcccatttcatcttcataacaacatgataaagaatagtatgaattggccgggtgcggtggctcactcctgtaatcccaacaccttgggaggccaaggtgggcagatcacttgaggtcaggagttcgagaccagcctggccaacatggtgaaactccgtctctactgaaaatacaaaaattagctgggtgtggaggcgcatggctgtaatcccagatactcgggaggctgaggcaggagaatcgcttgaacccaggaggcggaggttgcaatgagccgagatcgcgccactgcattccaggctgggtgacatgagggaaaccgcatctcaaaagaaaaaaaaaaaaaagaatagtatgagttattattatctccatttcatagatgaggcaaatgagtcatagagaggtgccaggagacatagttaattagtggcagagtaggaattcaaagacagttccacctgactctagaatctgagcactttaatattagctatagtatattaaaaagttcaacttcattagtaagtaaagatttaacaattaaaacatatggacatgggagtgcaaaggaatgataaacatcaaattccagttgtctctgtagagggagggaggaaggcattggaatggatttgggaaagtggtgcatgacgatttcagttatatatgtagtattgactctcatgtattcatcctgatatagtggaaagagcataagtattgagttagtcaagccaggcttttaatgaaaatgtggaaatttgttaagacttgacaaaccagaaccaggggttatatattttttctgcatacttttttgaatgcttaaaataattttcatggtaaaaaaaaaaagcagtgaactaaagtcatcctacttcatttatacaaagattaaataattaagaaaataattttggtgaaggtttggagaaaccgatatacacttctaatagtataaatgggaccaactcttttggaaagcaacttggcaatatgtgccataaaaacaatctggctctttggttcagtaagtttccttttgggacattatcctaagggaaaaaaatcaaaatgtacatgtgcatacagaaacatacacactggaaaaactgtatgcatgaaaatgtcaactgcagtgttgtttataacgatggaatatgataaacaatctaaaattttaacaatagaaaagtagtcaatattttgcagcctttaaagaaatatttatgatggctatgtagcaatttgagtaatgattgtgatgtaatgttaattgaaaaaaggatatgaagttgcatatccaccaggattaaatcaatgaaaaaataatcatagaaaaagatttaggaagaaacagcctaaagtaatgagtacagaatttgtgtcaaaatgatgagatgcattctttcctttttctcttccagatttttgatatagatttgacatattgtttttgaaatggaaaactacagttgtccattggtacccaagagggattggttccaggatccccaaagataccaaaatttgaggatgctcaagtctcttatatagaagggcatagtatttgcatataacctgtgcacatcctccagtatatttaaataatgtccagggtacttacaatacctaacacaatgtaagtgctatgtaaatagctgttatgttgttttttttattgttgtactattattttttattcttgggaagtttttcctttttttttttttttctgagacagaatcttgctttgtcacccaggctggagtgttgaccttctgggctcaagtgatcctcctgcctcagcctcccgaatagctgagattacaggaacgcaccactatgcctgcctaatttttgcattttttgtagagattaggtcttgccatgttgcccaggctggtctcaaacgcctgagctcaagcagtcctcccacctcagcctcccaaagtcctgagatcatggtataagccactgcacctggcctttttccaaacagttataatcagccactggttgaattcacagttggttgaattcatggttggttgaatctgcagatgtgaaaccaatggatactaatagccacctatattacatagtacaaacctagctttgaaaatagtgagacagatatgaaaataaactagaattcacgggagaaaatgaggggttctaagaaaggtgtagacaatacattaccaatacaggaggtcagaggaaggggagatctgtcaggctggggtcttcaggaatgcttcacgaaggagggactatcagtggacttcagtaatttgtagagccgggtaagagctggggatgaaaggagggctaagcaggaggcatgcaagttgcaaagtggagcaatgggagatgttctcaggaaacagcactgtgtgtcacggaatattttactttcagtttttctgggttttcagaaaatgtggtaactttaaagttttcacagttgaattaattccacagaacaactggttgtagaatcatagcaacataattatgagttgtgcttctggctccaaatctttcatctaaaaataatcgcagtgaccacatcttgggaaaacaaagccattacctattcttgtgctccagctatctcggtagtcacttactggaaaatggattacaggtaaaataactgcatgtttttaggacactacttgtctctcttaccttcagtgagttgattaacgaaataatttaaaaacttatattctccaggcattctctaaggcatgaacatgattttgaagaaatcctttaccatcacacatcacacaagcctgcctgtgctcctccagaaacgtagccctagtactcctggaagcccattttgttccttcagggagtatgctttctttgtgcagagaggagaaaaatgctggagacagagatgtggggagtaagaggagggacggtaggtaagtctcagccacaggtaagatgagtgggaacctgtatgctccactgcccccatgtgtaccagctgttctttgcccagcttccttgggctagaaacatattcagtgagtaatacatgaatcaacaagatgataggtgtgtcatttatcaaatgattacttgtgctagaagtttacaaccattcaattttatttattttattttattttattattttattttattttagatagggttttgctggatgcgcaggctggattgcagtggctcaatctcagttcactgcagcctcaacttcccaggctcagatgattctcctacctcagcctcccaagtagctgggactacaggtgtgtgccaccacgcctggctactttttgtgttttttatagagatggggttttgccacgttgcccacgctggtctcaaatgcctgggctcaagcaatcctccctcctaggcctcccaaagtgctggaattacaggtgtgagccattgcgccgggccacatcccttaactttaatgatcataagaatcctgcccagcttataattcaaatgccagggtactcaggttcttcaacagactctagttttcttatcctctaagattagtgtaaaataaaagtgcctgattgccatctcacacactggtgagaaattctctgttcctctccacatctccaggtttcccttccttgcctcacattctgttttcctacacaggccaaattctccatgtctcctttacatccccctggtgtttgtgttcccttttgctatatagccttgccgaatacttggcgcatcaccccaatttcttcactccccaaagttatcacccacatatgattgcttggttaacaaacatttatttaacttttggtaaaaggtaaggaatgttccactctggtgccaagtaacaacttaatattggatattaaaactgtatccccaaatagagccccagattcctggctactttgctggacttctctctttcctagggttggtgctttcatctcaaactccaggatgctcaaaattattgttttattatgcaaagcattttagttctctgcctggggcttcctccttcatatccaaagcggacctatacaggtgttttcctaaacttaagagtcctagaaatcagaaagctatagtctgctacaattttaaatagcatttacacaagatgaaaaaacaagtttagtgaaattaaatgactgcccccaaaaaagggtcagagcctgaattaaaagcctggcttgactaactcaatacttatgctctttccactataccaggatgaatacatgagagtcaatacctattgaatgtttacaacatgtctggctctgttctaagagcttcaggggcattagctcattcaatcctcacattagttaataccccactttatagaaacagagataactacccatagtggcagctaacacatggaaaggtcaggattagagcccaggtagtcagtgtctgtgcttctcatcattaactgctactctctaccagcctcaagatccagctccctgacattctttcagtggctgaaaataagggcagcttattatcacatttgggattaagttaaaaaaaaaaaaggaaacaggggcagctactgtgtgagagttcagtctgctccctgaaaatgaccccagcatggtttggaaactcaaaatttctaaaaaccctgagagtacatgggcattgttggggtctgaaggtatagactagatttgctcagtgacaaacttaattataaactttataatggctgctttcaaaaccaatcaggtaattcagtcttttcttgcttaattagttgccacaaattcactcaatccatttagtcagtcagtcattcaagacttattgagtgtcctctatatgtcaggtactgttaggcaccaagtgaagaaagagggatccttcgggtccagactcagtcctggagtggctccaaatgttagaattatgattagtgtttcttcctatactatacgggatggtgctgagattctagatttcgtggcccagttctttagagaaaaaaattactaacatgaagaagggcattaaattgggtcaccattgcttgagggaactattccttaagaatatagaacttgctttgattttttttacactctaagtgctgctctaaggtttgatttcctgagtggacaagactatcaaggcaagaagtcccatgtaggtgacaactagcaatatttgggcagaaacatatctcactttaataaatgggcatcttaatgtaaagctggatcttagacatgaactaaatcagtggttttcaaactgtgctcctagggcctcatttgcaataaatgaacattttaaactgcatgtgaaaactgcattttttggatatctgatttatatattggagttttgcaatttaatttcatttaggaagaagaaaaaagagcccttttgcaaaatgtgaacacctctgagattttcattcatttctctattcacaagggactaaggcctagagagatgaaatgactcactgaaatggcagagataaatcgtaaacctaggtcattactcccagcccagtccaatgcacagatctccccctttctatctactacccactgtgtgtctggagagcatggcacacaggccagtgtaaatctgggtgaactatgtctttgtagtactgcaaaagctgagaattcagttccaaatggttctgcaaaaatactgactgaggactatttactgtatatatgattaagtgctacataatctactatgttcctcataataatccatgagttgggctgagcaaatatctccccagccctctcctcaattttgcaaaaagcaaaacagtctcaaagccgttgacttctttaaagaaatgtattagtagataacaacaacaaaacaatccaaaattccaatcttctgacttttaggaagacagagctctaaccattatattatatactgttcaagccaactggtaagaatatgcagtgcttgtgcaggcaggagagcaatgatgtaattaaataggacagctcccaaagttgacaggcataaatgatgaaaggcaaagtttagatatcaacctatgagccatggacacctgcagagttttaaaattattacaaagggacctgaagtcccataaggtatgcttacctgaataaggtgggttgcactgatatatacacccagacttcaaatggatagagatgctcttttgtttaataaagtatgccttcaattaaaagcattactgaagccagatgtggtactgtgtgcctacagtccccactacttgctactcggaaggctgaggtgggaggatcacttgagcccaggggttcaagtccagcctgggcaaaaagcattactgaattcctagcaatgtgtttatccttatgtactttcagtcaacttttactaaaagtacaaacactattatgtgcaactctgtgaaattttgttgttaaaaatgaaatcatagttgaaaatgtggggactgtctgttcaaggctaaaataaagggaacagaacaaaattaagatgggaaataattattttaaaacatattttgtatgttttcctgtgtttctattttaaagctatatatctaaattattgctctttgttttcatgttgaatggctgcttcttatctggctttgtttattaagtgtggtcagatcatttattctcagaaaagctaccctgtagcctggccctacattcctccaagataatatcatctgcaggactcaagtttcttgccagagagctgatttgcagaagtaaacaaactgggagtaaaaccaagaaatgttaaagaaactttctgacttaagacattgataacaaaaactatgttagcaataagtgtctctaaaaatatatagaatatccagtcaagctgacctacagaattggaacagtaaacagaacacaaaaagggctgtaagcaataccatctaggaacacagaggtaacagatagggctccatgtctgtcagggactccaggaggaacagctgttcccttctctcaaaacaaaccatcctctgatgcgtttcagttgcttaccaactcagatctgcttttgaggagtaagccaaacacacagcctctggtgatttaccttatagagggcattagggaaacttaaaaaacaaatgtcaacttgaaaaggccacattttatatctttccttcatctctggcagtattccgttgttgttccaactacccacccccttgcccttccttacatttgattctttgttagatgaagcatggagacaatggaaagcaactgggaaacaaactaaacatttccttctggaaatattacctacttttaaataaccactagggtctataaatattttcattagaaatttgccctccctccacacacaccagtcactttgtgaaaaaccaatttctccaagtcagaacctagaatttatggtctcctctcattgcactactaaaacctttcatatccacagtgaatctaggctattacctctggagactggagttcagggcctcactcatatatttatctcatgaactaaacccctgtaattccctgtggagttggggtttggaggcagatgatagagaggaaagttagagttacaaccatttggttcaatgtggtagagcgctgaattgactgtgtgatcttaggcaagtcccataagctctctgggccccagataactcatgtgtaagaggaaaggatcatactagatgacctccaactttgtatcttcgaggtactgaatgggaaccaaagagtaaagggaagtcgcaaatagaattatggatgtggtaactgaattattcccaattcttccctctctccctgcgatagaattacaaagcatttgtcaagtggcttggcagtaccttctatcagaacgggcagaatatatgtagcatttccccacctacttcatatggggcttgcccgtgtgacttgctttgactgaagttagtagatgtgatgcaagcagaggcttttttttttttttaacttttattttaggttcaggggtacgagtgcaggtttgttatatagataaactgcatgtcatgggggtttggagtaaggattattttgtcatccaggtagtaggcatagtacctgatagatagtttttcgatcctcacccttcttccaccctccaccctcaagtaggccctggtgtctgttttctcttctttgtgtttccttttgttgttgttgttgttgttcccttctttgtggccacgtgtactccatgtttagctcccacttataagtgagaacatgtggtatttggttttctgttcctgtattagtttgcttcattgtcgcactaagcagaggctttaaaagtggctttatttcttttgcttctgtaatctcctggctagccactggttcaagaatgaggaaaggggatgttaaactgaccaaaaccttgaacaagaaaaatagacagttttgttttaagcttctaaaatttgtgtttggttatgtggtactattgcagcagaaacacaaaaatctctgctgaacttttttcatatattctatccaacaatatgcctactgaccttaaaattttattgagctgttgaactaaactgaaatcatctaggcatcttagcttgaccatggaaatgttctcctgattagcaccatcagcaggacgacttttggtgctgaggatactgcaaaactagaaattagtgtactgaacttttttatgtaaaaaaaaaaaaacactgtgtttttagctatattgagaaacgattcctgtgaaattgtactgtgttggctgtaaggatggtggtcactgtaacttacagtgtagtctttgtggcaaacttttggagaaattgctctctggtttcagcaactggagaaactatgttatcgtaagcaattggtttgtttgaatcttatggacagtggatctctatctggttgtgagccctcttgaattgcctggaaaattcagagccaaatatgtggccctacataagcaagtggatgtaagtgactttgcagcatacgttttgtttagcaacttcccctccttgtattattttcttttttctacacttattttctctttttctgcattccttgtaaattgttatcgttattatgttaagtattaagtattattttatcatatacatttatgtcagccaccttaaatccttttgggagcagaactgagaatacataaagcactactgttaataaaaaaaattaatttccgttagtaaaatgaagagagaaataaaattttatcagtgacccctcaacccttttgttgttgaaacttactaaggatctggcgtttctctattctgaaatatctccaggtcagtgttgtgaataaagcactgatatacattggtaccatttcgaattcatcatcaaaataaatgtaaagacaagctgggcatggtggttcatgtttataattccagcactttgggaggctgaggagggtggatcacttgaggtcaggagttcgacaccagcctggccaacatggtgaaaccccgtctctactaaaaatacaaaaatcagttaggcatggtggcctgtgcttgtgatcccagctgcttgggaggctgaagcacgataattgcttgaacacagaggtggatgttgcagtgagctgagatggtgccactgaactccagcctgggcgaaagagcgagactctatcccccaaaaataaataaaaggacaaaaattgtctttcttcaagctgtttgaaatagggaggaaggtttttctttacaaataatttgacgtattattctctttttttgttttgtttttgttttgagacagggtttcatctgttgcccaggttgtagtgcagtggtgcgatctcagctcactgcaacctctccttcctgggctcaagcgattctcctgcctcagcctcctgagtagctgtgattacaggtgcatgccaccaggcctagctaattttcatattttttagtagagatggggttttgccacgttggccaggcaagtctcgaactcctggcctcaagtgatctgcccaccttggcctcccaaaatgctgggattgcaggcgtgagccactgcgccaggcttgatatattatattattcttttaattattaaagttaattttttttaatatttgttgaatattgactatgtactcagatggtgctagctgttatggacgatataaagatattaataaataagatacttgaatctttaagatgccccatggccagccattgtggctcacatctgtaatcccagcactctgggaggctgagacaggtggatcactgagcccagcagttcgagaccagcctgggcaacatggtgagacttcatttctacaaaaaatgcaaaacttagctgggcatggtggcacacacctgtaatctcagctactcaggaagctgagacaggagaatcacttgagcctgggaagcagaggttgcagtgagctgagatcgtgtctctgcactccaacctgggcaacaaagtgagatcctgtctcagaagaagaaagaagaaagaagaaggaggaggaaggaggaggaaggagaaggaggaggaagaggaggaggaggaagaggaggaggaagaagaagaagaaaagagaagacaatgacaacgaagaagaagagaaagaagaggaggagggaggaggaggaggagctcccatgtgtctacattacaaagacaacttggtttccttgggtgtaattgaggttcactgcaagaatgatgaagaaagatgagggaggcaatgtggaaggactagcaacctgcaacagaagcatgatctggcctcctggttctagtgcagtgctctaatacatcaagagattagttgccaaggttgggggcaggacaagtataggaaacaccagcataaacacaaaataagagttaaagatgaggaaaatagaaacttgaactagtcagggtcactagataaaagcaaagaataatcaatagaaacagagccaaatcagaagctgaaagaatggttctgattcaagatattcatctgagtttacatgttttaactaccattgaatatccaaagggatatgaaaatatgaattggcacttgctgtgaaatttagaagatttccagtaaagtgttctatgtttacaggcaaatgtgccatatagggaagtcagagaggggcaaataccagtcccaccagcaactgtagaaagtccagtaaagatagagtctacacaaggcaatatctcatggcatcccagcttgcccttcatatagacagcgtactgagtagtatctcagaaaccagtgagaaattctttggcacaatggtgaggtctgtgggccctaccacctctgccctactcccacagacacttggaatgccgatttattaaagtaactctggtaaatcttgaaatttcctttctcccattgactgtatctaatatttcaacaggacccccaaacaattctgaaattaactgtgaactccacccatggacataaacacaatcatcagaataaacaaaccaatgaaccatcttctagattaaaagacttagttgtaatgtaaaaaaggaaattaaccagaggaataaacttaaatgaccccactcgtgaaagagttaataataaaaccaaaacaaaataaaacaaaaatctttagaaaaatctctaaatcttaaaaaatctagaaagatgctgagttaccaacaagattcaaaagaacattacaccatatgcacaccatatgcaaaatttaacactaaattgatcataggcctaattgtaagagctaaaactataaaattcttactagagaacaggggcataaatatttttgaccttggaaaaggcagtggtttcttagatatgacaccaaaaacacggataacaatagaaacaaagagattgtacttaaataaattgtacttcataaaaattatgaatatttgtgcttcaaagaaaacctcaagaaagtgaagagaaaaccagtgggctgggcatggtggctcacgcctgtaatcccagcactttgggaggccaaggcgggtggatcacaagatcaggagttcgagaccagcctggccaacatggtgaaacactgtctctactaaaaataaaaaaattagctgggcatggtgacaggtgcctgtaatcccagctacttgggaggctgaagcaggagaattgcttgaacccaggaggtggacattgtagtgagccgagattgcgccactgtactccagcctgggcggcagggtaagactccatctcaaaaaaaaaaaaaagagagaaaaccaacagaatgagagaaaatatttgcaaatcaaataactgataagggatttgtatccaggacttttacaactcaacaacaaaaagacaatctgattttaaagctatctgaatagacattgctccaaagaagatatacgcatgaccataaagcaagtgaaatgatgctcaacattattagttattagagaaatgcaaatcataaccataatgagacaccatgtcacatcctgtagaaaggctatcatttttaaaaaagacataaaaggcattgacgaggatgtggagaaattggaatcctcatacactgctggtggaaatgtaaaatgatgcagctactttggaaaaacaatttggcagttcctcagaaagttaaacacagacttaccatatgacttagcaattctactcccaggtatttacccaagagaaataacatgtttacacaataacctatatacaaacattcataccaacattattcataatagcccaaaaatagaaataactcaaatgtctgtcaactcataaatggataaacaaagtgttacacacacacccacacatgcactcacatacaagggcatattattcagcaataaaaatggagtgctgttacatgctacaacatggatgaactttgaaaacattatactaagtgaaagaatcccgacacaaaaaccacatattttatgattccacataaaatatatacactttatattatatatattgtctatatatataggcaaattcatagaaacagtagattagtgattgccaggggttgagggagggggcaatagggagtgattgctaatgactatggggtttcctttgtggatgatgaaaatgttctgaaattagataatgttgatggttgcacaactccaaaaaggtacaaccattaaaaaccgctagactgtgcactttaaaagtgtaaattttatggtatcttaaaaaactatcaatcatttaaaaattacattttaaaataggaacaatttaagattagaaaagattccttttgaaataaaaataagattgctagaattaaaaaaaaaaaatgacatggaagctgggcacagtggctaacccttgtaaacccagtgctttgggaggctgaagtgggaggactgcttgagaccagaattcaaaatcggcctggacaacatagcgagaccccaaggcaacccagtaagaccctgtctctaaaagaaaaaaatgaaatggaagcagtaaagagcaaaattggaaagtgacaaaaatcaaatcagtgaatttgaagaattcagagaaaagtgataaaggagtgaataaaatgagagaaaagatgatgtattaatggaagacgatgatggatctagaatatctgataaaagatttcaaagagaatgaacaataataaaagagataattatttctaatttcccaaagaagatcaagccaagttaagatccaatcaggtgaagagttgttttttgattgtattgtattactattgttattgtcgttattactattttttttactattattagtcagcttgaaatgtctatttttaactgacaaataataattgtatatatttatgggcacattatcatgttttgatctatgtatacatggtggaatgattaaatcaaagtaattagtaaagccatcacctcacctacttaacattcttctatggtgagaacatttaaaatctacttagattactgaaatttattcctcctatctaactgaaactatgtaccctttgaccaacatctctccttttcccaaccctaccctcatcccctctctagccgttggtaagcaccgttccactttctgcttccattagtttaactttttttagattccacattatcattgacttcatgcaatatttgtctttctgtgcctggcttattttacttagcataatgtcctccaggtataaacctgcatattgttgcaatgacagaatttccttctttcttaaggctgtatggtattccatcatgcttatataccacattttcattattcattcacccactgacacttcagttacttccgtatctttactattgtgaatagtgctacaatgaacattgaagtgcagatatctctttgacatatagatttcaagtcctttggatatatacccaaaagtgggatggctggattatatgatgattctgtttttagttttttcataagcctccatattattttccataatggtaatgctaatttacattctcatcaacagtgtaccagggtttccttttctctacgcccttgtcaacccttgttatcttttgtctttttttaaatgatagccattctaaccggtgtaagacgatatctcattgtgttttgaatttgcattttcctaacgattagagatactgagcattttttttcatttctctgttgacgatatgtatgtcttcttttgacaaatgcctgttagcttcaacttgttgcctagaaaattatggagtctacttcatgttgtattacagtagaacattaaggtatgatcctggaaatcagggtcccagctctgttacttatcactaatgtagctttgggcaaatcatttcacctctttgggactcaagttcctcatctgcttaaaaaaaatgaaaggaaaagcttgaactagatgactttaacacaattccttaatcaaaagatatgagccaggagacagatagaaagtaaggcaagaaagctagacagcagaagataataaggaagtccttatctaccagaactaaaattttgagggtgacgtgagaagggggcgagctgtacaagcagtcctgacactgtccgtagtcctgaagtgtcattattttgtctggctgccagttggaggagttgggaattgcttaggtaagcagtatggagatctgacaattttagcgcagaacagtgaaactgagctcattcacatctgtgtatttaactactacagattctgatgattcccaaccctatatctctagcattgaccttcatcctgatctcccaatacatgttttccactgtctaccaagtattaccagcatttttactgtattgaatttacttcaaactcaacaggtacaaaagtgaacttatcatattcattaatgatccttcttcttctcctgtattttctatcttgattagtgataccaagatgtatccctttccccaagccaaagaactaggagacttccatgattttaccatgcccaccacctatagtcaatcaccaagtgtgtcctgccaatattgcccataaatacatcttacattcatctctttctctctaccccactgtggatggatttatttaggttataaatgtttcttggttggactaccataacatcctcttcaataatcttgtcttcaattttgcacccttctaatttacatttatgatcaagctatttccctgctaaaagccttccctggctttagttgtttatagcacaaaatccaggttactcagaatggcattcaaggacacttcataatttgtacagggaagaaaattctgaaacaggatatttattagggagttcccaatggatcaacatctgtagaaaaatggagaaggaaacagaattaggtaaaaggagaagttgagctatgatccagccccaataaaggttgctcagcccacccgttgggtagctctggaactggactggctgctcagaattgttccaagttggatcaagtgggagccacggctttgtaaaacacactggtcatgcattggatgcaagatgtctttggaaggaagaaagacttgggtaatgctacaatttgagggttgtcttctggcatcattgtcagaaactgggagaataagtccttcattcccaaaggcagatctcagcagcacatcagaaaatccaccagccaccgtatatttgtctacctctacacatcctcctctgtacttccttgactctctgcatttactttatcataccatttactgaactctattttattgcctctttacttttctgtattcttcactagactgtgaactctgtgcaacaaatgctgctactatataaatcattgctttatcctcaatgcttgcagcattaaacaatttataaaataaaacattaagcactttgagaggctgaggctggcagatcatgaggtcaagagatcgagaccatcctggccaacatggcgaaaccccatctctactaaaaatacaaaaattttctgggcatggtggcaggtgcctgcagtcccagctacttgggaggctgagccaggagaatctcttgaacccgggaggtggaggttccagtgagcccagatcgtgctactgcactccagcctggcaacagagtgagactaagaaaatattaaatgaatgaatgcatatttcctttctccccactctttactccctgttgctctagtaaaaccaaactacttgaggtttcctgaattttccaagcctttctttgaggccatgctttgggtgtgctagaatgcctttgacttagtcatcagctgaatatctacttctctttcaaaagtcaattcaattgttacctttggaaaactttccccaggcacagtcacaatcttcattctctgtttcctgagaactcattttgtaccaactattatactcctattatttttaatttacatgtctgattattttcaggagatatgagaccttgagcctcatctattttgtgttcttagcacctaaagagacctggcacaagatgaagaaaaaaagaatgaacaataaatatgtgattaaaggttaggctctaggattactaaccaggaagtaatgtgcagaatgaactaaaaggaaaggagttatatgggagaaaattgttagtttatacaagaggcatgtgactgtggacactggatttgctataattccttattcctgaagttagttttttccacatgcaaattgaagagcagaatgatgatattagcatagttgtaactttgcctaacatgtcttagtcatgtagtgtcccagtctacttatgcaatgctagtgtaagggtgtcaaaatcaaatgccttcaggggccaggaagagtacctaaatgtctaaatgttcggtgggcctataggaaacaaagggcccacttgaggggcattcaatttcagtttttaaataatgtggtcaccaaacagaacaagtgtttgggcctgacatggcctgcaaaccaccagtttgcctcctcctcttttacacattttgaaatcacatttttttttaactacaatggaactgagtgggaggagatatgaatgacattttcatccttgcagaaaaagagggtgtttctatatttctaataaaaaagtagaattatttttgaagtggcttccttctctgccaggaagccaggaaatcagattagaaatttcattggcattaaaaaaaaaaaagatggcagggtacagtgtctcatgcctgtaatcctagcatttttggaggccaacgcaggagaatcacttgaggccaggaatttgagaccagcctgggcaacacagtgagacccccaccccagctccaaaaaaaaatttaaaagtattctgggcatggtggcatgagcctgtagtcccagctacttgggaggctgaggtgagaggatcacttgagcccaggaggacaaagttgcagtgagccctggtcataccactacactccagcctggggaaaaaaaaaaaaaaagaatctttccttggtgttgcttttttttttttttttttttttttgacaaagtttattttcttcttattaaaaaaaaaaatctgttaacatatttcaaaaatatagaaaagttcaaaaataatccctcaaaattccaaccagtgaacaaccttgactatcattttagtttatgcatcagatattaggtgggattgtaggactgacatgtgtactcagaactaggtggcaggtaagcaggaaagcaatttatttctaaccagctgggtttctgtaactaatgatctaacacagctaataaagacattctgggcagggcacagtggctcacgcctataatcccagctttttggaaggctgaggcaggctgatagcttcagcccaggagttggagaccggcctgggcaacatggcaaaaccctgcctctacaaaaatacaaaaattaactggtttggtggcacacacctgtgtgtcctctgctactccggaggctgaggttggggatcacttgagcccaggaggtcgaggctgcagtgagccaagatcatgcctctgcactccagcctgggcgacacagtgagaccttgtgtcaaaaaaaaaaagacactctgagatgactctaaagtgcctgactaaaaccagatagccacagggcctgacaacgaggaggagtttactgctgcgctactattgctgaaacggaacttggttttgaatccacaacagaactattgtgcgtgtgacatttgctttgagaaatgaatactgggttgacagtacacaagagcttttcagtctagtccataaagaactttcacttgattgccagctttttaccagtaattcaacatagaaaagtacagtttttgaccttaaaactttgaatgcaattcctaaaattaaaagatgtggatttatataagtcaaatgagaagacattacaataaacagagccacaggttttgtttgtttgttttttacaggaaattgtgttgtgtttacatttagagcattctgtgctgaggtattctctggctcatatatagaatcataagggagagaggagttgagaagtagttccctagaagaactagagagagagatgtaattatccctgatactaattagcagagatctggaatgaaaaaaacctcaataacctcatattcagacgattttttcaacatgttcattattaatagtaagcagacctcatgttaattttgaagaacacttaacagatttcaaaatatctgaagttcctctatttttttcctaatgaattttaaaatttttgtaatttttaaaaatagtattttggacttccctcgaaattttcctgcaatgtcactggtatatttggggatagagttttaagaatatccccagtgagggtttagaaaaatttaattcattataaatagatctattttaccttaattattattctattataattatttctttttttttttttttttttgagacagagtctcgctctgttgcccaggctggagtgcagtggcacaatctgcaacctccacctcctgggttcaagtgattctcctgcctcagcctcccgagtagctggaattacaggcatgccaccatgcttggctaatttttttgtatttttagtagagacggggtttcgccatgttgccaggctggtctcaaactcctgacctcaggtgatccacctgctgtggctgggtgggattacaggcgtgagcctgggattacagtgctgggattacaggcgtgagccaccgcacccagcctgttataattacttctaatcataatatttcttacttacaggccacctcatgttcagaccattttttccatatgtaattagaaatataaagcctgtattgcacttaaatatcattatactgttttaacatattttcatctacattaaaattcactttaaaattattagtcttagaaaaacaatcaaagaaaaataaagtatggtgtctccaaggttttggatattctaaaaggaagtagctgttctttcaagctaaatatcataaactgattttattaaataaggtcttacattttgtagtggcagcagtttataaatacaggcttactaattcattgctttcttttattcattagttatgttttggtactttatttaagtacccgagtggattatactagatgctgcgattcagaaacacaggctgtctacaggtgagacacaagtttcacctccaggggtacacagtttaattgcagcaaaatgttttaaagaaggaatgcttcactgtggaaaaaggaaacaagtggcttgttacccaaagagcacaaggaacccctccactgttgagttgttcacattttcttggtttatgcttcaggtagaggtaagtgaagcttcaaataatattatgccctaaagcttcaaactggaagaaaaaaaaaaagcccttgcacccctgaaatatgcatgcatgcctgagcatgcacacacacacacacacacacacacacacacacacacttttaccttgctctaaatttttgctcatgtacttagtaataaaatgttatttttagagttcacagccccaatatggaaatgtgtctagagcttggatctagaagtttatgtctttcttgaagttcctgggtcgtaataaccacagtgaggacaaaggcaccagaacaatgccaaaccaggagatatggcctgaattagaaggaagacaagtttttatcaggcataacaatgaaagaagttgaaaccatggagttattattaagagaagttgtggagtagttattcctggtagcctctaagtagcagttggtcctaaatcacaaaggtgtgtatttttctagagattccagacaagataattttgagggctcttatactatgattataaaaacctaataactatgttttaatgtagtgcattgtgtttttaccacttaagatggcagtgatttcatcagacagctttcttttggggagacttccaaaccaatctttgggggagaatctaatctcttttttgccaagctggtgaggttttcttcccccacattgaatgtttatatggaaagatatgaaccataaacatttttatataaaaacttattctttttgctttttattggctgcattgtaaggagtcatttggcctagagggaaaggagggtaacattccctatggcaaactacaacgaatcttccttctcctttcccaactccagcagtaatgatggaaaatcagtgcagcatcctagtgcattcgcagtgtggtttgacaaagaccataatgttcttgtcaacataggtaacagatcaatgtccatctgtagattccagtactttttcttactaagaagtgattaacagctggatgtaatatgtctactacagctacctagttttgtaaagcatatagttaattaaagggcaggaatcaaaaacatgatcaactctgtaaaagccctgagcttactcagctgcttcttgcaaacttcaacctgtggggtaaagagacatttgttgggtcatggcatgcttgcctctgaagaagatcatttcaaagactgggcctttttttctggtagcctagatgcaggacacagagttgctcattttgccagagtctctttttgccttgccaaactgacttttctttcaaaaaactatgtggaaaattaatgtgtaacttttcaatgataatattttctctttgtttggttttccccaatgatttcatatctatactaaacatccatcccaaataagttacacaggaagtggaggccaaagctaaaacaaactcacacccatttctctggcaacctatttaaaaaatagcgattaaaaatcaaaacattaaacataaccctttctggcgagataactctcccctaggttacattagaaaacacccccctacgtttacatggcatctttgctgtttatgatcttagttttcattattgtggcctaacaaaaatgtataaagcttaaagaccagctggagcaacatagcaagacccgagctctacaaaaaatttaaagcattggctgggcatggtggcgcatgcctgttaattactagggaggctgaactgggaggatggcttgagcaatcctcctataaccaggagttcaaggttacaatgagctatgatcacatcacttcactcaggcctaggcaacagagcccgacctgtttctaaaaaagaaagaaagaaagaaaaaaaggtttacagatattttgacactgcaaagaaatctcataaatatctcataaattattagtgacctgcaggaaatgaaagctcagcgttgcttcttttttcaccgctcctgatggggctgaacagtttctttacacccttgaatgcagtctgtcgtggcatgtgggtgtacatccttctctcttaagacaagatgtaatagtaacccatgatcttgtaatctcacataacaaggcattttgatctgcagtcctggttgttttctttaagctaaattttattttttattattatttttttttagagacaagatctcactatgttgcccaggctggtcctgaactgctgggctcaagtgatcctcccacctcggcctcccaaagtgctgggattacaggtgtgaagcaccgcgcctggcccctttaagctgaattttaaaggaacttagaatctcattctcttacatttttataaccaagaaatgaaccctgacggtaaagactattaatatactaattattcccagcattatacacttcatgtgaaaggcagatgaagaaaatgaagaacctgtcttctgttcaactaaaagggaaatttagctttacttagttgtatctgtaattgtccttttgtttttaagaatataagaatataaagaatataaataattgcaataaaacaacataagaagttgaccaatggaacaagaatagtatagcacttagtaagatgtacagatactattttaagtaccttgttttaaagttaagtaatgacagcctccagttaataaaccagaaataaactctaaccattatttcttggatttcagatatttttttctttatagaaataatgtgatgtatagtgttccttttactgggtcagccaacaaaagtatttacgttgatataaataaaatactttttgtaatcaaatattctagctcacaatgaaaaataattttaaaatgtgattatttagtacaagtaaacaaactttaaaaatacaacaacaagatttttatttttcatgaaataaacaacagtgagtagaaggaaattttgaggatgttcttgagaagaactttttgacactttag

SEQ ID NO: 562 - DNA, 1312 bp, Homo sapiens
ggcaactatacctttatgattttgcattctctataaacaactgatacactactaaaggcatacagaaaaggaacaactaatgaaaatgtattttcattataattgacagtctaggttccagtcttgacagagctaaaagaaaatctgatagaaataacacagaatcattttgcactaaatgtggaaataaatcaggtatctaccccggaaccatttatcttttgaaagtcctaaacaaaggtggaatagtgataagggaattagatgtgttcaaattgattcttcctcacatttccacattacaatcttacagagaagttattcaaaaactgtcaatttaatgtgtctgcaaatgttaaaggttttctgcctttatttataagacaaaattatcttctcttacacatttgatgagtgtttttatatgtatcacataggctaacaacttataaaatcttactagtatcagccaggcatggtggcttgtgcctgtaatcccagcactttgggaggccaaggtgggtggatcacaaggtcaggagatcgagaccatcctggctaacactgtgaaaccccatctctactaaaaatacaaaaaaattagctgtgcatggtggtgggcatctgtagtcccagctactcgggaggctaaggcaggagaatggcgtgaacctgggaggcggaccttgcagtgagccgagatcgcaccactgcactacagcctgggcgacagagcgagactctgtctccaaaaaaaaaaaaaaaaaaaaaaaaaaaattcttactagtatcaattatctattaagtttcaagtattatgcccaaaagcagtgaggagaaaaagccctttccctctgactatgatgccatagcaactttgagtatacataaatatctacttttaaagttctagatggcactgtcttagctttagtacattaatatatgattgtggaaaaggaggaaagccaagcgcaattgccttaaaaccttcagactaaaagttattgaaaatgaagcacaatataaatgttaatgttttcttttgttttattatagaccaggagctactgtggcttgcaaactatgttcttgcacaatactggctaacatgaaaaaatagatgcagagtgacagtatcactcttggatgtaataaaatccaggccaaaaaaaatcattaaataaaaataaagttttataaaactttataaggtaaaagataaaagttaccacgaagataaaataatcacaaatgtttacacatttaatagcatatctcatatgagaaaaaactattaagaataaatgga

SEQ ID NO: 563 - DNA, 124863 bp, Homo sapiens
aatatgcaagccaagtagaaaacaagtgtcattttttcatatctgtgaaagtcccctacgaactccaaaggcaacccttattcattgaaaattagctattgcccaaccaacccaacccctaaaaaatgtggcctgttaggcaagtttgccctgaagttggcatcatgcaaaaatatgtcatttaggggacaattagagtctctgataatttttacaaagctaatgtgcttctgcaagaactgttcatgtggtattaaaagtcagtgaacacttttaacttttatttgcattccatttttatacttaccagaaagaaaaaagtgcagaaaacactctccctatatcaaactacaaattccagctcagttcaagaaactaagagtagggaccctgccttctaactgatgcataaaagagtggaggtgctgctttttaaaaaggaggctaataataaagcaagaacagccagtaacagtcctgggcagggaagaaatcagccaaactcttgccaaaaattattgtattaaatgctaaatcctactttaaggtagcaaccaaaatttaatcttttcaaatgtttccctttatgagtagagcctcctactattttctaagaggcggaagcactgctctttgcaaagtgattgacttttttgacaggagccagaatttaaaactggcattgaaactcagaaaatctgaaaccaggaagaagaaagaaacaattgtttattgtatgctccatacacattttcagtatattgatgccatgtttgccagagaacaaatttccaaagtctgattgcagacctcctatctcctgacttttcacctgcctctgtaagtgtatgatgagatggtactggtgattattcggagccatcaccaggggctgcttccactaagagcagcccagttaagcaacacttccatggtgtttcttatagtgaccaatggaccatatccatctaccccaggtcaatgaaatcccttggcaaatgaggcacttatgtggaatttcacatgactggccatattcaggcagagccttgacaaggaggatgtggaaaagattctaatttgaggggagaaagttggggcagagctagccggggtggcagatgagatgttgttttttaaatgttctagagatcagaataggtgtgcgggttcagaagatcattcaggcataccaaaataatggcacctcctcttcactgtggaatgttttaaaatgactgctaaaattgccgggcacagtggctcatgcctgtaatcccagcactttgggaggccaaggcaggcagattacatgaggccaggagttcgagaccagcctggccaacatggtgaaaccccgtctgtactaaaaatacaaaaattagccgggtgtggtggtacgtgcctgtagtcccagctactcagaagactgaggcccaagaatcgcttgaacctgggaagcagaggttgcagtgagtcaagattgtgccactgcactccagcctgggtggagacagagttagactctgtctcaaaaaaaaaaaaaaaaaaaaaaaaaggaaaaagaaaagaaaaaaagaaaagataaataaataaataaataaaacgactaataaaaatgaaaatatcttccctttaacatattttcaaagccttcagtaataaaaaatatctgcttctttagccatttcgcatgcttaaagaaaaacttacaatgccattagcatggaaactgtgaactctaagccgccaagtattaaaaaacatataaaaagacgtttaatcttgagatttaactctgaatcctcagtcttcccaaaacatgctctaatgatcagacatcctaatgtgttgatcatagatctgtaaagaaggtcatagcctcatagaaacacatatcagttgtttaaacttaggcattagatgagaaagaaataattgataattaagggaacggaagttgaggctcggcatgggaatccagaaagaagtatctacaactgaaataaaaggtgagaaatacaatatattctgggaaaaacttatggccataggacctaggattattctatgacgcctgttctctttgttttctatttatcctttatcacaaagctccatatgccctacgctccaattatataaaatatagcttattaagtgttctaccctaatactcctcccacaccatttcttcctttagcagagaacattgtagataaaagtctttttaaaaataaaatgtttgcatagacacaaaggacatgatttttatcttcacattccttatgaagacaaaccacagtggtctttgttccctgtatcctgagagcctagaacagtgcctggcacatagttaagtgtttgtcttaaccttgaatccccagaaagcaaagctgaagacaagagttttaagttcaactactttgcctgtgaatgaaatgccagggaagcaaaagtgaggatgaagataaggggttatgaagcaagagggagaaccattccttaagatgaataccaagggcaaatatttgccccatctcaagacatcatcttctgctaagcatagaaactgcacctcaagactgtcctctgagggaagaattcatccactagccccatttcccttgtactcccttgcctttttgagctgtgtatgcatgggtgctgtacagggacccccagaacctccttccttgtggtcaacagaaaaggagcaagtagctcagtgtgggatagttgcccctggaggaagctggtaggagcacacacagagacaggtgaggaggagaggacctgcagtggtgcataaaaggagtctgatacagcactcaataaatatttgctgaatgaatgtgtttttttttttataacggttccagttattgattgaagaggggtaaaaagtcagcagtaactcatcatcataatcatctgtagtttagtgaagaaaagacacaggtcgccctttgaaagagcttgttacttggaataattttaatatttgctgattttaaaaacatttttccaattgtcagcttggcataactggaactgattagtgacaaaaagtgatagatgatgcacctgtccctcacttgaactgaagaaaaattgttcataaaagcatggacatttccacaagcatcattagtaacaaatatctgctgagttagcttttatgctccttcaaattagccactctctcacatactgatccttcccacattgcagcatcactttgttactacaactcatcctttaaagcttagctgaaaaatcactgctaccaggaagccttctctctctctctctctccctccctccccttcctctctatttccaatttgtgctaggtgctttcaagttactcagttttactgctattattgcatctctcacattctattgtaactgtgattgtctatctccctcactaaattatcaacagtggtgggactgagacatttatcttcctagcaccagacacatagcaggcatcctatgaatttcagcagaaccaaagaatgtgtaagtcactgaatcagtgtttgacaaaactgcaaaggatattgggaaatgaacagtagctgatgtttatcactggttgggttagggaaatcttagaggagctggatgtgggctggatgcagaaggaagatgagactcatggatttggggagaaggaaaattgcattacagttgggtttctggccatgagacagaaatgcacttaacctaccataaagcagtgaattatctagctaggcaggggcagaaagatctggagcacttcacagagaataaaactgaacaggaaagtcagagtgagattgtagagagcatcaaatgtcaggctaagcagctttgcctttttcttctattttatattctcagaattttcaaagcagtaggcaacatgaccaagtggagtttcaaatggctggtagatgtgtggaagagtaattagaaaagagaaaccaattacacagagaagaaaaaagcaattccctttgtcaaactatgagccaaggaagtaagacaaagtttggctttagaaaaaataatttgggaggatttaaagattatacaagttcggtgatttcctattctttgtttagagttaacgttctccaagacgtaacctgaactccataatctaccctgatttcttcatctcctgccaaactgaactgttagtgcatacatgacctctattgcctcatgtctgggaaaatcttggtgcccggaatactctcccttctacccattttcttctgtcaaagcctgaactgcactttaattctcttttctaagctatctcatccacaatagaaagtatatgtacatcacaattagaagaactagagaagaaagagcaaataaattcaaaagctagcggaagaaataaataactaagatcagagcagaactgaaggagatagagacatggaaaacccttcaaaaaatcaatgaatccaggagctggttttttgaaaatattaacaaaatagctaggccactagccagactaataaagaagaaaaaagaggtcacttccaagatggccaaataggaacagctccggtctacaactcccagtgaaattgacacagaagatgggtgatctctgcatttccaactgaggtacctggttcatctcattgggactggttggacagtgggtgcatcccaaggagggtgagccaaagcagggcagggcatcacttcacctgggaagtgcaaggggttgggagatttccctttgctagccaaaggaagccatgagtgactgtacttggaggaatggtacactcctgcccaaataccatgcttttaccatggtcttcacaactggcagaccaggagattccctcccatgcttggctaggcagttcacacgtccatggagccttgctcactgccagcgcagcagactgagattgacctgggatgctggagcttagtgaggggaggggtatccaccattgctgaggcttgagtaggcggttctatgctcacagtgtaaacaaagaggcagggaagcttgaattgggtggagcccaccgcagctcagcaaggcctactgcctctatagattccacctctgggggcagggcatatctgaacaaaaggcagcagacagcttctgcagacttaaatgtccctgcctgacagctctgaagacagcagtggttctcccagcatggctttcgagctctgataactgacagaatccctcctcaaatgggtccctgaccccagtgtagcctgactgggagacacctgccagtaggggctgacaaacacctcatagaggtgggtgcccttctgggacaaagcttccaggggaaggatcaggcagcaatatttgctgttctgcagcctttaccagtgatacccaggcaaacagggactggagtggacctccagcaaactccaacagacctgcagctgaggggcctgtctgttagaaggaaaactaactaacagaaaggaacagcatcaacatcaacaaaaaggacatccacgccaaaaccccatccataggtcaccaacatcaaagaccaaaggtagataaaaccacaaagatggagagaaaccagagcagaaaggctaaaaattccaaaaaccagaacacctcttctcctccaaaggaacaaaactcctcaccagcaaggggacaaaactgagtggagaatgagtttgacaagttgacagaagtaggcttcagaagttcagtaataacaaacttctctgagctaaaggagcacattctaacccattgcaaggaagctaaaaacctagaaaaatgttagatgaatggtgaactagaataatcagtgtagagaagagcttaaatgacctgatggagctgaaaaccacagtacgagaacttcatgaagcatacacaagcttcaatagctgattcaatcaagtggaagaaaggatatcagtgattgaatatcaaattaatgaaataaaatcagaagacaagattagagaaaaaagagtgcaaagaaatgaacaaagcctccaagaaatatgggacaatgtgaaaaggccaaagctacgtttgattggtgtacctgaaagtgacagggagaatggaaccaagttagaaaacactcttcaggatattatccagaagaacttccccaacctagcagggcatgccaaaatccaaattcaggaaatacagagaacaccgcaaagacattcctcaaaaagagcaaccataagacacataattgccagattcaccaaggttgaaatgaaggaaaaaatgttaagggcagccagagagaagggtcgggttacccacaaagtgaagcccatcagactaacagcagatctctcagcagaaatcctacaagccagaagagagtgggggtcaatattcaacattcttaaagaaaagaatcttcaacccagaatttcatatccaaccaaactaagcttcataagtgaaggagaaataaaaccctttacagacaagcaaatgctgagagattttgtcaccaccagacctgccttacaagagctcctgaaggaagcccataatatggaaaggaacaaccagtaccagccaccgcaaaaacacgccaaattgtaaagaccatcgatgctatgaagaaactgcatcaattaatgggcaaaataaccagctagcatcataatgacaggatcaaattcacacataacaatattaaccttaaatgtaaatgggctaattccccaattaaaagacacagactggcaaattggaaaaagagtcaagatcaatcagtgtgctgtattcaggagacccatctcacgtgcaaaggcacacataggctcaaaataaagggatggaggaagatctgccaagcaaatgaaaagcaaaaaaaagcaggggttgcaatcctgctgtctgataaaacagactttaagacaacaaagatcagaggagacaaagaaaggttcatgacataatggtaaagggatcaatgcagcaagaagagctaactatcctaaatatacatgcacccaatacaggagcacccagattcataaagcaagtgcttagagacctacaaagagacttagactcccacacaataatagtgggagactttaacaccccactgtcaatattagacagatcaacgagacagaaaattagcaaagatatccaggattgaactcacctctggatcaagagaacctaatagacatctacagaactctccaccccaaatcaacagaatatacattcttctcagcaacacatcatgcttattctaaaactgaccacataattggaagtaaacactcctcagcaaatgtaaaagaacagaaatcacaacaaacagtctctcagaccacagtgccatcaaattagaacgcaggattaagaaacgcactcaaaactgcacaactacatggaaactgaacaacctgctcctgaagattgaactactaggtaaataacaaaactgaggcagaaataaagacgttctttgaaaccaatgagaacaaagacacaacgtaccagaatctctgggacacatttaaagcagtgtgtagtgggaaatttatagcactaaatgcctacaagagaaagcaggaaagatctaaaatcgacaccctaacatcacaattaaaagaactagagaagcaggagcaaacaaattcaaaagctagcagaagacaagaaataactaagatcagagcagaactgaagcaggtagaaacacaaaaaaacccttcaaaaagtcaaagaatccagcagcttgttttctgaaaagatcaacaaaacagaccactagcaagcctaataaagaagaaaagagagaagaatcaaatagatgcaataaaaaaatgataaaggggatatcaccactgatcccacagaaaaactaccatcagagaatactataaacacctctatgcaaataaactagaaaatctagaagaaatggataaattcctggacacatacaccctcccaacactaaaccaggaagaagttgaatctctgaatagaccagtaacaggttctgaaattgaggcaataattaatagcctaacaaccaaaaaatgtccaggactagacagattcacagccgaattctaacagaggtgcaaagaggatctggtaccattgcttctgaaactattccaatcaatagaaagagagggaatcctccctaactcattatatgaggccagcatcagcctgataccaaagcctggcagagacacacagaaaaaagagaatttcagaccaatgtccctgatgaacatcgatgcgaaaatcctcaataaaatactggcaaaccaaatccagcagcacatcaaaaaggttatccacaatgatcaagtgggcttcatctgtgggatgcaaggctggttcaacatacataaatcaaaaaatgtaatccatcacataaacagaaccaaccaaaaaaaccacatgattatctcaatagatgcagaaaagaccttcaataaaattcaacagcctttcatgctaaaaactctcaataaactaggtattgatggaatgtatctccaataataagaactatttatgacaaacccacagccaatatcatactgaataggcgaaaactggaagcattccctttgaaaaccatcacaagacaaaaatgccctctctcaccactcttattcaacatagtattggaacttctggccagggcaatcaggcaagagaaagaaataaagggtatttaaataggaaaagaggaagtcaaattgtccctgtttacagatgacatgattgtatatttagaaaaccccatcatctcagccaaaaatctcaagctcatatgcaacttcagcaaagtctcaggatacaaaatcaatgtgcaaaaatcacaagcattcctatacaccaacaacagacaaacagagaaccaaatcacaagtgaattcccattcacaataactacaaagagaataaaatacctaggaatccaacttacaagggatgtgaaggacctcttaaagagaactacaaactactgctcaatgaaataaaagaggacataaacaaatgaaagaacattccatgctcatggataggaagaatcagtattgtgaaagtggccacactgcccaaagtaatttgtagattcaacgctattcccatcaagctaccattgactttcttcacagaattggaaaaaagactactttaaatttcatatggaaccaaaaaatagcctgcatagccaaggcaatcttaagcaaaaagaacaaagctggaggcatcatgctacctgacttcaaactatactacaaggctacagtaacaaaacagcatggtaatggtaccaaaacagatatatagaccaaaggaacagaacagaggcctcagaaataacatcacacatctacaaccatctgatgtttgacaaacctgacaaaaaacaagcaatggggaaaggattccctatttaataaatggtgttgggaaaactgacaggccatgtgtagaaaactggaactggatccctttcttacaccttctacaaaaattaactcaagatggattaaagacttaaacataagacctaaaaccataaaaatcctagaagaaaatctaggcaataccattcaggacataggcatgggcaaagacttcatgactaaaacaccaaaagcaatggcaataaaagcgaaaattgacaaatgggatctaattaaactaaagagcttctgcatagcaaaggaaactatcatcagagtgaacaggcaacctaaagaatgggagaaaatttttgaaatctgtccatctgacaaagggctaatatccagaatatacaaagaacttaaacaaatttacaagaaaaaacaaacaaccccatcaaaaagtgggcaaaggagatgaacagacacttctcaaaagaagacacttatgcagccaacagacatatgaaaaaatgctcatcatcactgctcatcagaaaaatgcaaatcaaaaccacaatgagataccatctcatgccagtcagaatggcaatcattaaaaagtcaggaaacaaatttgtggagaaataggaatgcttttacactgtgggtgggagtgtaaattagttccaccattttggaagacagtgtggcaattcctcaaggatctagaaccagaaataccattaggccagcaatcccattactgggtatatacccaaaggtttataaatcatgctaccataaagacacatgcacatatatgtttattgcagcactattcacaatagtaaagacttggaaccaacccaaatccccttcaataatagactggataaagaaaatgtggtgattacaggggcaagatggccgaataggaacagctccagtctacagctcccagcgtgagcaacgcagaagacgggtgatttctgcttttccatcagaggtaccgggtacatctcactagggagtgccagacagtgggcacaggacagtgggtgcagtgcactgtgtgcgagctgaagcagggtgaggcattgcctcactcgggaagcgcaaggggtcagagagttcactttcctagtcaaagaaaggggtgacagacggcacctggaaaatcgggtcagtcccaccctaatactgcgcttttccgacaggcttaaaaaacagcgcaccaggagattatatcccacacctggctcagagggtcctatgcccacggagtctcgctgatcgctagcacagcagtctgagatcaaactgcaaggtggcagggaggctgggggaggggcgtccgccattgcccaggctgcttaggtaaacaaagcagccgggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttttcccaggacgcagctggagatctgagaacgggcagactgcctcctcaagtgggtccctgacccctgaccaccaagcagcctaaatggaggcaccccccagtaggggcagactgacacctcacacggccaggtgctactctgagacaaaacttccagaggaacaatcaggcagcagcattcgtggttcacgaaaatccactgttctgcagccaccgctgctggtacccaggcaaacagggtctggagtggacctctggcaaactccaacagacctgcagctgagggtcctgtctgttagaaggaaaactaacaaacagaaaggacatccacaccaaaaacccatctgttcatcaccatcatcaaacaccaaaagtagataaaaccacaaagatggggaaaaaacagagcagaaaaactggaaactctaaaaagcagagcgcctctcctcctccaaaggaacgcagctcctcaccagcaacggaacaaagctggatggagaatgactttgacgagttgagagaagaaggcttcagacgatcaaactactccaagctagaggaggaaattcaaaccaaaggcaaagaagttaaaaactttgaaaaaatttagacaaatgtataactagaataaccaatacagagaagtgcttaaaggagctgatggagctgaaaaccaaggctcgagaactacatgaagaatgcagaagcctcaggagccgatgtgatcaactggaagaaaaggtatcagtgatggaagatgaaatgaatgaaatgaagtgagacgggaagtttagagaaaaaagaataaaaagaaacgaacgaagcctccaagaaatatgggactatgtgaaaagaccaaatctacgtctgattggtgtacctgaaagtgatggggagaacggaaccaagttggaaaacactctgcaggatattatccaggagaacttccccaatctagcaaggcaggccaacattcagattcagtaaatacagagaacgccacaaagatactcctcaagaagagcaactccaagacaaataattgtcagattcaccaaggttgaaatgaaggaaaaaatgttaagggcagccagaaagaaaggtcgggttacccacaaagggaagcccatcagactaacagcagatctcttggcagaaactctacaagccggaagagagtgggggccaatattcaacattctgaaaggaaagaattttcaacccagaatttcatatccagccaaactaagcttcataagtgaaggagaaataaaaccctttacagacaagcaaatgctgagagattttgtcaccaccaggcctgccctaaaagagctcctgaaggaagcactaaacatggaaaggaacaaccagtaccagccactgcaaaatcaagccaaattgtaaagaccattgaggctaggaagaaactgcatcaactaacgagcaaaataaccagctaacatcataatgacaggatcaaattcacacataacaatattaactttaaatataaatggactaaatgctccaattaaaagacacagactggcaaattggataaagagtcaagacccatcagcatgctgtattcaggaaacccatctcacgtgcagagacacacataggctcaaaataaaaggatggaggaagatctaccaagcaaatggaaaacaaaaaaaggcaggggttgcaatactagtctctgataaaaacagactttaagccaacaaagatcaaaagagacaaggctattacacaatggtaaagggatcaattcaacaaaaagagctaactatcccaaataaatatgcacccaatacaggagcacccagattcataaagcaagtcctgagtgacctacaaagagacttagactcccacacaataataatgggagactttaacaccccattgtcaacattagacagatcaatgggacagaaagttaacaaggatacccaggaattgaactcagctctgcaccaagaggacctaatagatatctacagaactctccaccccatatcaacagaatatacatttttttcagcaccacaccacacctattccaaaattgaccacataattagaagtaaagctctcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgaagacaaaaataaagatgttctttgaaagcaatgagaacaaagatacaacataccagaatctctgggacacattcaaagcagtgtgtagagggaaatttatagcactaaatgcccacaagagaaagcaggaaagatccaaaattgacaccctaaggtcacaattaaaagaactagaaaagcaagagcaaacacattcaaaagctagcagaaggcaagaaataactgaaatcagagcagaactgaaggaaatagacacacaaaaaacccttcaaaaaatcaatgaatccaggagctggttttttgaaaggatcaacaaaattgatagaccgctagcaagcctaataaagaagaaaagagagaagaatcaaatagacgcaataaaaaatgatgaaggggatatcaccactgatcccacagaaatacaaactaccatcagagaatactataaacaactatatgcaaataaactagaaaatctagaagaaatggataaattcctggacacacacaccctcccaagactagaccaggaagaagttgaatctctgaatagaccagtaacaggatctgaaattgtggcaataatcaatagcttacccaccaaaaagagtccaggaccagaaggattcacagccgaattctaccagaggtacaaggaggaactggtaccattccttctgaaactattccaatcaatagaaaaagagggaatcctccctaactcattttatgaagccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgatcaagtgggctgcatccctggaatgcaaggctggttcaatatacacacatcaataaatgtaatccagcttataaacagaaccaaagacaaaaaccacatgattatctcaatagatgcagaaaaggcctttgacaaaattcaacaacgcttcatgctaaaaactctcaataaattaggtattgataggacgtatctcaaaataataagagctatctatgacaaacccatggccaatatcatactgaatgggcaaaacctggaagcattccctttgaaaatggcacaagacagggatgccctctctcaccactcctattcaacatagtgttggaagttctggccagggcaattaggcaggagaaggaaataaagggtattcaattaggaaaagaggaagtcaaattgtccctgtttgcagataacatgattgtatatctagaaaatcccattgtctcagcccaaaatctccttaagctgataagcaacttcagcaaagtctcaggatacaaaatcaatgtacgaaaatcacaagcattcttatacaccaataacagacagagagccaaatcatgagtgaactcccattcacaattgcttcaaagagaataaaatacctaggaatccaacttacaagggacgtgaaggacctcttccaggagaactgcaaaccactgctcaatgaaataaaagaggatacaaacaaatggaagaacattccatgctcatgggttggaagaatcaatatcgtgaaaatggccatactgcccaaggtaatttatagattcagtgccatccccatcaagctaccaatgactttcttcacagaattggaaaaaactactttaaacttcatatggaaccaaaaaagggcccacgtcgccaagtcaatcctaagccaaaagaacaaagccggaggcctcacgctacctgacttcaaactatactacaagtctacagtaaacaaaacagcatggtactggaaccaaaacagagatatagatcaatggaacagaacagagccctcagaaataatgctgcatatctacaactatctgatctttggcaaacctgagaaaaacaagcaatggggaaaggattccctatttaataaatggtgctgagaaaactggctagccatatgtagaaagctgaaactggatcccttccttacaccttatacaaaaattaattcaagatggattaaagatttaaacgttagacctaaaaccataaaaaccctagaagaaaacctaggcattaccattcaggacataggcatgggcaaggacttcatgtccaaaacaccaaaagcaatagcaacaaaagccaaaattgacaaatgggatctaattaaactaaagagcttctgcacagcaaaagaaactaccatcagagtaaacaggcaacctaaaaaatgggagaaaatttttgcaacctactcatctgacaaagggctaatatccagaatctacaatgaactcaaacaaatttacaagaaaaaaacaaacaaccccatcaaaaagtggggaaaggacgtgaacagacacttctcaaaagaagacatttatacagccaaaaaacatatgaaaaaggctcatcatcactggccatcagagaaatgcaaatcaaaaccacaattagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgatacctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattgagaaaatgtggcacatatacagcatggaatactatgcagccataaaaaatgatgagttcatgtcctttttagggacatggatgaaattggaaatcatcattctcagtaaactatcacaaggtcaaaaaaccaaacaccacatgttctcactcataggtgggaattgaacaatgagaacacatggacaccggaacgggaacatcacactctggagattgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacataaagtataacaataataaaataaaatgtagcacatacacaccatggactactatgcagccataaaaaatgatgagttcatgtcctttgcagggacgaagctgaaaaccatcattttcagcaaaatatcacaaggaaagaaaaccaaacactgcatgttctcactcataagtgggagttgaacaatgagaacagatggaaatagggaggggaaaatcatacaccagggcctgttaggggctggggggttgggggagggatagtgttaggagaaatacctaatgtaagtgacaagttgatgggtgcaccaaatcaacatggcacatgtataactatgtaacaaacctgcatgttgtgcacatgtaccctagaacttaaagtataataataattacaaaaaaagaagaaaagagagaagaatcctagacacacaataaaaaatgataaaggggatatcaccactgatacaacagaaatacaaactaccatcagagaatgttataaacacttctatgcaaataaactagaatatgtagaataaatggatacattcctggacacatacaccctcccaagactaaaccaggaagaagttgaatccctgaatagaccaataacaagttctgaaattgaggcagtaattaatagcctaccaacaaaaacagctcaggaccagatggattcacagccgaattctaccagaggtaaaaggaggagctggtaccattccttctgaaacagtagaaaaagagggactcctccctaactcattgtatgagtccagcatcagcctgacaccaaagcctggcagagacacaacaaaaaaagaaaatttcaggccaatatccctatgaatatcaatgcaaaaatcctcaataaagtactgtcaaaccgaatccagcagcacatcaaaaagcttatccaccacaatcaagttgtcttcatccctgggatgcaaggttggttcaacatacacaaatcaataaacgtaatccatcacataaacagaaccaatgacaaaaaccacatgattatctcaatagatgcagaaaaggcctttgataaaatttaacaccccttcatcctaaaaactctcaataaactaggtattgatggaatgtatctcaaaatactaagagttagttatgacaaacccacagccaatatcatactgaatgggcaaaagctggaagcattccccttgaaaatcaggacaagacaaggatgtcctctctcaccactcctattcaacaagatattggaagttctggccagggcaatcaggcaagagaaagaaataaaggttattcaaataggaagagaggaagtcaaattgtctgtttgtacaggacaggattgtacatttagaaaaccccatcgtctcagccaaaaatctccttaagctgatatgcaacttcagcaaaatctcaggatacaaaaccaatgtgcaaaaatcacaagcattcctatacaccaatcatagacaaacagagagccaaatcatgagtgaactccctttcacaattattacaaagtgaataaaatacctatgaatacaacttacaagggatgcgaaggacctcttcaaggtgaactacaaatgactactgacggaaataagagaggacacaaacaaatggaaaaaccttccatgctcatggataggaagaatcaatgtcatgaaaatggccataatgcccaaagtaatttatagattcaatgctatccccatccagctaccattgactttcttcacagaagtggaaaaaactactttaaatttcatgtggaaccaaaaaagagcccgcataaccaagacaatcctaagcaaaaagaaccaagctggaggcatcacgctacctaacttcaaactatactacaagaccacagtaaccaaaatagcatggtactggtaccaaaacagatatatagaccaaaggaaaagaggcctcagaaataacaccacacatctacaaccatacaatctttgacacatctgacaaaaacaagaaatggggaaaggattccctatttaataaatggtgttgggaaatctggctagccatatgcagaaaactgaaactggacccctccttacatcatacacaaaaattaactcaagatggattaaagatttaaacatgagacctaaaaccataaaaatcctagaggaaaacctaggcaataccattcaggacataggcatgggcaaagacttcatgactaaaacaccaaaagcaatggcaacaaaagtgaaaattgacaaatgggatctatttaaagagcttctgcacagcaaaacaaactgtcatcagagtgaacaggcaacctacagaatgggagaaaatttttgcaatctatccatctgacaaagggctaatatccagaatctacaaagaacttacacaaatttataagaaaaaaaaaccatcaaaaagtgggcaaaggagataaacagacacttctcaaaagaagacatttacgtggccaacaaacatatgaaaaaaagctcatcactggtattagagtaatgcaaatcaaaaccacaatgagataccatctcacgccagctaaaatggagatcattaaaaagtcaggaaacaacagatgctcgagaggttgtggagaaataggaacacttttaaactgttggagggagcataaattagtccaaccattgtggaagacagtgtggcgattcctcaaggatctagaaccagaaataccatttgacccagcaatcccattactgggtatacacccaaaggattataaatcattctactataaagacacatgcacatgtatgtttattgcagcactattcacaatagcaacgacttggaaccaacccaaatccccatcaataatagactggataaagaaaatgtggcacatttacaccatggaaactatgcagccataaaaaagatgagttcatgtcctttgcagggacatggatgaagctggaaaccatcattctcagcaaactaacacaagaacagaaaaccaaacaccgcatgttcccactcatacgtgggatttgaacaatgagaacacatggacataaggaggggaacatcacacgtgggggcctgtcaggggtatggagctaggggagggatagcattagaaaaaatacctaatgtcgatgacgggttgatgggtgcagcaaaccaccatggcacgtgtatacctatgtaacaaacctgcatgttctgcacatgtatcccagaacttaaagtataatttaaaaaagaagaagaagaaagaaagtacatgtaagaaggccacttccaaagtgacatgtcacttctacttgggccttctggaaacaagctctccccacttcatgtgtccactccatgtatataggggtcaaactaataacatttatcttgggttttatatatggagaaagaatcaagtgtgatgtaaacaaagcataagtgtgatgtaaacaaagcataagtaaacaaatcaagtgtaatgtaagaaaagcatggactatagttctgttctgtatgtcctgagctatctacaaccttagcttcctcataggcaaaataaaggggttggtcaatgtcatctgaaaggtgcctctcaactctaacactctgtgtgataaatagtgagaacttcatacagcacagggagcgagatatactgagggctaaacgcgtggcacctatagtgactggaagctaggagatgcccaatatatatttagctgatggactaacctcctgactcatgctgtctacacttgcctctatttggagctggctgggtgcagtgcccaggggatcagagcttaccttgttatggcagtgactgcaacatttaaagcagcttctcaaattcaaatatgtacatgcatttcctggggatcttgtaaaatggagatcctggtttagtaggtctgagtggggcctcagattctgcatttaagtttccttttttattcatacataataattttacatatctgtggggtatatgtgatattttgatacatgcatacagtgtgtaatgatcaagtcaaggtaagtaggatattcatcacctcaaatgtttatcatttctttgtgttgggaacatcccaaaccttttagctgtacaatacattattgcgaattataatctgtgctattacacaccagaacttattcattctagaattcttttttggattgtttactgttggcatatataaatgctactgatttttgtatgttgattttgtgttctgcaactttacttaatttatcagttctaacagttttttggtggattctttaggtttctctaaatataagatcatgtcatctacaaacaaagctaatttgacttcttcctttccagttcggattccctatatttctttctcttacccaattgctctagccaggacttccagtattatattgaataaaagtggtggaagtgggaatccttgtcttgttccagatcttagaggaaaggccttcaatttttccccattcagtatgataactctgggtttgtcatatatggtctttctattttgagatattctcaaacaaaagccaatttgataagggtttttattttcataaagggatgttaaattttatcaaatgcttatttggcatctatggaaatagtcacatgattttggttctcggttctgttaaggtgatgtatcatgtttattgttgtgaaatattatgttgaaccatccttgcatccctgagatgaatcccactggatcatggtgaatgatcttttcaatatgttattgaatttggtttgctagtacttcattgaggctttttgtatctgcatttattattgatatcagcctattttttttccattgtgtccttgtctggttttggtatcagggtaatactggccttatagaatgagtttggaatattccttccattgcaattttttttaagagttggagtagaattagtattagttcttctttaactatttggtggcatttagcagtgaagccattaggccctgggctttttgtcgatagaagacttttcattaaagcttcaatctcattacttgttattggtttattgaggttttctatttattcatagcttaatcttgatcagttgtatatatccaggatttgtctatttcttctaggtttcccaatttgttgccatatagttattcgtaatagtctccgatgatttgttgtatttctgtggtttcatttgttatgtctcatttttttctgatgttatttatttgggtcgtttctttttcttttttttaatctttaatttttgtgggtacttagtaggtgtatatatttatgtggtacatcagatattttgatacaggcatgcaatgcataataatcccatcatgtaaaaggtgtatgcatcccctcaagcatttttcctttgtgttacaaaaaatccaactatactctttattttttaaatgtacaattaaattactattgactatagacactctgttgtgctaaataataggttttattcattctttctaactatttgttttgtgcccagtaaccatctccacctccccaccactcccctactacccttcccagcctctggtaaccattcatctactgtctgtctccatgagttcagttgatttgatttttagatcccacaagaaaaattagaacatgcaatgtctgtctttctgtgcctggcttattttacttaacataatgacctccagttccatccattctgttgcaaatgagaggaactcattcttgcttatagctaaatagtactccattgtgcataagtaccacatgttctttatccacttacctgttgatggacatttaagttgctttcaaatcctggttatcatgaacggtgctgcaacaaacataggtgtgcagatatctctttaatatactgacttcctttcttttgggtatatactcagaagtgggattgctggataatatggtagctctatttttagtgttttttgttttgttttgttttttgagggacctcaaaactgttctccatggtggctgtaatcatttacattcccagcaacagtgtatgagggttccctttaatccacatcctctccagcatttgttatttcctgtcctttggataaaagccattttaattagggtaagatgatatctcatagttttcatttgcatttctctgatgaacaatgatgctgagcatcttttcttttccctttacttttttttttttttttttttttgcttttctttttctttttcttttccctttcctttcttttattttcttttttttttttttttctgtgacaacgtctggctctacggtccaggctggagtgcagtggtgccatcttggctcactgcaacctttgcctctgcctccagggctcaagccatcctcccaccttaacctcctgagcagctgggactagatgcaggcatcaaaacgcctggctaatttttttttttttttttttttttttttgtagaaatagggttttgccctgttgcccaggctagtcttgaaattgtgaactcaaacaatctgcccacctcagcctcccaaagtgctggaattacaggcatgagccactgtgcctggcctgagcaccttttcatatgcttgcttgcttgccatgtatacgacttcttttcagaaatgtctattcaaatattttgcccatttttaaatcagattattagacttgttcctatagagttgtttgagttacttatacactctggttattaatcccttgtcagatgggtagtctgcaaatattttctcccattctgtgggttatctattcactttgttgcttgcttcctttgctgtgtggaagcttttaacttgacgtaatcccatttgctcattttgccttggatgcctgtgtctgtggggtattactcaagaaacttttgcccagaccaatgtgctggagagtttccccaatgtttccttgtagtgttttcatagtttgagtccttagattttgatttgatttttgtgtatggtgagagataggggtcaagtttcattcttctgcatataggtatcctgttttcccagcaccatttattgaaaagactgtcttttccccagtgtatactcttgccaactttgtcaaaaatgagtggtatgtgaatttgtttctgggttctctattctgttccattggcctatgtgtctgtttttatgacagtagcacgctgctttggttactatagctctgtagtataatttgaaatcaggtaatgtgatccctccagtttagttctttttgctaaggatatcttgggctattctaggtcttttctggttccatataaattttagattttttttctatttctgtgaagaatgtcattgctattttgataggattacattgaatctgtaattgctttgtgtagcatggacatttaaacaatactgattctcccaatccatgaacatggaatgtctttccattttgtgccctcttcaatttctttcatcagtgttttgtagttttcattgtatggatctttcatttctttcataaagttaattcctatttaattttatttgtggctactgtaaatggaattttaaaaaatttctttttcagattgttcaccattagcatatagaaatgctactgatttttgtatgttgattttgtatcctgaaactttactaaatttatcagtcctaattttcttttgtggagtcttcaggtttttccaaatataagatcatgtcagacgaggataatttgtcttctttatttccagtttggttgtcctttatttctttctcttatctgattgctctacctaggacttccagtgctatgctgaagaacagtggtgaaaatgagtatctttgtcatgttccagatcttagaggaaaggctttcaatttttccctattaagtatggcactagctgtgggtctttcatatatggctttcattatgtcaaggtatgttccttctatatccagattttttagggtttttattattaagagatgttgaattttatcaaatgtttttccagcatcaattgaaatgatcatatggttttttgtccttcattctgctgatatgttgtatcacttggattgatttgcatatgttgaaccatccctgcatccctggtataaatactacttggtcatgatgaacaattttttaatgtttgttgaattaggtttgcaggtaaaatattttgttgaggattcctgcatcagtattcatcagagatatcattctgtagttttctttttttgatgtgtctttgtctagtttgggtatcaaggtcatgctgatgaatttggaagtatttcttcctctatttttcagaatagtttcagtaggattggtattagttctttaaatgtttggcagaatttagcagtgaatccatagggttccaggttttcctttactgggagaatttttattatgggtttgattcttcacttgttattggtctattcaggttttggatttcttcgtggttcaatcttggtaggttgtatgtgtctaggaatttatccatttcctccagattttccaatttattggcatatggtttttcatagtagccactaaagatcttttgaatttctgtgatatcagctgtaatgtctcatttttcctgtctcattttattcacttgggtcttctccatttttttcttagtctggccaaaagcttatcaattttgtttctcttttcaaaaaccaactctttgttttgttgatctttttatttgcttcattttgaattcatttatttctgccctaatcttgattatttctctgcttatattaattttgggtttggtttgctctcccttttctagatctttgagatgcattgtcaggttatttatttgaagtttttcttcttttttgatataggcacttataggtataaatttccctcttagtactgctttatctatatcccataggttttggtatgttgtgtttccattatcatttgcttcaataaatttttcaattgtcttctaattcctttattgacccattggtcattcaggagcatataatttaatttgcatgtgttcgtgtagtttccaaaattcctcttgttgttgatttctagttttattccattgtgtgtgagaaaaagaagatgtttgatataatttcaatttctaaaaatgttttaagacctgttttgtgacttaacatatggtctatctttgcaaatgacccatgtgccgaggggaagaatgtgtattctgtaacttttggatgaaacgttctgtaaatatctatgagatccatttgttgtatagtgcagattaagtctaatgcttctttgttgagtttctgtctgggagatctgtccaatgctcaaagtgaggtgttgaagtctccagctaatgatttctatctctctctttagttgtattaatatttgcttcatatatctgtgtcatcctgtgtcagatgcatatatatatttacaatcattatatcctgttgctggattgactctttatcattaatgaccttctatattagtctgttctcatgctactaataaagacataccccagaatgattaattgataaaggaaagaggtctaattgtctcacagttcagcatggctggggagcctcaggaaacttacaatcgtggcagaaggggaagcaaacacatccttcttcacgtggcagcaggatggagaagaatgagaacaaagcaaagggggaagccccttataaaaccatcagatctcctgaaaacttactatcatgagaatatgatgggggaaactgcccccaggattcaattacctccctctgggtctctctcaccacatgtgggaattatgggaactacaattcaacatgagatttgggagggaacacagccaaaccatatcaccttttttgtctctttttatagtttttgtcttgaaatctattttgtctaatatgagtatagctactcctgctcttttttgatttctgttgtcatggaatatctttttccatccctttatttacatagtttatatgtaaagtgtgcttttttcacttcaaaggttaagtgtgcttcttgtaggcaacagatcattgggtcttgttttttcatctattcagccactctatgtctttagattgtagagtttaatccatttatactcaatgatattcttgataagtagaaatttaccctgccattttgttatttgttttctggttgttttgtggtcttctcttccttatttccttcctttctgtcttccttttagtgaaggtgattttctctgttggtatgatttaatttcttcctttttattttcttgtgtacctgttgtttgtttttttgatttgatgttaccatgaaacttgcaaatactttcttataacccattattttaaactggtgataacaatgattgtataacaaacatgtaaaaagaaagaaaactaataaaaactctacactttaacttcatccccctgttttttaagttttattgtatttgtatcttattaaactatgtttgaaaagttgtagtagttattattttttattagttcatcatttagtttttgtacttaagagagaagaaacttacacaccatgaaagcaatgttataatattctgagttattctgtgtgcttactcttatcagtgagttttctactttcagatgatttcttcttgttcattaatatccttttttctttcagattgaaagactccctttagcatttcttatagggcaggcttgatgttagtgaaatccctcagcttttgtttgtctgggaaagtttttatttatccttcatgcttgaaggatatacaccagatctactattctagggtcaaatatttttttccttcagcaacattctacccttatgtctctctctacctcctctttaaggccaataactcttagatttgtgtgttttctgaatcttgtagggatgcttcattattttttattcttttttctcttgtcttttcagtgtgttttcaaatatcctgtttttaagctcactaattctttctctgcttggtcagttctgctattaagagactctgatgcattattcagtacgtcaattgcacttttcaactctagaatttctgcttgattctttttaattatttcaatctctttgctaaatttataccataggattctttttttttttttttttttttttgagatggagtcttactctgtcactcaggctggagtgcagtggcacaatctcggctcaccacaacctctgcctcccaggttcaagcaattcttctgcctcagcctcccaagtagctgggattataggcacccaccaccacacctggataatatttgtgtttttagtagagagggggttttgttggccaaactggtcttgaactccagacttcaggtgatctgcccaccttggcctcccaaagtgctgggattacaggtgtgagccaccatgcccagcctatcccatagaattctaaatttcttctgtgtattatcttgaattttctttgagtttcctcaaaacagctattttgaattctccgtctgagaggtcacacatctctgtttctccaggattggtccctggtggcttatttagtttgtttgattaggtcatgttttcctgaaggatcctaatgattgtagatgttccttggtgtctgagcattgaagagtttagatatttattgtagtcatcacagtctaggcttctttttacccatccttcttgaggaggatttccaggtatttgaagggacttgggccccaagtccaataatttcatagtatttgcagacttgcgaaggtaattccttggtggttttggataagatctggaagaattatctggattaccaggcagagactcttgttctttttccttactttatcccaaacacatggagtctctctctttgctgagccatttggaactaggaatgtggtgaagtaagcagcctgtggccaccaccactgaaagtatgctgggtcagatctgaacccagcagagcactgagtcttgcccaaggcctgctgtaaccactactgagatgtcacctatgttcacttaaggccctagggctctatgatcagcagatagcaaaagccagccaggtttgtgtcctttccttcagagtggcaaattcccctaggcccttgatgggtccggagatgctgtctaggagccagggcttagagtcaaaaaccttagaagtttgcctgatgttctattctactgcagctaagctggcactcaaaccacaatataaaatccttcccactctttcttccctttttcacagccagagaagcctctccctgtggccacgaccaccagtggcccatggggagttctaccaggccactaacaatgttcacttaaagaccaacatctcttcagtcagcttgtggtgaatgctgccaggcctgtgggctcttttctgcttcagagtaggtccagaaatgctatccaagggcctaggcctggaatcagtccatggttctctgtgtgctgttgtttcttgtggatgcacatctatgtctttgctttgaaggattagttattcgttccagtcttctctgttcagtttgtttgtttgtttgttttattggatagatttgcttacaggttctttactgcccagtcactgactcctttttggctctaggtgcaccttaagcctatgtttgcctcagctctagtaaacaatcagagagctgcctttcctgaatgagggaggtcccccaaaaaatattctggcagtgtgggaggctggctagcagttcatgcccaggggcctgtgggacaaacctcctacagcacagggctgctgaataaccatagaaatgtggcatcttctttggctgagttacagagcagagtttccagggctggaaatgggagtcctgcctatccactttgtctctgcttgtcctcaaggatatttcttccttcaggcattcatgatgctttttgtcagttaaggtagggacagttctcctgccagggaaccaaagatggtggagaagctggttgtacacctcagtttcactttttttactatagaaaaagtgagtttgggggacatttttcacacacttggttacagggagaaagtagggaggggcatcatgaatgtggaagtctaattctcttactgtccactcagttattttcacctttctgtggccccagggagtatctcaagttcatatttgagttctgggatatttctggtaacaatcttggtgctgtatatttagtttgggttttctgttatgggggatggggaaggtaaagccagattgcttctatgacaccattttgattttggaattggaagtcacttattccttttacttaactctattttcgtacccattaaccagcttcttttgattcccctgtcctgcctacacttcctagcctccagtaaccatattctactctctaccttcatgagatcaactatctcagcaaccatatatgaatgagaacatagggtatttgtttttctttgcctggcttatttcacttaacaaaatgtcctccaggtctatccatgttgctgcaaatgacagaatctcatcttttatggctaaataatcttccattatgcatgtataccatattttctctatccattcatccattgatggacacttagaaatgcagaatcttgtccactattcacagtagccaagttatggaatcaacctaacaagctcctggtggtacagatactgatgattcctgggccatattttgagcagcaagtatttaaaatacagtagtacctgaatgcctctaagtcagaataaaagaaaaaaataataaaatacaatagtaggctgtagagttcagatctgtgattttcaaagtagggttcacagtcagacataggcagtgaggatccttttatggtgcaaataaagtataacttaatatattttaattttcatacactaataaatgctgcttagtagcaggagttcctactgagaagatccaattaccttgcagtgcttggtaattacgtaaaatgtgttcattcattcaacaactgctattaagcattgtctgtgtgtgaggcactgatgtcgtcactgggagtgacatctgaacaaaacaaacaaaaactccctgctgtcatagagattacattttagcagagaaaaatataataagatatgcatgtagttggaattcctatatgtttaggaaaatatacttttttttttttttgagacagagtcttacttcatcacccagcctggagtgcagaggcacaatcttggctcactgcaacttctgcctcctgagttcaagccagcctcccaagtaactggaattacaggagcataccactatactcggctaattttttgtatttttagtagagacatggtttcaccatgttggccaggctggtctcaaattcctggactcaagtgatctgcctgcctcagccatccaaagtgctgagaattacaggtgcaagccaccataaccagctcttttgtgatattctttctaaacatctagatctgtatgaagaaagaatacagaggaaataacaaatactagttaatatattaatgatagaaagtattacctcatcaagatgtagagagctcttgcacatgcattgcctgagtatcagatatagaagctgaaaaaaatgtgatatatagtacaaaactatccagtcaatgatgagcaaaacataaaggaggcatgcttccaacatattgaaaataaaatgtatcaagtaaatgtatcttttctaaatatttttatttagagaataaaatcatgctgctaataaagacatacccaacactgggtaatttattttaaaaaaaaaaagaggtttaatagattcacagttccacatgacttgggggacctcacaagcatgacggaatgcaaaggaggagaaaggcatgtcttacatggtggctggcaaaagagagagcatgtgcaggggaactgcccatttcaaaaccattagatatcatgagaattattcactatcatgagaatagtataggaaaaattcaccccccatgattcaattacctcccaccctgtccctcccatgacacatggggattattacagttcaaggtgagattcaggtggaggacacagagccaaaccatatcaactcctattcccataagcctcaataatgtttaaagtgatacaaatgccctataatctaaagaaaaatagaagcgtagaaaatttcataagaaaattttggccaggcatagtgacttacaattgtaatctgagcaatttgggaggcttaagtgggagaattgcttgagcccaggagttggagactagactaggcaacatagggagacccccacctctacaaagaaaaaaacaattaaaaaattagccagctttgtggcacgcacctgtagttccagctcctcaagatgctgaggtgggaagattgcttgagcctagcaggtcaagtttgcagtgagcagggatcacaccactgcactccagcctgaggtatggagtgagattctgtctcaagaaaaaaaaattgtaagaaaatttgaaataagcagaaatggttatggttatttttaatagaaattatgcattgtttagagcacactcttccaagttattcgatgtaagcctttcatcaccattgagctattttaaacttttaaaagttgtaggtgactgatagcaaagcaaaataattgtctatgcataattctagtctatggatatgcaataaattgtgtctagtggaggttcaattaacttcccttccccatgatagaaagtcagttttgcaaccacttgcaaattcatttcaatattcttgatatataagtgtcttcattctttgggttctctctcgaatcagttgaaaaagtttttccaattctctcatttaattaatgagttgaaatctttgacatctgttcattttatattcataggagtcatgatgttacttttttggaaaattatcttttacagatttatgaaacaaaacacatcaccattttcaagttgaaaagaagcttcaatttttacataaattgaatctaatcattcaattaaatttaagtgaatttacatattcctattatatattccaagcatagcactcttgtatgaaagcattaatccctggatagatggactgacagctcaaggtcattaaatacactgtttttccatagtgtccccagttttgataacttctggctggaaagttttccaggctagctgtttcagggctagggaaatctgggataaagtcatagagaatgtgaattcatttgtcttgctttgtaaattaaaagtcaagattgacagtaatgtaattttaaaaataattgcttgatgacaattcaatagctattatacctgaataataattttacaatttacatgtcacaaataagtgaagaaaaagaaatacaccctccagcccaattcttcacatttgaaaaaatagacttcattaaaattagaaacttctaagaaagacattattaagataatgaaaagatatgccataaacttggagaaaatatttggaaaacgtatacctgataaagcacttgtatttggaatatataaagaactctaaaaactcaacaatatgaaaataaacaatccaactaaaaaatgcagaaaagatccaaacagatatctcaccaaagaagacatacagaaggcaaatatgcatacaaaaagaagttcaacatcatatctatagagaattacaaattcaaacaacaataaaatatcactacacacctgttagaatgggtaaaatcaacaccaaatgctgacaagcatgtgaaatgatagtaggtctcactcactgcttgtggtgtaaaatggttctgcaatttggaagataggtttgcagttatccagaagctcaaattatgtctataaatatttcatatgtaatattcaactctcaataaaaaatttccaggtatatgaagaaacaaaaggttataaacaaaagcttattaaaacgaagagaaacaacagacagtagaaacagacaagttgggagtacagatggtgggtttttaaatattcatgcttaatatgctcaagaaataaatgaaaaaattgtaaatgttagtagaaaactgaaaattttaaggaaaaaacaaatggaaattctagaactgaaaaatacaattgatattaagaagtcagtggatagattttacagatatagttaaataaatagtgaactgtaagatacatcagaagagaatattcagaatgaagaagagcaataaatagcaaaaaacataagagacatagagataaaaatagaaggtacaagtaattggagtctgatgtgcttggctctgtgtccccacccaaattccatgtagaattgtaattcccatgtgatgaaggaggagcctagtgagaggtaactgaatcgtgggggcagacttcctccttgctgttctcatgatgcagctctcatgagatctggttgtttaaaagtgcacatcacttccccctttactctctctctcctgctctaccatgtgaagaaggtgcttgcttagcctttgcccttcttccatgattatgtttcctgaggcctctccaaccatgcttccgctacagtctgcaaaactttgagtcaattatacctcttttcttcataaattgccccgtctcaggtagttctttatgtcagtgtgagaatggactaatacagagtcatagaagaagaggagagtgaaaaaaaatcacaagaagaggagattgagaaaaaaataagaagaggagagtgagaaaaaaacaataaagaaataatttcttgaacccgggaggcagaggttgcagtgagccaagatcaggccactgcactccagcctgggtgacagagcgagactccatctccaaaataaaaaataaaacaaaaaacaatggttgagaattttccaaaactaatgaaagacattaacccacagaatcaaagagctgtattcaatctaagaaggaataaaacacaaacagtaacacttctaagtgcatttttttttgctaaaaaaataaaaaaacaaaaaacagaaaatattttttaaaaaaaagtcagaagggacctcaacaaaatactagcaaaccaaagtcagcagctaatgaaaaggattatacactatgactaagtgggatttgttcctggagggtgttcaaaatacaaaaatcaaacaatgtaatataccatattaatagaatgaagataaaaatctcacatgttcatcttaactgatggaaattaagcactcaacaaaattaaataccccttactgatataaattactcaacataataaagcctacacagtagatattacttgtattggttcatgttttatacagtcagtgtttatttgtataccaatttcatttttcactgttcctctttcttctcaaacttcctttctggatttaattttttcttcctggaattcgtccttgagaattcctttagtaaggcccattgatgttaaactctttccaagttttgtttttatgaaaaatatattttgctctcatttgtgaaaaacttacatgattctatgttgaattattttgtctcagcatgtagaagataccattctactgtcttccatcttttgttattgctattgagaattctgctggtctaactgcttctttgaagttactctctttgactgtctacctcctttaagtaccttttaaactttcagattctgagttttactaaatgtatccagatggcattaaaaaatttttttctgccttgggtttcattgcatttcatgaatctccaaattcatgcccttctctctccttaaaaatttaccaatcctgaactattgctcaaataaatataatctctaaatatttcctatttcccattttatcaattctctccttttgaaaactccaattaatttttttattaaaccttctcattatatctgccatgtttctaaaactcctttcctagataatttcttcttgactatattctagttcactacttctctcttcatttgtatctaatgggctatttaactgttacactgattttttttctgaccataatttttaatttaggaagtctggttgaacataaaggaagcctatacactggaataaatatgaagctgctgcatatgattcttattccaaaataaggcctaatcagcattaggctgagatcttcattggtggcataagaagttcaaccacttgagtggacataatctccaaggtggaatggacctggtaatggactggatgacatgctggactttaggaatatccacaaatctgcatgaggtctctcctgctacaggccattggtgtggaagagaagatttttctaattgaggttgattatggaatgaaattaaagggtgggaaggaaaggttttcacatatgatcagagaacagagataccactgtgtggtcaccaacaaactttgtccccttcttcctctccctctctctcctacttttttctcttcctcctccttgtttggagaagcagttcaaagcagattcaccacttcttggggcagacatgagcataggcatcttacccaattgagttggatacttgcagttcaggtcatatttaaataatggttgggaaaacaaatagtgtggctccttctagtaggaacttcacctgcttttgtcttcgacactctttttcttgatcagcttttcctcctttatatatctttttacaatttgttcaatctctgttcaatttgcagaacagacaccacaccctcaatccaagaactgtgcagacattcctggaagttcaaatactcagctttcttcgtaaagcaaaatggatttgctccttgaccacattcatgcactttatttctagagggctctgtaaatcttattaaagttgatcttgtcctcaggcctaatcagcattaggccgaggtcttcattggcagcataagcagttcaaccacttgaacggacataaatctccaaggtgcaatggacctggtagtggatggcatgctggactttaggagtatccagatcctaagctgccacatctgttcccaggagaacagtcttccatacaggcaagccactccaggtatctgactctctgcttgtggtgcatgcgagtatgtagggtcagcagcatttaggactttgaggagcctagaaaggtgtgtgatgtaagagatgttgttggcaaacactaaggtgaggcctggatactgcatcaggaagtagtacaggtggaagtctttctcatcagtctcataatggatcttggtatctgtcagcaactccattgtgacttcattgcttgtgggggtcaatgaccttggacttgcccctcgtgccaaccttctgcatgagaaggtcgagtttggcagttttgtccattttcttggtgtgcttcttataaaggattcatgcagcagcttgatgtaccagcatcactgcgacacaaaaatccaagtgtctgtctctctgggttgtattgggagtcatgaacatctctagcaactgtgagagctcagcaaagtagcctttctcaatcatccagtcagccccatctaccaccaggcacctgaactgctgaaggctgctcaaatgaaggtgattttctttaaccagctcccacagtcagcttgaacggctgatcacaatatcaggctgacacctgagcatcctctgctatttgtgcatgaatatgccaccgaacaaaatagcagttttaattcccataaacttggctgcagcatcaaagggttattagacctggatggccagttcttaagtgggaatcaggaccagtccaagcaggtgatgttttagatgtcctttacaggtagcaactttgccattcaactcttgttttgacattccagtttgctctttatcaagcctttcctctttgtcctcatgccttgttaagggaagaaagttctttaccagcatcatcatcatagaagaacagcacctggtttgagggggaagctctggtctttgctctggccttgttgggtggtactctagccttagctcagcttcacaggggagtatttcactctcgattccagtctcatcaggcaacattcccgactcagttccagccttgcttagtgatccagtctcagctctggactcagttctgggctctccaggtggtatttagtgttacttggagttagggcaagcttactactccagcactgccaatactgcttgaatcactggaatgacaaagacaagagttttcccatatcctgtctcagcatccccaaggatgtctagtttgtcacagatgacaggtgtcaaagtcagggcttcttagactggtgtaggtgcagagaaacctagaaaacctgctgcttggagaatggcttggacataaaaagtccttcaagctgatacattcaccttctagtcaggcatcagtgtctttgctttttggggcacctttgggacagtgccatggggaggcttaattttttccctttttcttctcttttggaacaatctgggccgggctttctgatgccctctcctctcctctgggtcaggacaaatcataccatctccgatttggctctggttcagcatctttgacttcaaactctttctggacactaattccttcagtttccacatctttacttttcttcaacttgatcattttctttgaggagctacactttacttcctcctcttctcaaacagctggtgcctttttcttcttggatgcctcctttgagaagagactggaggaattcttggcagaggggaccaaccagtaatctcagttcctcaaagcataccacatcagccatctgtccacttacaaacatatttgggtctaccttcacttgcttccatttccccacaatcttgattcctttcatctgaaacttccaatagtttgatggttttgatcttgattttgtctccttcagcttcatggttgcatttggagatggttatcacagctccttcagatgctggctgcctcctccactgagttttaattatcatatttttcacttctaaaaattttgattccttttcaaatttctttatttttagtgcaaacttttcattaaattatgatacatagacaggccgggcacagtggctcatgcctgtaatcctagcactttgggaggctgaaatgggtggattgtctgagctcagaagtttgagaccagcctgggcaacatggcgaaaccccatctctactaaaaatacaaaacattagccagttatggtggcacatgcctgtagtctcagctattctggatgctgaggtatgagaatcgcttgaaccccagaggcggaggttgcagtgagctgagatcacatcactgtactccagcctggggaacagagcaaaactctgactcaaaaaaaaattatgacatacagaaaagtgcacacattatgaatatagcttgatgaattttcacaaagtgaacacatctatgtaaacctcacacagatcaagaaatggaacattcccagaaatccagaagttatcttgtgctctttctactcttctcatggtaagttttacatggttcagaactttatatacatctaatcatacagtaattcctcttttataatctacatctgataattccattatttgaaatacttaggatctaacttatttgttcattctattgactttttaaaaatttttggattttgagctcatgtatagagggagttctgtgaggaatcattccagggaagatcagtcttgtttcatccaagattcccaggaagttaccaactcagaattctttaagtcaacttctggcctcaggatttctagggcccaaacacaagttcaaactccactctacatgaatgtaagattatggttgcaaattctcaaggggacgtttttcatcttgagctaagtccttgaaaaccaaataaccttttaatttcctttgactaaggggtagattttctatctcttcctttcattgaaaatgtgatcatttgagaatcttggttttatgtaactgtcttagttccaactccctaccttacatgaaccaaagccttgtcacttgtcctctatttaacttaaaattaaaggtgtttctgcttaaccacaagatataatttagcagcaccaatgataatataaactgttatcatgagcttcctaatatgatgaatgagaaatatacattactaatgtaggagtttggctacaaatgtttaacctgaatctaataatgagaaaacagacaaatccagattatggcacatcctctaagacattgacaaatggcaatgttaaaaaagttcagaaattctctgcaaagacttaatgtttttcttcttaaaattcagatttgagaaataatttgtttaggatgtggtgtggaaggatagaacaatggccctcccaaagatgttcacatcctaatccctgaaacctgtgagtacattaaattacatggcaaggaggcattgagattgcagattgaattaaagttattaattagctgaccttgaaatacggagattatcctggattatctgagtgggcccaaggtcatcacaagggttcttaaaagggaaagagaagcagaagagacccaaagaaatgatattgtgagaggaacccagcctgatattgctggcttagaagaccaaagaatggagtcatgaaccaaggaatgtgatcgcctcaaaagctggaaaaaaaaacaaaaaacagattctctcctaaagactccctgccaacaccttgattttagctcagtgtgacttattttggacttctgacctctagacctgtaagataatttattcttttaagctaatacatttttgataatttgttatagaagcaataggaaattactaaaaattagatgtgagggagaagaaatcaccaaaaggattagtggaatggaggtgcaactcacagaaatggtgaagccctgtgatgaagccttcccaatgaggtttgggaaagaggaaatgaatttaattttgagcacaaacctgggacaagaggcagcctcatgaggggcacaaagcagcctctttcttattacagctctgcctctttcaagctgttccaacttggacaagatacataaaccccgtgtctcaatctctttgcctgaagtggggataataatagcaccctgataataataatgccctacttcatagggtattatatagaggaataaatgggataatttatgcaaggtctttttacttggcatgtgctcaaatgttggttaataatgatgatgatgatgatatagaagacacacttctgtgcagtgttttagtcaccacaggccactaaacaaccatgtttcatgactatatggtcagtataggaatgaagaatgtaaattaccttgcttccttgtttacgagggttgtcaactgtactatttaaaatattctagacgtgtgtatatatgcagatgcaacttcattcattttgaaaagtaattctgcctttattttgattagtttctttgggtgtaacttgttacttgctttctgcgccccacccccacccgccttctgtttttgttttttgagatggggtcttgtgatgttgcccaggctaatcttgaactccttggcccaagtgacccttccaccttccacctcagcctcccaagtagctgagattacaggtatgtgccaccatgcccagctgcattcatttttattttattttaatttatttatttagagacagtgtctcactctgttgcacaggctggagtgcagtggcgtgatctcggctcattgcaacctccacctcctggctcaagcgattctcctgcctcagcctcccaagtagctgagattacaggcatgtgccaccatgcccagctgcattcacttttaattttctttatttagagatggtgtgtcactctgtcacccaggctggagtgcagtggcacgatctcggctcactgtaacctccacctcccggctcaagcgattctcctgcctcagcctcccaagtagctgggattacaagcaccagccaccatgcctggctaattttttctatttttggtagagacagggtttcaccatgttggccagggtggtctcaaactcctgacctcaggtgatccacccaccttgccctcccaaagtgctgcaattacaggcgtgagccaccatgcccagccatgcattgatttttagaattgatattttgttcctcttttaagccagactttcgatttgcttttacaatatctatgcagctggcctaaagtccagtgagaatgttatcctctgagagcactggagctgggaaacaactgtgtccaatcctgtggcctggacctacagaagggtagaaagtgtacagctgcaggagatactaaaatgcaacttgcttaagtaggacttattatcactataccctctttccattaaaagctccatgtccttctagggctgtgcttaaaagactacattttctccttgaaaatagagctcctccaccctggggtaaagggcaggtatgtacacatttctggaagtgagtttatcctagttgctaattaaacacaaagtttgacaaggtgcttgtcctaaaagagctcaaagtctggtggaagactggcactcaaacaattaacaaacaatgatataaaaagtttgtttcaagaagaatgagaccaagtgcttcactttaactggggagacccatggaacaagggtggcagcatgacaaagcgcaatcctccagagggaagtgtaaaccaaagtcctctggtaaatgggaggtctgtttcccaattcctatccactactttgttatgtattaaacttactccattttccaaaaagtatatagaataaagtgactctcaatcagttagaacccaaggttgtaaaagaatgctatttttcaactctggatggaaagatcttactgacgaacctctgggctgtttccagtttggggttattttgaataacctgccatgaacattcatctacaagtctttgtgaacatgtttttattcatctcaaataaacacctaagagtagaatttcctggtcaaggacacgtgtacgtttagtttaaaacttttattagcaggtactcaacagagatgaagtgagattgtttaaaaacatgttggctaaaatgaaaagattttttctttttgtgatcacatcaggtatctgccaaggatagcaattttacttaaattttttttaaaaaacttttactataatttccaaaactggaatctcctctaaatcaaggagaatgtcttaactgacatgtgagagagctattcatttgtaaactgttgctctactggatccactctgccatgttgtgccattattaacatcctatttcatacctctttttaactgagtcctctgctcttcgacatagaatgattgtttggttggggaaacttgtcataaaagaaattcaaactattggcaaaatcctaggatgtaccctatcaaaagctttttgttgatcacctccctcccctatcaaaaaactttttttccaggtcaaaaatagtcctttcattctgaaggagaaacttctttaccggtcaccttagtaatattctaggattttatccttcctgctcttatttctaagacatttgcttgcaacctaagtagcctgtgatgcaggatctccaaagtgtttctttccctgttaactttaatgagttaactcattaaacactccaacagagcaatgccaaattatctaaactggtaacagataccgctaatccaaacattaaccaactgcctgtagaaattgaggctataggctgggcgtggtggctcatacctgtaatcccagcactttgggaggctgaggcaggtggatcacgaggtcaggagtttgagaccagcctggccaacatagtgaaaccccatctctactaaaaatacaaaaattagccgggcatggtggcacgcacctgtagtcccagctactcgggaggctgaggaaggagaatcacttgaacctgggaggcggaggttgtggtgagccgagattgcaccgctgcactccagcctgggggacagagcaagactccgtcacaaaaaaaaagaataaaaaaaagaaaaaactgaggttataacccacatgtgttagaacaaggacttaggatgccatccgcagggcacttttgagactagactggcaaaccaccaaagctgagatgtcagggcccctgtaggctttatttgcatatgtcttagtacgttcttaacctttgattagagggtggaaaataaaagatttaacttgccaaccaaaactttcagcaacgtagaatactgaagtcagattctgtctgttggaaaactagaaagaagactcctggtttaaacagggattctagaaagtcagaaaggagacactgtgctattaactgaaatggacacaggcatgatttcctatgttacagtacctgccatcagaaaatctcagtaccctttatgagaaggccctgagaaaaagcttttttgtaattggaaagaaattataagatagaaggcagaattctccatgttttagtcaaagattctcctgtgcatttatacaaagctttcacctaaaagtcaagacagcacattcttgtcattgagaattcagaatagagagtctgaaagtacaaatacattcttatactaacattaggctcttagaggacataaatctttttataaaaaatttatttctctgtaaatacaaattccaacatcaacaaacaatagtccagtggaaaaatactagccattaacattgaaaacttttttcttaatttaataaatagaactttggcattcaaaattctagctgtaaaccctattaaaaaacagaacaacaagaagaaaacccctttacaaaaaaagaggcaagaatgatagatcagaaggcataagccaaccagtggcttcacattctttttttttttttttaaacaataactgtatttcaattaagtcatgaacactgtatttacacatgaggtattctgggtggttcaaaaactgaacccagcttacaaaaccaccagtcatagtgactgattatacactgtgctgtgctttttaatgtaaccacctagcaccttactacttcttgtcatcacaacaatgcgatgttaagttttatgtttatgtatttaactatttatacatatatgtacatatacatacacaccaatgaatacaatctaaaggagtttccagctcactacacagggaaggctgggctccaaagacatctatctgataattcccctcatgtttactaaggtatccacctagtaacaaaaaacggctccttgctttaaaaaaaaaaattccttaatcaagtttatatacagaagaacaaggtgcaataatcatcaacattcttagaactcatgtaaaatagaaataaatgcttactgcaggcaaaaaggcacaaaaggttctctctgtgtacagctgcaatagtgttattagacttgctgatttaaaactatattcttatatttagcacttttttaaataagaaaaaaaatccaaaatctttcccatacatgattaaatatatgatataatcatatggcaatatgccacccatggcattttggggcaaagttggaaattttgctctttataccaaataggaaattgttcctgttgttttgtgaacatgaattgtcaaaaatggaaacatggcagtttcaaatgatatagtctgagtgagcatggttatgaaaattgcttattaccataattacatatctacaatgatataattcctacgtaagagaatgccaataatccaaactaaaggtgtgcctaagctgaactatgctgtgaaaatatagtccatgttcttagctactatgttacttaatgaactattactgatatttaaagaacattttcccaattaagtagctcctttaaaaacatcctctaagaaattaataattcttgcactatgaaagaattactttataagctccttagtatatcagaaatgtatgacattcattttagcaacactttccagcccttgagattgtctctacaacaagctattgaaagaagtctaattaggtttaataaactgtcaccaccaaaataaatttcactaaaatataatactgttagcattaaatattgaatcctaggtgccacacttcttttaaaatgacctcaggaatatcttacctagccagtatttgtggttttttgtttttgtttaattagaggccactgaaaattaatagttcaaattaagccattttacttttctgagctcaagtgaaaagatagctattgtgcctttgattcagtgaattttatctgtacaggcaatttgggtctttcattgagtcaactgttactttatgcttgctgtaatgtgattgaggctgaataagctcaactttaaaacccaaaagaacaaaatattaatactggataagatactttctaagcaaacaagtgttggattcacaaaaagcacaattaaaacgaggtttcattatctaagtaaattttcaaatagattcactttaaaatttaggttaattttcatttcaggaatatattggtgtcataacttccacgaacatcctagttcaaactgggtgagatgctctagtgttgctatttgcccatcttatttggtctaacagtaaaatctgtttttaatgtgatacagaagaggatattctaatacaagagggtgtcctgggaaaggaaaattttctgaaaaataaaaatcaaaaagtaaatactgacaaactagatagaatactattagtttcaattcccccacaaaatccctccaagtctatctactgtttatgtaggcccctttacaaactccagattttaagaggatcaatctataattcagctaactacttaaactagcacatcttaactcccttttttatggggggagggtacagattttggaaactgaaatgcatcagcagtagttttgttaacttcctactaagtcagaaattttttaactttggaattttatttttaagatacgtgaattaaattactttctctaagttttagaaagctaacttacaaataaattattttatccccaactaagccaaaaaacaaaaacgtatctatagtagattaaaacaaactgtaacgtctgcttaaaaaaaaaaaaataaataaacccataaaatcccaaaacatacactaaaaatctaggagagatatttaagtaagaacctactggtccaattagtgattgtttgccaatttgttctattattttaggaagcctttatttctaaaatcatgggggagggtggttgggattctattcaaagagagtgtaaaaatatttgctgcacttgtggctgatctattttagacgttattatctgttttaccataaaggaccaaggcagaattcttcgcatcacatttttggtggaaatttactataccctgattatcgtcaagctactaatgttaaaaaccaagtgaatataattagaaagccaagttcttaccagtgactaagaccctccttaggttaaggactctgggatgcaggagcactacaatgtacttactgatttcttagtgcccagattctcagaagtaagaagagcaggaaggactcagacaccaaacagaaggaaaatctgatttctttacagtgtattataactgattattcaactataactataaaataatctattgagagctgtatagccaacattttaaactgtgtatcttcctgggtagtctccttgaaggccttgtctcacattttcacttttaaatatttaagaaaaatctttcctaggagagcctttattctagtatataagaaaacaggcatgtgctatgccctttatctggcaagaaaacaggcatgtgatatgctctttatcaaatcaatattatcctgcttgagtcacaccctctacccctccatctcttatttagtcttgacctaaatgagacttggttgcatcacaagatcaaaccaacttacaaaggacaaggctttcgccaaaactaagtatattcaaaagaacataatcaatgctgaaggcaataaaatgtataatccttccaaaataccaacagaaacatggacaacactcatttggaagtttaaatgactgtacgtctactgcaaaatcaactgcatttcatagtaataccctgtaattcagattaagaactaatttcgccaagttcatatcctgtgaaaaactgttgttaatgtactttaacaaaagggattaaaatacaatctcaattaaaaaatgtttatgctactgttgattcagatataaatagtattggctttctcttacagtagtttcaactttgaaacatacaaaactgttaaaatgtaaatgttgagatttggataagtaagctattgttccagggtaactttgttaatcttccttttataataatgatccaatgcctttattaattatatatggctttgtttacatttatatatgtatatatataaaacatataaataaaaaattgtaaatagtaaggaacatgttaaaattagttcaagttatgttaacctttcttgtaacacatacattacaatgctaaggaaaaagagcatcacgtcaaaatttcacacctcttgggaaatccacaatcactctggaaaaacagctgacctatctacagtactaaaatcagctcaaccacaaacatcctatcagtgcagtaagtgttcaaaatataaatggttttgcctcctgtactaccatgacaacacttgcctgctgtttgaactcttgttcagccagccactgaaaatcccaaagtacaacacaagcttctatatgaaagaaatataagaataaacagcgtgtgcctttctcagaagctctgctctgaccctagaaacccttataaatttgtgaataaagcacgtgcacacacacacaacaacacacatacatgcacacacaaacacacaaagctataggattaaaaggaatcctactccttcatgtgaagggtactcttcacagcttggtcctacaatcagtagtttgagaatatagacatttttttccttgtagattttatcatattttccaaaggtaatttgattttttttctttttgcctgattagataagccccttcaaaatctcttcacttcccttctccccttcaacaaaacaaatccacagaaaaaaaatccctaagtgcaagtcatgtcacttgcaaccttccattatggctccataacacagcagcatttaaacaacaggtcattattgctgtgggactaacacttgatcactgagtaatgcagttgtctcccatgtcctgagcatagcggtctgatattgtagtccttaattcatcaatgtctcttcgtaactggcacacatctgacagctttttagtgagtgtttctgtgctgtggtcattctcagtctcttcagctgaacagttcattgctgtgtaaataaaacatagagagaatatctcacatttttttgaacaaagacattttagaatttttcaccttaatcatcatggaaatacagtgctacacactgaataccagtgaggctcaggttcaagttatgtttaaatcatgcatcattcaatattaaacagatcttatccacttggtcctttataaatttcacaaattaaactgaattaaatgcacacagtgatacacacaaattcagcatgtttaatgggtaacaatattccaaaagtgaaaaaaagcatactctaatgtctctcttcaagctcaactagagcactcagtttttcccatttggcaaaatctgaagaccatttgtgtagtaagaggtggtatcttacatatttacgactgcaaagtgggtttactgccatgaaaatattaattttcaaatacatagtaagtgtcacacacacacacagagggagagcggggagggaaaatgagagagacagagagggagaggaagagggagaggaagagtgaaagctgggaccctacaatcccaaacaatttaatcaggctgatagctggttgcctaatggctgaataactgagggccttgagtcagccagcttttagttatttacttcagttcttctctttgtaagcatatctcaacataaaatcaggcagagccagtgattacaaaagaaacctctccttataccttcatagtagtttattgtaggcataagagtcagtgagtgactgttattttaacaaatgttaactgaacatctgccatgatataggaactatgttagatgttgaagtcagaaaaggaacagacacagtggcttgttctcgatgctttacatacaatttcataaacaaatgaacacagtgaggtactgtgggtaacctaccactatatacaagttgcagtggcataaaaaaacaaacaactagtcctaactggagaggtaacagttgcttgttcactgggttggccaaactgcaaaatgaacaaaagtggagtcagaaagcaaaacagtatgatagaatttgagaaacctcaagaaaatcagtatctagctctaaaatggtagagtacaaactgtgacaaaggagagtaccaagaaataaggctatagaggtaggtagtagctacctatcttgaccacagagcagtgtaggcattaggaaaccaggttcatagtttagacagatctgtctggcaacaatgtaaaatggattagggggaggggatgagaaagatggttgtcagagagaccagtataggtgacgggttatgaaaacttaaattaaggcaatagtgcaatggagatagaagggcaggaatgttagatgtagtaagcagatgacagaactgatagcactcaatcatcatcaacttgagtgatgggcagggattgggcacaggcgccagatgaaggaaaaagcagagtggagaataaattctgggttcaagtgacaggtgaatggtggtgttactcactgagaagaggaaccggttcagggagggaaggaaagtgtgttctggttttgaatgtgtagagtctgtgatgcatttgaaatagccagttctaatatacatgggaatataatctggagcccagaggagataaatgtctgggtaaaggagataaatgtctaggtgaaaggtatggcagtaacagaaaaaacaggagtggataagatcactcagataaagtactgaataaaaagaaacaaacacaaaaccagtaacaaaaggcttctggggataccaataattaagtggcagagaagtccacagaagacagagactgagcagtcataaaggcagaagcagaacctagagaatgatgtcatggaaaccaaggtagtgcacagttttcagaaggacagggtgagtaaatggagccatgaagtgactggtttttcacaaatcaactggctggtaaaactttcacaatgccaaatataaggtaaggattctggggtcaaactttaaagactagaaggagtattgggaggtgggcgtggtaagattcacattaggatagctctactactctattactgaaaaacttaacaaatgctaccttatgacagtgaaaatgtaggagactctaaagtaattaaaagggtgaccaactctaaaatcatgaagaaagtgagttccctttgtgtgtgagctttgcttcttgctcccaagagatattaaagcactccatgttcaccaggcaaacttctcctcttcctcgtctgagagcgacactgaacaccaactactctgtggagtctccacagcccttcccacgtagatttagttgtttttttcctcttgtgctcccactgtcctttgtccacatctcaactatagcacctatcagaatgctctaataatttggttaatgtgtggacaaggactgtgttcaggttatctgcattaccagcacttacttagtgtctggaccatagaaggcatctgataaatgtttactccgtgagtgaatatacttaaacattatgtgttttttcgatatccacatttgtgtatgtgtacaaatgtctatgaaatgaaagggacatagttgagcacagataatgtttcatttaacaagtgatatactttggtcaagagcattatttgatttgccaaaataactattatgatgcaaaatggtggaatctttttgatgaaactagaaacaaaatcagtttgtttgaaacaaaaccagtattattaaccataatattaggcagctactaaatacacgttggcccataaaccttattatatggtcttactgcattcctatttccttccaagttcatttcttctctattataaagagactaacatcctgatttggaaccacgtacagagatgagcgtttctgcaaaagtagcacagaaagaaagggacactaggattattactgtggcagctcccacaattatgtgtggaggaagacagaattgaggccaagagtgaatgggtgtcacattaagccagcaggtacgcatgacaaaggcaacagatttgtaggctgtgaaaactggctcatgtgaaatcactggcactcacgtgaagcagctgccatagaacatatactgcactggaaagcaaaaatatttctcaaatattttaccagtggacaatatggttgggtcacttaatctatacaactaacacatgaaagcaaatagaaggaatcattatttttggaagagaaaatgggaagtcacacctaactaccactctattcacatatttacagattcaacataggaaacatcaccaggcattctaccaagtggcagttaatgtcagctataaccctactcacttcttgcaatgaagtaataacaggtatacataaacccacagactgattctaagtaggaaaagagattacaaaaataaacagagaaaaggcagtcggaagttcctgattcatgaagataggtttctaattgccacaaaataaggacaagtcatcagacacttacatcttattcccagtaataatgaaagattaggctccttgccctgagcacgctgattaagaatactacacaatgctttcaagtcaaacaaacaacaggacatttccttgaacagctgatcaatcacagtcaaatcaaatagtggccgtttggaaagaactgtctgctgcctagattggtcaggttcctggccctgatccaataaagagcatgtctcatctgtttgtctttggttctgcaaggataaagaaaacaaacatcagattgttagaacagaggaaaggtactcaaagccatacaggttaacattctcccccaagtctataaacaaaacgatggagtcatattatatgcacattaaccaaattcaactacatatatgcagtgggaaaaaaaacacatagaaaaataacaatttaaatagtggaaattgtttctctgtgccatctgatgctttagcgtatatccaagggaggaaacataaatccagtctcagtttctaggagtctctcacgtaataagcatgttggttgtgtatgtatttttcttttttgggcctcaatctgtcacccaggctggagtacagtggcgcaatcatgactcactactgcagccttgacctcctcgggctctggtgatcctcccacctcagcctcctgaatatctgggaccacaggtaaacaccatgatgcctggctaatttttgcattttttgtagagagagggttttgtcacattgcctaagctggtctcaaactcctggggtgaagtgatctgcccacctcaggttcccaaaacaaagtattaggattacaggtgtgagccaccatacccagcctgtatttttctataatgagatttattccaaggataaaaagaactaaaaagtaactttgaacctcactctgtggtttttattgttagtagcaatagtggtttaattactttgaaactactttttgcatattggtggggggaagcatctatgttaatgttgataggaaccacaaacttcggtgcgagagacaaagaaataacaagtataaaatcaaagaagaagaaaaaaagaaaaaaccaacaactctgaattgctgatccccaaaactgctaccttcttatcttgaaaactgctaattaaaggtaactttaattagctttccaattggaactgtatttcagaataactcaatagcctggggtgattggaaaaaaacttttttatagatgaatgccagctaataaatataataaatatatactgtactataattatgtgaaactgtattctaaaacacaaaataaataaaggtttgtctttttataataattttggtaagaaacaatggaattaattaacaggcatatcaaaatcatgtctttaatctgaaaatgctctattaatatctataaaataagcattttatagtgaatcatcctttcaaagcaaaattgaatttcttctactcacttcaagcaatgcttttgttaatctctgtacatttctttctttcttttccagctcttccatcatcttttgagtggtcagtttctctttagaaagctttccttgcatagactagaatttttaaaaaaattggaaagcaaaacaggttaacatgtaaagaaaaatctcaaacagaaagaagtaggaatgttggctctgaatactttaaatcttctttcctccccatccccttggaagatgaagccttcacttttaaactaatccctatcagttagagagtggctgaatccaaataaaaaagaaaaagaaatgctggtttcccagaatacatttggatttttttaaattacagtttttaccaaggaagtttttaatttgtataaaacatgtcaaatctgaagttcctacttaatatggtattacaaacagttcttatttcattaactttttatatgtagagagtgtattagcaacaaatctatatttttgttttacattttgcttacagttaatgagatgcaagataataagatcatgatatcatccctattttctatcatttgaaacatagctcccgtctttcattgtatagtaatccaagcagtgaatatactgtgaactctgggtcaaaggtctattatgggaatttgataagctaatctccttcttactccttataaaattgcaaattacctagacatgacactattgtgagtacgccaaagcagcataaaggacattttgagtctttggttagtcttttcaccaatatattaaaagaaaaaattgccatacaccctgtagttattagtgaattctaagtgtttctatcaactattttccttttattagaccacaaaatcaataaacatatgaccagaagagaggttatcattttatttcaggtctgtatttagtctcaattctgacaatacttcagtttgctgaccacctaaatagcacacaatctactataaagatattttcctcacattatctttggatggagtaaaaaaagatagctatcaccatgggttgaaataagactccataaatataaagcagttttatcagtaacagatactcaaacttgttgcttttaaatttcatttgtctgctaaactctgaaaaaaatattacatttagtaactcagaagttggacagaaatgaatcaaactctataacaagtgtttctccttctagggaaaagttgttttatattccacaaaaatgaaaaaaaaaaaagcaccaagtcaacaaggggctctctgaatacgtgtattattgaaaactgaaatttcctttgtaacttcattagattgactcaaatcttatttgattaaatgaacatggagagttatttacctagctgaagatctatcctttctggcctaacaagattatttggctggaatccagaattcaacctaaattttctcaagatttgtgacggtttattagaattacagaagaagggcatcatagacacactactcaaactcacattctaacaaaaaaaaaactaaactcgaggggtgttttcacaatataattattatatataacagaataattataataatgatacattgtaacagaatacagtcctttaaaagataagagttttatatttttaccaattcagagtcatgttgaatgtgactaataattagctaataaatccaactaatatgtccctatgtaagactgattttaatcagtgcagaaacaggcaatcttctccatcagaaaaactgaaaatgtctggcagtattgccatttatcacaaaaaggaaaatcagatttctcatatgttgcttgagttgaagggcagttatcaagaagcactttaataggtaaaagacattgcagataggcttatcctgaaaggaccaagtgctgtacaaattggtctaggataatactaggtatgagtgctatagttgtctgacagtaacatttcacctaaaacattaattacttctctatcctaaattgtattaagatatgtttaaaagataacaagaaaaattctatcaagaatactgtgcgttattttataaatactttttgcagagcatttttttgaaatctcttaagctcttaaaatatacttgctcaaactggtagtactttacaatgcataaatgaaatatctcatattttctgaaacgagtgtttggccttgtgaattttacaataactatttatcattcactagacatgtaggggattaataaaattaaaaattaatttgcaaacacctacaacagctctcaaattctcagtttaatcatgacatttaaaaattctgccaaggtactaacctacaaggtctttataatgatcatgtttgaagttgaacagtggaaataagcacatttgttgttttaacgtaagtatccagaaatgccccatttacaaatagcttgaatgagggaaaaccaggtgtgccttagtccagattctatataatccccaaacccaatttaaaaggaactattttgaaagaaaatttatgttaacatttttactgcatatatacacacataaacatgcataccatataagaaattcacagggacattccttcatgcaaaaatcattgccaaacactgttctgttcattgagtgatacatcagtgaacaaacagtcaaaactcttggcctttgtggaactttactaggagaaaaaagaccaaaagaaataaaataaatatgcaagttacacagtatcatgtattagaatttgactagtgctgtggagaacagagcacagtaagggtcaggagactgaaatctcaggtaagcaagggcctgaaggaagtgagagattgtgtcccagagatatccagagttcctatcagtacaaaggttctgggacagatggtgtcttctgtgtttgagaaaaagcaagagagccaggatggctgagaatagtaggagaaagagtcagagaaggaagacagcatgcagaacagattgtatagggcctcagaaatcagtataagaactttgatttttattctggaaaaaaaaaatgaggatccactgaagagttctgagcagagacatgatgtaatctgatttttgttcaaaaggatcacttaacctaatgagagtatactgtgcacaggcaagggtagaagcatgaagaaataacccagatgagaaagggagacagcttggaacagggtggcaatggaggaggcaaggagaagaggtcagattctagacatactttcaaggtagtagaatttgctgtcaaatgtgaggtaagtgaggagtcaaggataaatctaggatacctggactgaacaaatggaagggcagagatgccattaataggaaatctgaaatgtatagcagggtgtttattttggtggtggggagataagaaataaaaaaaagagccttttttaatgtttctaagaatctaagacaatgtacagctcgaattcctttcttaaattagttatcatcttgtaacttgataaaactttaaaaacaatctgcctggagttttgcttctagcatgacagtgtgaggagctccacagacctaccactcaatgaaattggtgaatattataattaaaaatttctggaaatggtcctaagagcatatagcaaatgaagaaacattactcaaggaaatctactaaaactcagtaagaagagtaagagactggtatttgaaataaaactctgcttcacgaaaggattctagagtagaaaaatgaaacaaaactcaactccatctctgacttctcacatctcattgggatggaaattctacttcagactgacagagccaataacacacggctccctctcctcccagaccctagttagacagttctctttccagaaaagatagggcatcaacatttatcatcctagcaaaggctgttttaggcaagtgcaaccaagagatggggggctcccttcttctacctcaatccccttatgggatggaagcttacattgagtgcagaaatcctgacccttgccccagcttgtggggcactggttctacgctgggagaggcaagtcaaaaagatgtagggctgctgccagaactccctccagtgagcgttcagctactagagtgggggtaccattcagaaatttgtcattgtccccacaccaattaacctggcttaagagattttgcctgaggaaaagtaggccatagaactagaagctccaaatgtctctctataggaattcacttcatttgcaacagtgtgatgacaaagccttagagcactcaaaaacattggagattgtcatgaaaggcagttgacaggatactattagacccattggccctataggctaaatccatagactactttcccagggaaaaacagtgagatagctgggaagaatactcctgaggtcagaacaaatctcaaacactaagctaatgaactgtcccttcaaaagagctagaatggatcagtttgtgaagcaatttatgccacagggcattgttgaaaacaactgaatgattggctacaattagtggagcctaacagctggatatggtcaagagtcacagaagaccatatatacatttgtatgaaatgtttaaaataggtatatttatagagatagcaggtagatcagtggttgcttatggctggggaagtggatgggggcttagggaagtgacaaaaatgaggcttctattcgagatgataaaaatgttctaaaattgactatggtcttggttccacttatctgtgaatatattaaaaagtattgaattgcacacttcaaaaaaggtgggtgaattgtaggtgacatttttttttttttttttttttttttgagacgagtctcgctctgtcccccaggctggaggacagtggcacaatcttggctcactgcaagctccacctcctgggttcatgccattctcctgcctcagcctcctgagtagctgggactataggcgcccgccaccacgcctggctaattttttgtatttttagtagagatggaagtttcactgtgttagccaggatggtctcgatctcctaacctcatgatccgcctgcctcggcctcccaaagtgctgggatgacaggtgtgagccaccacgcccggtgacttatatcttaataaaactgttaatgcttgagttctttggcttctaacttctggaaaaaatgtattttctggtttataagtatatctaccaaaatatgttaaatgtgtttgatgacacctaagtatctcagaaactaaacttgttttttaaatttaaacctcagtctttctctccagttcccactctttggtccactgagcgtgctgaggattgtaatgcttcctaaatgctctagttttactgccagactatatggcaaagttagggactgcctgaggaacttaataatacataattcgaaattcatcccagagatactgattcattaggttcacaatagggcccagaaatatatatcttaaaaagtattacaaataatgtgagtatccatatagatttggtgactattcgcagcgctaacaggcccaagaacattctttcatgattcaagtgagctgtcttcactcgtacaactcccccccgcgacataactgatttttcaagttaaatccaccttttacacattttttgacatatcttaattatgcaactataacatgcatacaacagatctacgtgaacagtaaagactgttctctttacaagtaccaagactacagtgtgtgcgtttttttttttttaaagctacttttcatagaaggcatttggctggtacatttttcaaaatttagtattaacttctgataagaatacttttagtttttcaccatcataagcaattttacagaagtaaatgttttcaaaattaaacttgagaaaaagaactttatttcaagacataacacaattcggataacaaaaaataggagataaacatcacacaataataatgggaaaacattaaagcaattgatatttaaaggagttatgttctacctataagatattccattgacttatgatccattttcccactatttctactgaggaaaactgctagatgaaggatttatgagatttgctaaaaattggaatagaattttcttaggctgtgggaacatctcgatgtgttataaatagaacagactgtgtcacagttttgagactggtggttccaaccacggccaagtaaacagtcttaatgtcctctaacgtattattctatcttttgtgatattatgatcatctattgatggctgtcaattcagaaaggccatttaaatgcctaagttcttgcaattagtaaacattttaatgtcagagaaaacaagcacacattacaaaactctatgtcctctgccaaaagactacaatgataacagctcactgaaaaaggcttacggatttgaaatgcacttttgagaaataagaaggaaagtaatgcccaatgaagaactcaatcacattctgactgcagccatatgttcatggaattgacaagcaacattctaccgcaaaatgtctttatatactgtataatgacagaagaaaaaacctataggagaagcagccaggctagctatactagttttatggatataaataagggcgacatttctaaaaggtcaatgagtaaacaaggtattcatgccagttaacaatatgaccttgacagctgaaaaaaacagtagataaatctgtatttttacagcactcaactcaatttccaaattagcatatacttttacatgaagtattactttttctatattcaacaacaaatatagtataactagtagaggaatgatttctctccaacttcgaaagctgtgaataaataaacatgccagtgacctataacagataagtatttatttgacttttgtggcaaaaaaataaactatagctgtattttgaacacagcatctaagtatgaaacaatgccctattttttatctcctataaattggacataaaatgtacatagcctgggatttttttttcccttttgggagtaaatttaaactgtatgaataacttgcttgttcccaaggaaatgcagtgcaccaaatcaagacaagtgaacttcaaacaaatttggtgttctcaacagtttgcaaggacataaagaggcagtaacacatgaaattctaatagtaccaagttatctttgtctactgaatactctagaatggaaaaaccaagcactgtggaggaagaaagaatatcccaactatagcgtcagtgagattttacataaaattaatactatagtgatagtcaaaatgcataatttatattaaaaataattgggaggttctctggtatccttaattatatagtgttttgtgttattttggataggcaaaggtatttgaagaaattcaaaaacagagctatagcatatggaaaggacatcataatctacataggtataagctgaccattctttacgtaagttgatgaggaaaaatcaggcagctttaaggaagtagaaagtgaagggaattgctgtattaggtatatcagcttgataatacacccattaattatgtccattaaccacaatagaaagccacaagaatattttttcaacccaaagtgttcttttcagtgtgtccaatgctagggaaataatcagtgctcctcttttaataacaagcaatattttcagatttttatagatatgccttttagaaaaaggtcaccaaaaatgaccaaatacaaacaaaatttgtctttttaaatgatgaggggccaaaaaataacatgagtttaaaactagtaaataattttctcattatgtgagtcatattcatctccagctttgctattcaaataccatcttcacaaatatagctattttagccagttatcaacatttattgtctgtctctgtgacctgtatctatagatctctgtgtctctagatctgaaaaccttgatggtcagaatgggcaaatgagatgctaagaacaaaaaagaaaagaaaaccaaaaaagatagccattgtttcaaaagacaacagaattaataattatagtgtctaggcccaaatatttggaaataaatgcatctcattaattttacttcaattctctacatagtttgaataaaagatttgtgtttgctgaaacaatttagtaacaaagaacagtatggcccataattgcatattcttctacatattcatttatgtatggtcatgacatatttacatgtgactacagacttggttaacatataagagtaaattgcagtaagatgcctccacaaatgggggaaaatgcacatttcaatgaatgctaatatatactgaacacctataatgtgacagtatgtgataaatgaaatcttacaagtcattaaagtttcaatgccaaagttcaagtgtcgattattcttaatttagattgagataacttgtattagatttacttcttggaaaacgtgcccaagtgaaatggaaattccttgaattatggtccagcataagtcacataacaatagctgaggaaatctaacaatctagaggttctaatggcttatggaacagctgaagttatgtttgtaggaatataaaataaagtttataacctctgtcaatcaatccatcaggctcatacatttattgataaataatacaaccaaaagacaaagaaagaagactgtatataatggcaaatcatttaccacttttactttgattttaagaagtaacagtaaaattaggggtataaagctaaacatttttcagcaaaagatgaccaatgacttcccatcacactacctcacatttcctgcactccaggctaacagactttgtgctgttcttagagcatgccaggtacataaagggcacttgttgctccctttgcttggaatgctcttcccctggatgtcttcgttcagatccctgttcaaatatcacctcttcaggaaaaacatcatgaccactctattaaatgtagcactctctagcctacttaattttttaaaataacatgtttaacagcaatttttttcatagcacctggtattcattatattggttttgtattctctccaactcaccccactagagtggccagggatgtgacttgttcactgatgaatctttacaattttttaggattaatttatcaaacagcaaaaactggaagattaatattaaagaatttgcaactttacctcagtgctataaatattatctttccatacgatatatgcatgctttaatattttcagattaaataagcattaagagtatatcagaatatagctaaattaaaataagcacaaaatattccttacctgaatttctaaaatcattctgtcaatctcatcttgttggctgtctattatctaaaacaaaataaatacatctgattcaaataatttttacatcgcttcttaaaagtaccaacatttcaagaaaacagcacagaaatttataaatttattttttaaaagggtctttttaaaaaactgaaagtatccttatgatttgggtcacacacgtataaaactacaaaagtcttcctctagttctcaataaaagttttctcaaatttataaaatttttaagagtaactttgagacagactgaataattaaggaaggaaaaagatatccttttgttttggcttttatttcaattatttaattttgtttcaattgctatggtcctttcaaataaaaacattcaaactagaaactatgtaagtgattaaatattaacaaaatataaatcacataaaatagctataaattatgtatctatacacacatatccacatagcatagatttcacgtttatgatctaaggtatctactgaccttactagcagtctcattttgttgtctgagattatcattttcattctgaagctgttttgcatctaacatgggaaggcggattccatcttcaaggcatctttctactttttgttgcaaactatttcaaaagacaattatatgaagaaaataagctctatttgctgattttggtaatgatttcaacataaatgattattgctttattaaaaaatattatagaccctaaaaatgacatcaagacccacagacagtatatgaaaaactgttatctatagttcataacaagtaagaagggtccatagttagctagaggctgatcatcttttcagaaatggcaaatttgagaccagagtccagagttgctcagtatgtgacatccttaggctccgatgaagtccttcattacccaaatctgagctctgaagtctaactcatgttctttccttttcctctaaaagcagggttccttgattaagatgatcattgcagggaacctaagaatatggatccacatcttttgttctttattctaagctcagcaaaagtttgcttgtaagaatagctgttgcctaaatcagtagagttgcatttctctttcatttcttttctttttttttttaacttttattttaggtttgggggtacacgtacttacaactgtattaattgagacccacgaggcaagagaagtaagtaaatctggaagatacatggcaaaactgctgtaccttttacttgcagtaaagttagaaataggagccaatcacttcaatttgatatattccattaaggagtgcagtttgagtattttactggcccctttttcgttatttagaatttttacttttttttttttataaagccattaggtaaagggtttgtattaatattttcagtcttcatttgtatgagtttttatttttactattttcaacagaaacttttggcaagatatcaatatattgcttcaaaatgttaaattataactgagataacctgtttcaatgaaattatgcttctagttcttaatacaggttgaacatccctaatccaaaaacctgaaatctgaaatgtgtcaaaatccaaaactttttgagcatggacatgatgctcaaaggagatgcccatggcagcatttcagattttggattgtcagaattagaaatgctcagtgggtaaatacttggcaaatattccaaaagctgaaaaaaatcttaaatctaaaacatccctggtcacaggcagtttggataagggatgagcatcctgtagtacatctttaaattaaggagaataaaataaaaattataaattaatttaagtaaaatgttttatgaaaaatacgaataaaataatgtagaaggattcagaaaattttcttacctctgaacggtagttactaactccttttctttctttttctggcatattaactgtgtctctttatcttgacactgctttttgatctcttcaagttttttttctgtatctatcaaagcctcttgtaaattcttatttttttcttccagaatctgcagctaaggagaaatgttttacagttcattacacatgaaatattaaatacgcttctattagaaactgttactgtgttggcaaggattaacagacttgtagctaaaaaaaaaaaaaaaaaagaatcacactgtattttatctagagtatttaattctccatctcttcctctgtgtgaaaggcacctagaagaacagaattacaaggaagagaatggggttagaaatttgtagaagaccgagaaaggttaatattctcattttaaatttattttacttttattgtaataaatatataactctatactgtcttaacaatttccaagtgtatgacaggttgaggttaagtacattcacattgttgtgcaactaatctccagaactcttcatcttgcataattgaaactctatatcaattaaacaactccccatctatctctccctccatttcctggtaaccaactttctactttctatctctgtgattgaattcttaaggtatctcattaagtggaatcatacagtatttgcctttttgtgactagcttatttcacttcacaaaatgtcctccaggttaatccatacgatagcatgtgtcagaatttctctccttgttaaggcgaacaggattccactgtatgtatataccacctttagtttatccatttatctggtcatggacacttgggctacttccaccttttggctattgtgaataatcacattataaacatgggtgtacaaacatctgttcaagacccttaactgccaccccagtggatgttaggtattttctgacatattttctaatacccattgccctctgttcctgctcatgcaacctcctgcagtccttaatttcctgcctgactttaatctctcttagtttttacaacttataaattaatgtaaaataaacagagaatgcaacataggtcttaaagtatgcagagtgacacttcatagattagattcttgagtgggggtaactttacccccagaagacatttggaaatatctgtttacattttgggtttgggataaacgagaaggagcactgctattggcacttagtgagtagagggcagatatgtggatgcagaagtacacccttcaaagatcaaggcacacccctgtaacaaaaaattatctgcctccaaatgtcaatagtgccgaggtcaagaatccctggcttagaacaactttgggaagagactgaagagtagatctagtggatttataaataaggtttcaagagagtggccctcacctcagttaggagaaagactctgaggtattgttaaggaaaaaaaaataaataaaagaaaaagtcagaggagttaattgaagtcataggtcaaggtataagaaaaatatatatatataaaggttaagaagaatgaagaaaatatctagaaagatagtcaacaaaaggtcttgtcgagccttggtgaatcctagagactgtgttggaaagcaccagaactgggggtgtgtgcatgcatgtgtatggggtagaggttggcagactggtttagaaactaacttctacagtagttaagagagttacaatacaggatcaataggaaggtaatcacttattaactgacaagaaagatctacttatgcatgcttagataaacaaagtttcttattagaattaagtccccaaaacagcaattaaacacatagatttaacttatagttagccaaatttctagagtcaagttaacatgttttcatgtcatttaaagataagcattttatttcatgttacctgtagactctgactctgtacatcatctagagttggaagatcagccagatacttttccaaggtctcaattcttctctgcttttctttgttttgttcagattccttctggcatttctttttcagactactgatgtatcgatctctagttttaagctaaaagcaaacaattatgaaccttcagtagttttcagtcattaaaagatataacaaaaccaacactttaatattagacaccattgaattcaccaacagtttcaggttatagcgaaggccactagcaactcaattaagatttaccttatttcattctaagatttacacttgccgggtgtggtggctcatgcctgtaatcccagcactttgggagactgagatgggctgatcatctgaggtcaggagcttgagaccagcctggccaatatggcaaaaccctgtctctactaaaaaaatacccaaaaaaattagctgggcgtggtggcacgtgcctgtagtcccagctacttgaaaggctgaggtatgagaatcgcttgaactggggtggctgaggttgcagtgagccgagattgtgccactgcactcctgcctgggtgatagagcgagactttgtctcaatttaaacaaacaaacaaaaaaagatttacacttaaaaaaatttatgtcactgaaatcaacagtttagggaatatttgcttttaccatggacggcatcctataaattgtcatcaaccagggggcagtaatgacatagtttttattgcctgcacatgtgcaaatttggtcaaggctgttcatatctttgtgatttcaatattgtcatatacatgtagaaactatgtgttgagtttaaatgatgtctaaaatgcctaaacaatgttaccttacaatttagtatggaacaatgttattgggtgcccagacaggcacagaaaaaaagcctttgaaatcagtgaagtattcatctctgaaggaatgactccgatttcttagtttttgcataactatacccaaatgctttatgggaactaagagaggaagatactacaagtaactaaaactattttgttacgttaacagacttgcagagaaattgcttatagtgtactaaacaatgcaactaaagctggaagaatacaccaaatacttaggggcagataatggactagtgaaaccaattcatacctcaagcaacactagtttaaggcactgtgtcataattgaatttgcagcttattttctttctaaaaaccacaaaataaaggtgtcttactattgatgtcattttaggattgataaagtatggtaaccgaacacttatgtcacacatggtgtgtacacacatgataatgattctagtaaatcccaatttatataggctgaaagtcagattttcatgtactttttaccccctactacatgaaatatatcatctataaatttcatatctcatagtcaaagctctttcatatttactcctatttaccttaaattaacaatcttccaaccatttaatcctcttcaaaacttacagggttctaaaatatttttacagtgttttcccatattcactgggaaaataactggcaataattagcagtaagatggattattctttcaaactttattaaagctaacacttgttcacagtctagtttctttcatgtattttctaatttttttcaggtctaatgtataacaatttttaaaacttcatgtggaaaaattattcatttcaccagtgacattaggatctacttatgacctctggtaaggagcaacactggtaagacaaacacatcctattatttattggggctttcttaggattaaaggtaaatgtgctggtgtgacagtttaccctgtgatctatcagaatagaaaaccttacatactgttggcactggtggtgaccatataatacaattccctttttacagatgaggcccaaagatctttagtgacttaacaagtcacaaaatcagaagtggaatttgaatctagatcatctgactgaaaatcaactttctttcagttctttgttatgactcattatcaggttcttattttagtaaccagctgtgcttggtccccatcaaccaagcctgctcttgccttagcaaatgaccctgtacattacagaggtaaacatgataaaccaacctatgtttacttaatgctctctaacttggactcaactgtctaaatgtcttcaatgtgacaaaatgatgcctcaaaaagcaatgactggaataggtctgtctgtgtgcaaagatgtcctacttttcttctttttcttttggttgtccaactctctttgctgtcatgtcaagcttgcttcccttgatcacaaattgctgccaacactctcctacgagacactgtctctgttatttgttggtcacatgttgatcatacatattcattgggtcttgggtttttttcagcctgctcacagatgacaagctctttgttttgttttttggtgtttcatttttttttaaaactgccaagttttgtgctgtcccatacaaacagaggttactgaagtctgaactgcattaattacctccagataaatgaggtgtcactaataaatcttctctattctattaatacaaggctaagtttttcttttcaaagaggtatgacgcaatactgatatcattcctagaaggtaataggaaggacatgttttataagaagttcacaaagttacttttctttattatctggcttttataagaaagaactcaaaggtaacattattattaccacattgttttttctgtcatagaatcagtctttgataaggattacagagtaaatgccaaaagaaacaatatgatccaatcttgtgtggacccaaagtgctgtttgttgatttgttatcaaggagcctgctcttcctaatctatgcactcccttgaagaactcaagtcatctccatgtgctctgacacaaactctgccctctacatctatcccctctcctcaaatttctctggtatgtacatttccattcttaattgcctcactcccacagaagctactcctcttcttttcggagagtaactctaccatatttgcatctgttaccaacccttcccgaacttgctccattatgcacccactctaacatctttgatctctctctctctcattgttttttccctagtctaccttactgctttctctcccatcctggcaaaaattacctgaaagaattcattcaacatgccaggcaccatgaatggtgctacatacgccacagagacacattcaaatacaatccccctgccttcaaggagcttagagagaaatataaaaaataatgattatacaaattgggttgagccctggaaaaaaagaataaaatgctataagcatatgaaaggaggagtagaagggaaaaatattaagctagatttgagcaaataaataggtgacttgaaagtgggagaaaaaaatagccaagtatttaccatgcaaaaaggccactctgtgtaaagatcctgataccagaaacaaagcctgagctgtctgagcaactgtaacacccagtgtatcaatacacagtttatcagaggaagattggcagaacctatggatatataattaggcaatgtgtctcaggccatgggaagaatttgatttatattttaaagacctggagagtagtgtcagcaagatggcagaaaagcaagtcttgaactctccttccccaaaccaacatgtgggttcaattaaaaaaatagtaaaacccccaacatggacaaattccctttttaagaaatccaaaaattagtcaagaagctattgtactctgggtgaatgcaaaatcagccacatggaagcaattaaggaaatgtaggacacctgtaatcctacccccaatacagcatatgatcagaaggaacctgttgggaaagaaaatagttggatcacacatccaacaccccaacttttctgggtgctgttcagaagactggcttctgccttgcctgtcttggaacactaataggaccatgacactcttgctgcctgggaccagtgagatcagaccggtgagatcagagatgatggtttaggctagcagtttccacagtccacagctccagctcagcactccagcaatgagtgaagaaactccagattcaagtttctccctgtgcagagaaagcaatggacagaacacccaacaatctgacttttcagaagtctggccaagggactggctgaaattctgcttgtctgagtactgataggacctagaatactcctgaagcctgaaggatgctaagaacaaaaaaaaaaattagttaaactagtacaaagatatgaaaagcccccctctctcgccagactgattagtgagggtcttctcctgtataaggctagtctctgaggagtggaagtgatagctattttatataatatacaagtatcaacttaaagagggaggaaaaattaacacacagggaaatatgtccaaaacaaacaaaataaatctcctgaaaccaaatctaataaaaccaagatacatgatttgcctgaaagagaattcaacatacccaacataaagatgctcaatgaggtcaggtaaacaatgcatgaacaaagtaaaatttcaacagagataggaaatactttaccaaacaaatcttggaactaaaaaatataataactgaaataaaaattcactagagagggtcaaaagcactctagatcaagcagaagaagaaataaacaaactcaaacacaggtatttggaaattatcaagtcagagtaacaaaaagaacaaggaataaaaaagtaaagaaagcttgagaaacttaaaaaacaccattaagcggacaaatatacacattgtaggagtcccaaaaaaggaagggggagaaagggaaagaaagcttattcaaagaaataatgactaaaaacttcccaaatatgtgtgtgtgggagggagaggcaggaggcatggggaatggacatccagatccaggggacccaatggaacccaaataagatgaccccaaagaaatatgtacaaagacacagttaaatcaaattgtcaaagtcaaaaagagaattctgaaagcatcacaagaaaaatgacctgtcacatgcaagagaactccaataagactatgagcagatttctcagaagaaattttgcagagaaagtgggatgataaacttgcactgcttgggcaatggggaatgggggtaattgtcaacccagaataatgtaagaagaagtgttcttcaaaaatgaatgggagtggctgggtgtagtggctcactcctgtaatcccagcactttggggggccaaggtgggtggatcacctcaggtcaggagtttgagaccagcctggccaacatggtgaaacctcgtctctactaaaaatacaaaattagctgggcatggtggcacgtgcctgtaatcccagctactcgggaggctgaagcaagagaatcacttgaacccaggaggcaaaagttgcagtgagccaagatcacaccattgcactccagcctgagtttgcaaaaagtgcaaagctctgtctcaaaaaaaaaaaaaaaaaatgagagataaagattttcccacacaaacaaaagctgtgatattatagttgattacctacccttgtactataaaaaatgtcaagaggaattcttcaagttgaaataaagggatgctaaacagtaatacaaaagcataagaaagtacagttgtcccttggtatatgaaagggattggctccaggacacctcatgtataaccaaatccacacatgctcaattcctgcatagaagacatacaaatagtgaacaggtatatgaaaagatgctcaacatcactaatcatcaggaaaatgcaaatcaaaaccatctcgtgcctgttaggctggccatcttttttcttgaaaaaagaaaataacaaatgatggcaaggatgtggagaaaggggaacccttgaacacttggtggaaatgtagaatgatacagctgctatgggaatctgtatggaggttcctcaaataactaaaaataaaacatgatcaagcaatcctacttctggatatttatccaaaagaattgaaatcaggatctctgagcaacatttgtactcccatgttcctagcagtattcacaataacccaagatgtggaaacaatctaaatatccagcaacaggtgaatgagcaacataaatgttatatacacacacacacacatatatacacatgcacacacacacatacgtgtgtgtatatatatacacacacacacgcacacacacacacaaaatggaatattattcaaactttgaaaagagaaatcccatcatttgtgacaagatggatggctctgggggatataatgctaagtgaaacaagccagtcacaaaaaggcaaatactacataattccacttatatgagataaatgaaacagagagtagactggtggttgtcagggactggggagcagggaagtgggagttactcttcgatgcatacaaagtttcaattacataaatgaataagtgctagagatctgctgtacaatatgcctatagttctgaattatacactcaaaaatttgttaaaagggtacatcttgtattaaatgttctttctacaacgaaaagagaaaatataatgggatggcataaattagttttaaccaaagaagtaaaatgactggatcctttgttgttaaaagttaagtcctttgcgctatcaagaatggatttgggaggatgtggagaaactggaattcccaacactagtagtgggagtattaaatggtacaatcacttgggtagtttcttgtaagttaaatatcgactgtacaaaccctatgatccagcaattcaactaccaggtatttatccaagataaatgaagacacacatagacaaaaaatcttgtacaagaacgttcacagcagccttattcataatttctccaaaatgctaaaaatccaaatatctatcaacaggagaatagatacactgtagtatatctttataatgaaaaacactactcagcaatagatagaaactgatacatgtagctataaaaataaatctcaaagacattgaataaaagaatatataccatgtaatttcattaatatgaagtccatgaaaagtcaaaattatactgataataatcaaaaagcacacacacaccacattttctttatcgattctttgcttaatgggcattcaggctggttccatatttttgcaattgcaaattgtgctgctataaacaagcatgtgcaagtgttttttatgtaatgacgtctattcctctggacagacacctagtagtgggactgctggatcaaatggtagctctacttttagttgtttaaggagtctccacgctgttctccacgctgttttccatagttgttgtactcgtttacattctcaccaatagtgtaaaatcattcccttctatttcataccaacatctatacacacacacacacacacacacacacacacacacacacacacatatgcatgcatatctagtgttcctgtctgtgtatttggtttttagcttcttattctgaatcaggggcttcagtttaataacttaagttgcatcattattaaagataggccagcttcatttaccaaccctttatgcccaacatgacaaaaaaaatgaaatcatagactcaataaggaaaaggagaacagttatttggtgtaggcaattaattttttaaagattttactatttgttagaaagatatacaagagcatttctatcctcaaagaaaatccttggatttctgcagacagcagagggcttctcaaaagttactacaaaattaatcacctccacataaatgtatacataacctggcatgacacctgacagggtaaatgacagacaaataattatatgctgaggaaatgttgttgacctaattcaactttattagaaaaacctactttttcctctagtttcttcttctcttcactaaataggcttagtctttgtttgagaaactcattaagctgtaaaacttctttctcagtagatgcaagcttttgctcaaattccccttgttgggaatgggaaactgattcctctgaaaatggtgtctggagtgaagtgttctcatattgtggctgttaggaaagaaaaaaaggaggtaagactttaaaagtttgtcttgaacaaatgtgaagaaattggaaatgaagtataatataaggagtacatataggctacatgaacagacacaccttgatttaaattccagctatcttgcttcctagttatgtaccataattaaagtaaattacttaccttctcaaaaccctggttttctcatctctaaaacagaaacaataaagcctactttgcagtgttttttgaagaaagataaagtatgtaaggtttccagcatataggagaaacttcatgaaagacagctattatttgattttaaaagtatacttcaacatgtaaatagtacagtatatacattaatcatataaaagtgaaagttctaagtaaataaataaaaactaaagaaaaatttcttcacagttaatcatttccagctaatactaaattcaatatgtattaatagaatgtttctctaactagaaagtaagatccatgaatcggggattcttgtccatctcaaagtgtccatcttatattccctattgcatagaaaaaaatggcacaaaataagtactcacaaaataattgttgaatgaataaatgtattattgcttctatgagcaaggctttgaaggaaattcttttcaaggggaagatattccctctcccccatgtaggattaaaatctggaagaggaaggcaggaaatacaaatattccttcaaacaaatcagcatgtggttaagtgctgtaaaaagatatcaacaaagtactgtaaaagcaaagaaagaggttatttttccatttatttaaaagatatttacaaagcacatacgttaggcattgtgctaggtgctggggattctacagttaataaaatcagatcccaccagtttaatgtgtcatacacaaaaagaccaaaaaaagacaatgaaactaagtgctaagatagttacatgtgcagtagctaagggagggtgttacagaagtaaatttgaactaggccttgaagaactgatactttcccaaaaggtaagcatgcaactcaaccattacagaaatagcatttatcatgtccaggctatttcaaagatggcagactcaccctttacaaactcaaattttaatcagagacatgagaagcctttagatgattgtaatatagaacagaatgaatatggtagccaaataaaggccatgttaagtacaaagtattgggagaaagtaggatacatgaagacattgagcgaatgaggaaaaaggcttttctggagaggtggcttttgagacagattttgaaaaacagattctggcaagaatggaaaaaggaacaggcattctagaaagaacatttttaaaaaggttaaaaagtagatacagagagttatcatgtcatgtttataggttacaagtgggcagaataaaagggaaaacttacaaatctaggttgcagccttcctgtagaattccaagaattgtgaacttggctttgtaaatctctatattccccagcattcaatctagtgtctagactctgagcaagtctgatgaaagggaagagatgagaggaaaaagacaagagagtgctagaagaaataggacaaagctagattcagtgaacaagatgcactgagaatgaatatggatgttatcatttaaagaaattattctaactaatttagctgaaaagaaacaaggagctgatatagagcatggagaacagaatgaagaaactggaagcagggtgaaaggatttagagaaaatgattatttaaagatgtaaatggaaaataaatgttaaagataaccaaggtttaagattttgtctaactaatacggaagattatcttctgggcagaagtaaatataaagaagaacagtaggttatatagaaaaataggttatacttaagcagatatacttaatataattagagcctatgattattatttcatttgaatatacaagtacagatggacaccaggcagaaagatagatatggaactcaggaagatggctaggctatgaaactataaaaagctaatacagacttccagtttctagcccagcgtgtaaagatatcagaagtcgccactcagtcctaaaaaaaataaaataaaaagctgaaaaaactgaaatatcaacaagtcttctaaagtctgtgagagaaatgaggttacagggcaaactgctgcctccaaaactggaaaaaaaggataggtagaaacagaggttcataacctaataaagcaaaaacccattagtagaagagccagggtgggaaaatctgtaactaatgaattgctagagacttggagtagataaatctgagagttaaaaattccacggggacccaatcatacaggaggtttccatatgtctgtgagttttacctccaggagtgttctacaagatcttcagtgagtatcagagaaaaatcccctcctgtttctggcagggggaggggaaaaggaaccatttaaaatatgccagagcattctgttcttaaaaatgcctgccgtcaggagaaactattttaccagagcctaaactgctggggttttatcagagcttaacgtagttggggtaaagggaataacccaactccagccaactccagccttccacatagaggagggttaatacacaaatcaagctcctttggccttccctgtggaaataccaactccatcgccctcctgccatcctgtcccgcctaagggtggggaaagaaaaaatcttagaaaactgaagttcacaatccagaggaacaaattcaccaaaagactgagacctaaacacaggactatagaatacttccccttccctgcacactttaccactgcattactaaagctctatttaccacacttattaaaccttggacatcatgtctactttcaacaaaaattacaagacacgcaaaaaggcaaaaaacgcagtttgaagagaccacaaagcatcagacacagagtcagatatggcaagaatgtcagaattatcagaccagggatttttgacaactaggattagtaagattatgatagaaaatgtagacagtatacaagaacatacagataacgtaagtgtagagataaaaattctagaaaagaataaaaaagaaatgctaaagattgagaacactaacagaaataaagaatgtccttgagggactcattagcagagtagacctggctgaggaaacaattcctgaacttgggatatgatgacagaaacttccaatactgaaaaagagaaaaaaaaaaaaccttaaaaaaacaacatgccttgtttcacatgaggcttctgacttggactttcgggttaatgctggaatgagttaaggctttaggggactgttgggaaggcatgattgtgttttaaaatgtgagaacatgaaatttgggaggtgctggggtggaatgacacggtttggttgtgtccccacccaaatctcaacttgaattgtagttccaataatccctatatgttgagggactcagtgggaggtaattgaatcatgggggcgattacccccatgctaccgttctcgtgatagcgggtgagttctcttgagatctgatggtcttacaaagggcttttccctctttgctcagcacttcttccttctatcatatgaagaaggatgtgtttgcttccccttccaccatgaatttaaatttcctgaggcctccccagtcacgcggaactgtaagtcaattaaacctctttcctttataaattatccagtctcaggcagttctttatagcagcatcagaacagactaatacaaagccctttactgttggtgaagaggtgatcctgcctgctgccaagcacatttgtcatgaactcttaggagacgctgcagttcaaaaggtgacatgtgttcatctttcatctttcagccatcacaacaaaatgaactgatgaaacagcagaggatattgaggcacagttgttaaagaggatgaatgagtcactgtggtatgcaatccaggttgaaaagtctatcaatgttaacaaggcaacaaggcttgcttttgtgtgatatattttcagaaggatgtgcaagaggatatgtcatacgcacttttattgccaaccaacaccacagctgcagaattattcaagtctttgaatgattacatatcagaaaaatggaattggtcattttgtgtcagtatacgcacagacagagaggcttccataactggatgtccttctggcttcacaacttgggtcagatggtcacttctgcatgtgactccacacattgtgtcacccatagagaaatgctggctagctgaaaaatgtcacctgaatttagcaacattttgcaggatatccttaaaattatcaaccacattaagtacatgcccttaacccacatctgatggtgcagctctgtgaggagatggacgcagggcacacacgtcatctcttatacacagaagtgattgctttgtgttattttattttatattttttattttattttattttattttattttattttattttatgaggctggagtgcaatggcacgatctcggctcctgcaacctccacccccggggttcaagcaattctcctgtctcagcctcctgagtagctgggattacaggcatgcgccaccaagcccggctaatttttgtacttttagtggagattgggtttcaccatgttggtcaggctggtctcgaactcctgacctcgtgatccacccacctcggcctcccaaagtgctgggattacaggcgtgagccactgtgcccggccagaagtgattgctttctaaaggtagattactggccagagtttttgagttacaagagccactccagagatttcttttagaaaaacagtcaccactggcaacacatttcagtgacacagaatggctcacaaaacttgcttacttatgtaacatattcaacctgctcaatgaagtcaatctgttgtcacttcaagggagaatgacaacggtgttcaagtcaacagataaaagtggctgcattcaaagccaaactagtattatgagggcaatgcataaacattgggatttctgacatgtttcaaacattagcagaaatcttgaaacagactgagccagggccttctttctcccagctggtacatggatcacctatctcagctttttaaagaatctgagcattaattcccaaccataaaaaaacccgaactgggaagaaatggatagcgacccacttgtaaattgccaggtgaatcaactttgtccacactagaagagaatcaactgcttgagactgcaaatgacagtggtcttaaaagtatgtttgagacaacttcaagtctccatacattttggattagagtcaaggcagaatatcctgagattgccacaaaagcactgaaaagcctgcttccatttccaacatcatatctttgtgaagcagggttttctgcaatgatagcgaccaaaatgagattacagagtagactggacataatcaacaaactttgggtgtcactgactcccaacactcccagatgagaccgtctagttgtggaaaacaagctccgggctcccactgattctacattatggtgagttgtacaattatttcattatatattaaaatgtaattataatagaaatgaggtatactataaatgttatgtgcttgaatcatcccaaaccacaccccctccccaggtctgtggagaaattgtcttcctcaaaaccagaccctggtgccaaaaaggttagggacttctgctatacactctgaagttatccttcaagagcgaaagagaaagacttccacagacaaaaattgaaggatttttgtggccagtatatctgctttgcaagaaatgttaaaagccttcagagagaagggaaatgacacaggtcagaaactcacatctagacaaagaaagcaagagcatcggaaaaggaataagtgaaggtaaaaatttttaaagctttattattcttaattgatctaacaagtgacattttaattacagcaacaatgtaatcatttatgtatgtttctgtgtatgtgtgcatgtatgtatacatatgcttatgaataagtgaaatgactgataacaatgatacaaggatgagaaggaagatggaggaattagaagtattttgctattatatggtacttatcataaggtacacttcattaccttcaggtggtgtagggttacttgacagcagacttggattagttataaatgtaaatgaaaactatagggcaaccactaaagaatgtaaaaagagaagtgtaataaagtagaaagagaaaaattgattaatataaaatgctcaattaaaatgactgggaaatggttggctcatgcctgtaatcccagtactttgagaggctgaggcaggaggatcacttaaggtcaggggttcgagaccagcctaggcaacatagtgagacccccatatctacaaaaaataaaaataaataaatacaaatgataaaagacaaagtgtggaacactacaaaaaaatctacagctaagcatcaaaatacatcaaacaaaaactgacagaactacaaagagaaacagattaatctactatcgcagttggagattttaacaactgtatcagaaatggacaaatctagcagcttgggaggccaaggcaggtggatggcttgagcccaggagtttgagaccaccctaggaaacatagtgagacccaatctgttaaaaaaaaaaaaaaaaatagagagagagaaaggaaaggaaaaagggaggaaagggaggaaagggagggagggagggaaggagggaaacagaaaagaaaagaaatggacagtttcaacaggcagaaaatcagtaagggtgtaatttatctcaacagccccatcaatcaattaactgtaactgacatctgtagactactcatccaaaaatggcatcacacattcatctcaagctcacctggaacattcaccaaagcggacaacattttgggccataagatacaccttaaaaagataaaaaatcatccaatgtctgctgtcagaccatagtggaattaaactagaaatcaaaaacagaaagacagctgggaaatcccaaaatacctggagattaaacaacacacttctacataatacataggttaaaaaggaaatctcaagagaaatttaaaaatgtcaactaaatgaaaaggaaaatacaacctatcaaaatttgtggtatccagtgaaagcagtacttagaaatttatagcattgaatgcatatattagataagaaaaaaaggatctaaaataaatcatctaagcctccacctaggaaatcagaaaaagtagagaatatcaactagaaaaagtaaatctgaaataaacaaaagaaactaaaagttcaatgtttgaaaattaattaaggtactccatcaccaacaggctaaaaaagacaaatcatgattatgtcaaatccacgaaatgcacttgacaaaatctaacacccattcatgattaaaaactcttggccaggcacggtggctcatgcctgtaatcccagcactttgggaggctgaggcgggtggatcacaaggtcaggagtttgagaccagcctggccaatagggtgaaaccccgtctctactaaaaatacaaaaattagccaggcatggtggcagccacctgtagtcctagctactcgggaggctgaggcaggagaatcacttgagcccaggaaacggaggtttcagtgagcccagatcgcatcactgcactccagcctgggggacagagtgagactctgtctcaaaaaaaacaaaaaacaaaacaaacaaaaaaacaactctcagcaaactagtaatagaggaagcttcttcaatttaataaagaacatatacaaaatacaagtatagctaacattatatttatagtggtgagaaacttgaagcttcgccaccaagatcaaaaagcatgcacgaatgtcccctctcactactgcttttcaacatcatactggaagtgctaactaatgcaataagacaaaaagagtacataaaaggtatactgattggaaaggaaggaagaaataaaaccatcattgttcacagataacatgatcatcttttataaaatgtcaaaaagaatccatacaaaaaaactcctggctaggtgcagtggctcatgactgttatcccagcaccttggaaggccaaggcaggaggatcacttgagcccagaagttgaagaccagcctaggcaacatagtgagaccttgcctctactaaagtatttttttttttaattagccaggcatggtgacacacacctgtactcccagccactcaggaggctgaggcagaaggattgcttgagcccaggagttggaggctgtagtgagctactgctgggagccaaaaatgccaaagggaccgtgaccaactcagcattccactggtggctatatgatcaaacagcaaactatttatcatgaacgcaggacgtgggcaaactcacactgcacctgctgctaaaaggtttcctgaggaccatcactccctggcgctgggctccttgaagttatctactgggaaatctagcacctattgttcgaaggatgcagtctcacaagcctgctgtgaaccaaacaggctgactgataattactcaacaatcaccctctctttctcgttatctcttttacctaatacattcagagggctgaaaaagctcaaggaccctgtccactagaggcaaggtgcccccgaccccttcttccaattatactcttttgtctttgtcttttattcccacgttcaccccctttgttcagtctcccaaggtccatgcaggctacaagtactgccccaaacagcaacaaaatcgggtgctcaacaagctacaattgcacatatgattgtgcaactgcatgccagcctaagcaacagagcaataccctgtctcaaacaaacaaacatcttgaagggacatctgttctacttcttcttgtttggataaacagcttgtgagaggcttctcaggaggcaagtctaatctcataggggcatgacactggaagtctttttctgcctcattctccacatggtcttgatctcgcttatttttgtcctcttcaattctgctttctccccttttcttcccccagaactggcttctctcctttctttctctttttccactttctgtccttgtgtttgtcatgattgtttttgtctttgaagaggctggagcagtgctccaaactgcccgtggagagctcagtaactgctttccctcctactttgaggaccagcttcaagggcttttccacatactctttgtagaggtgcttctctgacttgtgctccttgcccatgtctgaccaggccctggtgcccacctcccatgccaggcccaggccttggggtgccacttctggtccaggccaggcgaggtggaggacaggagcagggcctaccaaaccccgcacgccaatgcagggggttagcatgtgtgccaggtggcacaaggcccctcttgagaagacagcccatgagacctagctggggcctgagaacatgaatcaactgatgagacagctgcagagaaaagatccaagtgctcttttcgttttctgtgattttattgctcctggctactccatcatcattaaacacccaatggatctcagcaacatgaaagaagagatcaagaacagtgaagaactaacggataacttcaaaccaatatgtactaatgccatgatttacaacaaaccagagaccacttattataaagctgcaaagaagctgttacactcagagatgaaaatttttagccaggaaaaaattcagagcctgaagcagaccacagacttcatggctaacttgaaaaaacttgaaagcagaaagacagaacagacatctcacagagtggggaggatggaggctgctggctgagagagagagagagagagagaggactctggagatgccgaagcacaagccttcaagagtcccagcaaagaaaataaaaagaaagacaaagatatgcttttaagtttaaaagcagtaatttagagagacagtaggagcagcttgactgcatcatgaaggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcagcaaggataattcagatttaatctatgcaatctatgggggaagactgatcttccaagcaatttcagcaaccatgagtttctggccccatgccaagattacccatatgttaagacagatagtttgctggatgttttaacaaaaggaggggattccagggccctataagagttggagatatcacctgacgatgaaggccatactaggacacttgacacagcaaaacaaatggagattacacaagtagagccagcaggacatttggactctaatactcaagataggctcatggcactgaaagcagtaacaaactttggcgctccggttgaagtttttgactcttgaagaagctgaagtattccagaagaaacctgatgagaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtatggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatgttggttctttccaatttgatctatagattcaacacaatcccaaccaaaatcctagcttattacttagtagattcaatgaactgattctaagtttatatgaagaggcaaaagacccagaatatccatcacaatactaaaggaaaagaacaaagttggagtactgacactacccaacttcaagacttataataaggctacagtaatcaaaacaatgtggtattagtgataaaatataaaattaatcaatacaacaaaatagagagtccagaaataggacacataaatatagtcaactgatctttaacaaaggagcaaatgcaatacaggggaaaaaacagccctttcaacaaatggtgctgaacaattggacatccacatgcaaagaaaaaaaaaagaaactagacacagaccttatattttttacaaaaattaattcaaaatggatcacagacctaaaacacaaaactataaaactccaaaaaaaaaaaaaaaggtagaaaatctagatgaacttggctatggcaatgactttttagatataacatcaatgctgaatccatgaaaggatgaactgataagctggacttcattaaaattaaaaactttttccctccaaaaaacaatggcaggagaatgagaaaacaagccacagaccaggagaaatatttgtaaaagatgcatctgatctaaaaacaaacaaacaaaaaaaacctgttatccaaaatgtacaaataataggccgggcgcggtagctcacacttctaatcacagcactttgggtggccgaggcaggcggatcacttgaggccagtagttcgagattggcctggccaacctaatgaaaccctgtctctcactaaaaatacaaaaattagctgggtgtggtggtttatgcctgtagtcccagctacttaggaggctgaggcaggaaaatcgcttgaacccagtatgcggaggttgcagtgagccgaaaccgcatcactgcactccagcctcggcaacagagggagactctgtctcaaaaaaagaaaaaaaaaaatcatacctacataatgaagcttacatttaaaaaaaaataataatactaggtctacagaacttctagacagctgaatatgtggaagttccctcctgaagggtggcacccctggagatggcatgggatctccacattccttatctcataccttcccctatgcatctcttcaatctggctgttcatctgtatcttttctaatatcctttataacaaatgggttaagtgtaagtaaaaagcttctgagtttcagcaagttaatcaaacccagggagggagttatgtgaactctgatttatagccagttggtaagaagcatttgggacttgaaattggcatctgaagtggagggcagtcttgtggtagtgagtcctcagtctgtgggttctgacgctatctctacacatacagtgtcaggattaaattagaagacagacacccagatggtgtctgctgaagaatatgcagaactgactgcctggtgtgtagggaaacaaataccatacatgtggtgcagaagtactgtgctgagtggagagtagagtgggaaaaatgcatctttggtttttcctatatcactacagcggctttactcataattgccaaaacttggaaattatcaagatgcccttcagtaggtgaaggctgtgcatgtgtggggatatggaggatatgggaaatcttggtacttcccatttaattttgtagtcagcctaaaactgctctaaaaaataaaattcataaattttcaaaaagttatcacaggtggggccaggcgcggtggctcacacctgtaatcccagcactttggcgggactaaggcaggcagatcatgaagtcaggagttcaagaccagcctggccaacatgttgaaaccccgtctctaataaaaatacaaaaattagctgtgtgtggtgacacgcgcctgtaatcccagctactcaggaggctgaggcaggagaattgcttgaacccaggaggcggaggttgcagtgagccaagatcacgtcactgtactcaaaaaaaaaaaaaaaaaaaaaaaaaaaaagttaacacagatgcttctactataatacaaatatatgcattcctggaaaaccactggaaaatcatgcactaaactgtgatatacccagaaagcggaacattattcagtaataaagaaaaatgaactatcaagccatgaaaagatatagaggaaacttaaatgcatactactaagtgaaagaagccagtttaaaaagaaatggtttgaatagtatgtactatatgattccaattacataacattctgggaaaggcaaaactatagagaccataacaagttcagtggttgctaggggtccaatgggttgaacaggcagagcacagaaaatttctagggcagtgaaactactctgcatgatacgataatggtggatacatgtcattactaatttgtcaaaacccttagattgcacaacaccaggagtgatcctaatataaactattggtttttgagtgttaatggtgtgtcaatataggttcactaattataaataatgtaccctaaggtacaaaacattgatagtgggggaggttgagcacgtgtgaagatatggaggatatgggagatcttggtacttcccattcaattttgtagtaaatgtaaaactgctctaaaaagtaaagttaataaatttttaaaaagttaacacaggtgcttctactataatgcaatatagacattcctggaaaatcatgcactaaaaataatagggcgtatggaacgaataggattaaaaacactcaattcaaactgatgcaattttaactagtgcactaacaaaaacagtgactcaggagataacttggacagtctgaacaggtggtcacagtgatattttaaaaccacatacacacacagtcaaaatgctggcggtactttaattagaggtctggtgagtgttcagatgatataggtggactctgtgatatagggcttgccgtgcaggtggagtaggagggagcataacctggcgtgaactgaaagtctataaagaaggaagtgcacttctcaaggaagagcacccaaagggcaggtactcttttacaattttcttatgtaagttggaaaaagcttctgctaatgtagtaggtaaccctaagccttttgctttgctggccaaatattttaattttattcaccatattctaactccccttgcctggggagttggtgggggaaagcacttatgaaccaatctagaaaactaagcagacatcattctcctatttaccaattgtgtatgagcaaatttgcaccatagaaatgtgttttgtagcaagacaagctgtagttgaaactctatgtgaacttaatcatatagaaaaacaaaaatctgaggtcagatgttttaatttctacatttagtaacatcttttcaacctttatctgccttctctgacttttatacaacggttccctttctatggaaaaacacttgcttgctttcctttctagaacaactccctcaggctccttcacaagttgtgctcttctgctaccttctaaaatgctgctgtttcctgtttctagttctggatcccattttcctctcattgcacaaatcctcccttggaatacctgatcatgcccaaggctttaataaccacccacctagactgacaacacctaaatctcttatctctggctcagacctgcacccacaaatattaccctcattcttcactcaaccccaaatttacaatgtgtaagtttaactcactatttttctcctctaaacagatccttaacatagtaatctctataaaccaatcaattgttgctgtatgaaattaggcaatcattctctcaccacattaaatatgtcattaaatctggcccattttaccatggcttggtcatacagatgtttaatcaacagtcttcttctcattctgaccactacagataaaattcaaatgttcacataacttttggactattgagacagcttcctgactggtttccctgcctccaataacatctaccttaaatccaatctctattatgccatcagagtaaccaaactaggatactttggaggtgaaagatggcactattaataaatttataagcacagcaggcataaactgggccagccctaagcaaacctttacacctcaggtcattgatatcactcggcccttgcttacctcttcaaccacatatctaccactacctttctctcacattacatttcatccacacagaataatttgtagttttccaaatgcattatatttctcatcattcctttaagcttctccatatgccatacactatgcctcaaaacactattccttcacccccttcacctggctcaattcatttagttcatcaggttctcaaactagattatcacttcctacaggaagcctggccaggcttttggaagattagcttctatgttcatagctggggttcccacagcacttcatacataaaccctgtgcgaatcaacacactgcaactatctcttgtctgtgttctccattagactacacattccttgagggcaaaaccagcttcattcacatttctattgctacagcataaatggaaccttatccatagttaagataaacaatttttaaggaaatggataaatatattttttggtatactctctctgtagggtttaagttccataaaggcagaaaccattctttgcttttgtgttcccagaatttaacacattagatgtttaatgttttgttgaggaggctcatttgcaaaggtgggattcattttattaaatgttcattagtacagacttggtggtggaaacaaaccaattgaagaaaaaatagaaaaaaatgatataaatggaaagaaaaagaataaaatggaaagaaaagaaatgatgcaacaatgaaacttaataatagtaactattatttggttgatctttccaaggtacacatatatacagaaagaagagacctctttcttctccaatttaagtaaagaaaaagggtccttcatatttggtttattccacaaagtcctgttaaccacagatggaaatttaggtataaatggaaatacaaactattccttggctctaccaatctaccattagaactatccagaaagtttggattttagaataaagacatggttctcattctctacctatgagactgagtgatatctacttctaaggtcatcttaattgtaaggttagtcaaatttttaataagaaaatagaagttacttattaagagtatgttttccatctataaattcatttaaaaatgttacttttattttactgacttatttactctagaatacacattaatttcaataattattattaaaagcataattttctttgtctagtgtctatagaattaggatgaatatgttatggatcagaaaaatgtacctatacaaaatgctatgcataaaaaattacatcattcaaagatccaaagttaaaaaaatccttcgctaaagaaatattttattactctatctgctgtttcttctaaccctcaccattttattggctctctgtatctatccattgatagaagtttatcttatatatttatcatacccatttagtattaagattttccttgtattctcttttacaaattgctctcatcttttaaaatcagatttctcaataatatttcaattcctcacatacttcaaaatcctactaatatttttaacaaccccttttacatatccttccaaatactaatatttttatttgtccttgcacgctggcttggagagccctctactggcctgatgctgtgtcaaaagaacatttgcttcatccttcagatacctattttttacatgctttcgataatatgataattatataattaaagcctttattccgaatgacagaatgttaaagagaaattgaacaattctactaaaatgctgttaccaaagcaagatacactacttccatagtatagaaataccattttcaaataactgtacattattctcagtactcattataaagccttgctatcatgtgacagaagtccaagatgagaccaaattataacatgatgtattcataactaaagtataaaaggcaagttggagtctctatgttaaatgcctctggcctcaagaaaatctgatagttattttctcatcaatatttcctgattttaatataccaatgtctctagtatttataaatatcacatttgaagatatgatgaaggaaacaattccacttaacttaaaatctaggaataaaggccgtaatgaagagaacaacaataacaacatccacaaatagaagtatataccaccacaaagttatcaggcctcactttagatcccaataagtacgccaacagtctttttctttgggaaataaaccaatataaagtttatataaaaataaacatgcaaacaagttttaaaggaagctctttttaaaactgagtaataattaaggaaagtagccattccagtcatataaattttgttaacgggcctcatagactctatatctgtgttccaattagactatactctccttatgggcaaaattaacctcatttacatttctattcatatggcgtagacactgtcttacctacagtgaatacaaataaatttagaaggaatagacaaacttgttttcctatatggtctctccctctgtaagttttgagatccatgaaagcaggaactatttttcacttttgtgacatcagaatttaacacagtggatgttatgtcactgtttggttaaataggctcatttgtaaaggtgagattcatttataaaatactcattagaatcagacctcattgtagaaaaaattacatagaggaaaaggaaataataatataaacaaaatattgagacaaaattggaaaatttattttcaaattaaattatagacaaaaagctaatttcctttatatatacagggctccaaaaaacaataagcaaaaacctacaacctaacataaaaaatgatcaaaggatatgaaaagaaatgtgaatgggcccttaaatttataaaaagaaatataacatcactcttaagagaaatacatattaaaaccatatgaccataaggagataaatctcccctttcttttatatagacctactagaagggcaaaaatccaagtttaataacacactctgttagcatggctgggagttggggagtgggacggtgagagttcttatacactgctctcctaaagagcaatttgacagtatcagtaaaaatcacaaactcaatacctagaaatttcacttctggaaatgtaacttacaagaatatctgcatatgagcaaaacagtatttataaaaggttattctttacagcatcatttacaataaccctaaactgaaaacaactcaaattttgatgagtagggggcaggtagaataaattatgctatctccataaaacagaagatcgtgtaactgcaaaagcaagggaaaggggtgttatctaggtaatgatagagaaataatcactgtgtgttatataattgtatataacatttaaaaaaaagcaaggtgccagataatgtacatattcttatatttttttaaatgcagaagaaggataaaacacacttatatctgcttgtgatatgcatcaactctggaagggatacaccagaaactgacaacagtagttcctgtatgtgtgtggagaggggtgtgcaatctggacagatggaaggctgtagttggacactctttgccacacatataaataaatataaatcatgtgaatacattattaagttgatttaaaatgtccttatattacaaggtaagtatattattaacacaagctttactactaaaacagctacaaaatcctctgtaatcttacctgcaaactagccacataagaatcctcacaatttacataatgtcctaacatggcatgttgagcccgtaattcattatcccttatcctctcatgcaggtgggtaatttgttgcttctgcctgcaaaacataaattaaggtcacattatgagttataattttctaatagttagaagaaccttaaggagcttattcctcttagattcctttaatattcctcttagattctaacagtcacaccttgctttcttcaacaactcatagcttgctttaagcaagttatttaatttctgtaaatatgtatgcttagaaattttaaaactgttttgtgccaggcatgatgctaagagctttgtatgcagtatctctcatcttcaaaaatttattaactctcatgatgaagttttgaaggagagagcttttaaagaataataaagatagtatgagtaaacaaatagcttgatgttttccaaaattacttacaaagtaacttttggaacaagtaagttgtatgtttcaggttgcatcaaaagaccttgttctactcaggatgatttctaaaatttgctaacctttaagaaaatccacatataaaacattaaataggagataagtcaggagagattcgtcatataacacttttcaaataatttaaagctttacaagaaagaaaaaaaaaaaaacccttccttttccagccaaggtgcagtagcaggcagggactagttttgccctcatgcctgaaacaattttttaaaaaagacaaaatataggaagtgaagactctcaaggcattgggccaccaggcaattaagaacagtaatctcttagagataggtaactaatgaggtgggccctatgactgactgcacttcctgctgagagagttttcaagccccagcacaggaatggtggtctccctgaattgaagacacaaagctgagaatctggagaaaccaaggcagctgtagttagttcacagtactcgataacccttgggcactcggttgaatactaattaatacaggcatgaggaagctaccgacggtgtgtgtagagtggaagggcaaccaaaaaaaatattacagggaacagtgcttcagggtgccttggaattactggctattcccaactgccagaataaaaagcttcatgattcccagggcatcagcaattctcaactggggacagttttgaaaccagttaacatttagcaacatccagagacattttcaattttcacaactggggcagaatgttactggcatctagtgagcagaagccagagatgctactaaatgtctacaatgaacaggatagccaccctcaatagtgaattatctgatccaaaaaaaatcaacagtgctgaggctgagaaacccagggtttgtaagatgagtcttgtctcagtggggaaaaaataacccttgataaaacagctctaatgccacctaacaaaacttaaaagcaagtacaaaaactgcttcctagaataaagttcaggaatacaaaaatgtaatatcaaaaacaagttaaaattcataatgcctggcatcaaaaaattattgggagtacaaaaaaagcagaaaaaatgtaactcataataataagaaaatccaatcaactgaaagtgagctagaactgacagagatgttaaaatagacaaggatagtaaatcagttattataactattcatatgcttaagttagaagaatgaacgaacatgttaagaggagacatacatgacaaacaacacactgaatggtgattaaaacattagacattacagcacaaaagtacagtaaatttaaaaacagcaatagaaactatctaaaaagaaacactagagaaaaaaggacaaagaaataaaacaaaaaagctcatagtatcagtgagccgcgagattataagaggccaaatacatgtacaattggaatctctaaagaggaggtaagaaggtggcagggggtgggagtaggggacagaaaaaaaatatttgtgtataacaggccaaaattttaccaaatctgatgagaactatacacccataggttcaggaagcccagtgaaccccaaataaaagtaacatgaagaaatctaagacaaggtacatctaaatcaaatagattacagtgataaaatcttaatagcaaccagagggaaaaaagataaatccattcaaggagacaaagatgaagaggatggcaaatttctcaactgaaataatgcaatcaataagacaatgaagtactttaagtactaaaatttaaaagctctcaacctaaaatttttgacatgagaaaaaatttgaaaacaacacaaaaagcatacaaaaaaaacctgttaacctataatacttcacccacagaaaatatttttttaaaggttaaataaagatcttttttggaaacttaaaagctgaaagaattgatcaccccagacttcaactacaaaaaaaatgataaaggaacaccttgaggtaaaagaacaatataccagatgaaaacctgaatttacacaaaagaaagaagaataccagaaatgataaacacatgggcaaataaatacataagatatttttcttattatttaaatctcattaaaagatcataaattgtttgaggcaaaaaaaaatttatatccacgttgtataacctttgtagatgtagaatgtatgacaaaacagctcaaaggctagaagagaaaaaaatggaactatgctttataagattcttacattatacataaaatagtatagtattacttgaagatagactgctatactttaaaatatattataaactctaaagcaatcattataacaatagaggtatagctaacatgccaataaagagataacaggaattgtaaaaaaatattcaactaattcaagagaaggcaaaggggaacaaagatcagatgggacaataagaaaacaaatagcaatgccaggcacagtggctcacatctgtaatcctagcactttgggaggctgaggcaggtggatcacttgaggtccggagttcaagaccagcctggccagcatggtgaaaccccatctccactaaaaatacaaaaattagctggtcatggtgatgcatgcctgtagtcccagctacctgggaggctgaggcaggagaatggcttgaacctgggaggcagaggttgcagtgagctgagatcgtgccattgcacttcagcctgggagacagagcaagacactgtctcaaaaaaaaaaaaaaaaaaagaaaacaaataccaatataggagatttaaacttgaccatatcaataatcacaacatgtaaatggtttagatactcccaaacaaaaggcagacattggcagaatggataaaaagtaggacctaactatatactatctacaagaaagaaaaccattctgaacataaggacacaaacaggttaaaagtaaaaagaggaaaacctgtgctaaaaataatcaaaagagagccagagtaactatattaatattagtagaagcagattttttttttttctattttagagacagggtgtcactctgtcactcaggctggaaggcagcggtgtgattagagctcactacagccttgaactcttgggctcaagccatcttcctgtctcagccttccaaatagctgggactatatataggatccactgtgcccggctaagtttttttttttttaattttgtgaaggtgaaatctcactatgttgcccaggctggtctcaaactcctggcttcaagtgatcttcccgcctcaacttcttggtgttggaattacagatgtgcgccaacttgccaggccaaaacagattgttagagcagagaatattgccagggacaaaaattataacttaataataataaaaagatcaattcattaagacgtcatgacatttgggcctaagagcacagtgtctaaatacatgaagcaaaaaaactgataaaacagaaaagaaacagatacatccacaattgtaattggatattttgacacctggatctcaataattgacattaatagaacaagtagacagaaaatcaagagaatataaaagacaaaaacactatcaactgatttgtactaaaaggaatttctagaatactccccacaaaagacaaaagcagcagaatacacaccctcttcaaggatacatgaaacacttattaaaacagatgatcttctgagccatgaaacaagcaccaacaaacttaaaagaattcaattcatatagaatatattcttggaccacagtgaaattaaatcagaaaacaattacagacagaattctagaaaatcctgaagtatttggaaacaatgtaacataattgtaaataactttagggtcaaagaagaaatcagaagataaactaagtattttgaggtgaacaaaaatgaaaaccaaacaaattaaaatttgtaagatattgataaagaagaacttagaaatttattttttattttattatactttaagctctggggtacatgtgcagaacgtgcaggtttgctacataggtatacacctgtcatggtggtttgctgcacccacatcatctacattaggtatttctccgaatgctatccctccccaagacccccacccccagataggccctggtgtgtgatattcctctccctgtgtcagtgtgttctcattgttcaactcccacttatgagtgagaacatgtggtgtctggttttctgttcctgtgttagtttgctgagaatgatggtttccagcttcatccatgtccctgcaaatgacatgaactcatccgtttttatggctgggcatagtattccatggtgtatatgtgccacattttcttcacccagttgtatcattgatgggtatttgggttggttccaaatctttgctattgtgaatagtgctgcgataaacatacatgtgcatctgtctttataggagaatgatttataatcctttgggtatatacccagtaatgggattgctgggtcaaatggtatgtctggttctagatccttgaggaattgccacactgtcttccacaatggttgaactaatttacactcccaccaacagtgtaaaagtgtttctatctctccacatcctctccagcatctgttgtttcctgactttttaaggatcaccattctaactggtgtgagatggtatctcattgtggttttgatttgcatttctctaatgatcagtgatgatgagctttttttcacgtttgttggccatataaatgtcttcatttgagaagtgcctgttcatatccttcacccactttttgatgtggttgtttttttcttataaatttgtttaagttattgtagattctggatatcagccctttgtcagatggatacattgcaaaaatgttctcccattctgtaggttgcctgttcactctgatgatagtttcttttgctgtgcagaagctctttagtttaattagatcccacttgtcaattttggcttctgttgccactgcttttggtgttttagacatgaagcctttgcccatgcctatgtcctgaatggtactgcctaggttttcttctagggtttttatggttttaggtcttacgcttaagtttttaatccatctttagttaatttttgtttaaggtgtaaggaaggggttcagtttcagttttctgcatatggctagccagttttcccaacaccattcattaaatagggaatcctttccccattgcttgttttcatcaggtttgtcaaagatcagatggttgcaggtgtatgatgttatttctgaggcctctgttctgttccattcgtctatctgtcttcgtacaagtaccattctgttttggttactgcagcgttttagtatagtttgaagtcaagtagcgtgatgcctccagctttgttctttttgcttaggattgtcttggctatctagactcttttttggttccatatgaaatttaaagtagttttttctaattctgtgaagaaagtcaatggcagcttgatggggatagtattgaatctataaattactttgggaagcataaccattttcacaatattgattatccctatccatgagcatggaatgtttttccatttatttgtgtcctttcttattgccttgagcagtggtttgtagtgctccttgaagaggtccttcatatcccttttaagttctattcctagatattttattctctttgtagcaattgtgaatgagttcactcatgatttgcctctctgtttgtctgttattggtgtataggattgtgatttttgcacattgattttgtatcctgagactttgctaaagttgcttatcggctcaaggagattttgggctgagacgacgcaggtttctaaatatacaatcatgtcatctgcaaacagagacaatttgacttcctctcttcctatctgaatacttttatttctttctcttgcctgatggccctggccagaacttccaatgctatgttgaagaggagtgtgagagagggcatccttgtcttgtgccagttttcaaagggaatgcctccagattttgcccattcattatgatattggcggtgggtttgtcataaatagctcttattactttgagatacactgcatcaatacctagtttattgagtttttagcatgaaggggtgtcgaattttatcgaaggccttttctgcatctattaagataatcgtgttgtttttgtcattggttttatgtgatggattacatttattgatatgcgtatgttgaaccagccttgcatcccagggatgacgccgacttgtttgtggtaggtaagctttttgatgtgctgctggattcggttttccagtattttattgaggatttttgcatcgatgttcatcagcaatattggcctgaaattttctttttttgttgtgtctctgccaggttttgtcatcaggatcatgctggcctcataaaatgagttagggaggattccctctttttctactgtttgaaatagtttcagaaggaatgataccagctcctctttgtacctctgttagaatttggctgtgaatctgtctggtcttggactttttttggctggtgggctattaattactgcctcaatttcagaacttgttattgatccattcagggatttgacttcttcctggtttagacctgggagagtgtacgtgtccaggaatttatccatttcttctagattttctagtttatttgcgtaaaggtgtttataatattctctgatagtagtttgtaattctgtgggatcagtggtgatatcccctttatcattttttatcacatctatttgattcttctctcttttcttctttattagtctggatagcagtctatctattttgttgatcttttcaaaaaaccacctcctggattcattaatattttgaagagttttccaggtctctatctccttcagttctgctctgatcttaataatttcttgtcttctgctagcttttgaatttgttcgctcttgcctctctagttcttttagttgcgatgttagagtgtcaattttagatctttcctgctttctcttgtgggcatttagtgccagaaatttccctctaaacactgctttaaatgtgtctcagagattccggtacattgtgtctttgttctcattggtttcaaagaacatctttatttctgccttaatttcattatttacccagtagtcattcaggagcaggttgttcagtttccatgcagtcgtgtggttttgagtgagtttcttaatcctgagttctaatttgattgcactgtggtccgagagactaaatgcctataccagaaaaaaagaaagctctcaaattatctcagcctccactttaagaagttagggggaaaaaaagggccaggtgtggtggctcatgcctgtaatcccagcactttgggaggccgaggcgggcagatcacgaggtcagaagttcgagaccagcctggtcaacatggtgaaaccctgtctctactaaaaatacagaaattagctgggtgtggtcgcgggctactggggaagctgaggcagaagaactgcatgaacccgggaggcggaggttgcagtgagccaagatcgcgccaccgcactccagtctgggtgacagagcaaaactctgtgtgtgtgtgtgtgtgtgtgtgtgtgtgtgtgtgtgtgtggcgggggggggttgtgaaactccgtgtgcgtgtgtgtggcgggggggttgtgaaactccgtgtacgtgtgtgtgtgtgtgtgtgtgtgtgtgtgtgtgtgtgtgtgtggcggggggggggtgtgaaactccgtctcaaaaaaacaagttagaaaaagaagaacaaatgaaacccaaagtaataaatagccctatgtatattacagaaattgggtttttcgttgacctttcaatacagaaagatcaggagggtcaggagtcttcactgaagaattctgctgaaagtttaggaaataaaaaatactagttgtacacaaggtaccccaaaaaccagtgaataattcccaactctatgaggccagcatgaccaatatctaaaccagataaatacattacaagaaaagaaaaatacagaccaatatctcttataaatataaatgtaaaaattcttaacaaatggaatccaaagatagataaaaaggaaaatacatcataaccaagcgggtatatcccaggaataacatggtaggttttacatctgaaaattcatcagctacctagaatagaagtagtttccacaatctaaaaaaggcaactacgaaaaacagctaacatcacacttaatggtgaaaggctgaagactttcacctaaaacaaactagggacaagagaaggaaaaggatgtttactctcactgcttctattcatcactgtattggaggctctatttacttcagtagaaggcaagaaaaggaaataaaaagactctatactgaaaaagtaaatccacctttaatcacagacaacatgatcgtttatgtaaacaatcctattgaatctacaaaaaaatacctacttaaactaataagtgagattagattgcaggatacaaaaccaattttatttctatatatttaagaacgttttgaaaatatgcattttttaatcgacataattgtcatatttgtggggtataatgtgatatttagatacatgtatataatgtatagtgattaaattagagcaattagcatatccatcatctcaacctttatcatttctttgtgctgttaacattcaaattactctcttctagctatttgaaaaaaatataattattgtttattatagttaccctatagtgcaacagaacactagaacttctatctagctgcaactttctattccttaaccaacctctctgtattcgctacttcccccagccttcccgcctccagtaaccactatcccaaactccacttttacgagctaaactttcaaaaaacttcatttttgcttaagtggtgagactccttcacccagtcagttaaggagatcgaaatgcaaaaggtcaagcactactcaatcacctaaatggttatagtggcaaatgtttttctgaattgttcctgaagttaatctatacactttttctcatgagatggggagcatttaggaacagtttctatagcagttatttttcccattttctctgctttaacctaataatccagtctcctcctatgaaagttatacgcagtgtgaaaaaaaacacattttttctcatgtaattttggataatatattttcagaagtaatatacaacatataatttttacttaagtgatttgaaaggtatcgctgaccacaccatatcccaaactaaaaagttcggcaggtttactttcaattccatccaattggacaccaaatcccatgaagtctggctctgaaatagcctctacatgtgccatcaacattttaaaggccattactctcatctgcttcttcaaaaacagaaatgttatatatttgattccaatttaagtactatatatgttatagaaatttgtatatacaaacatttttacttttaaatgacagttatgctgctttagaaacaaaagctgcttagtttctcttctgttttatacaatatcaaatgcactgattatcaaaaactttataataaactcataaagaaaccaaagattatttaagatactgggtaggttatttactaaaatgcctccattattacccttcctatattactaatgcctcctgtcaacgtgattttgctgtttccactggccagaagtgaagtccactactggtctagtgactaacagaatataatggaagtgatgttgagccagttctgagtctaagcttcaagagacttcgtatgcttcattctttcttagaatcccacccagccaccactcgaacaaacccaggctagcctcctgcaggatgacagaacatgtggagtaagacaagccatcctgccgtggcccatcctatgccacccagcccccacctgctaccacagacgcataaataagcctagctaaagaattagccaaatgagcaacttgagttattttgaattattccttagtctgattctacaatatataaaattgagaaatatatattttattatattatgtcaataattttctgcattttctattaacttatatccaatggaatggtattcaaaaaaaaataacatcaactgatttccattgtttgagggagggcaaatccatgtaagtaaaactgaactttagtccattttttaaaagtattaatttcaggccgggcatggtggctcacacctgtaatcccagcacttggggaggcagagactggtggatcacctgaggtcgggagttcgagaccagcctgaccaacatagagaaaccccgtctctactaaaaatacaaaattagccgggcgtgacggcgcatggctgtaatcccagctacttgggaggctgaggcaggagaatcacttgaacccagaaggtggaggttgtggtgagccgagatcatgccattgcactccagcctgggcaacaagagcgaatattaatttcaattatataaaattgcacctatattaaattataggtattaaaaatacacatccaactgggcctgtacttattcgtatataacattcacttgtaccagaaacaactaatatttttaagtagctttttcctaaaatcaattaaaactatcttccacaatccttcatttatcaagtatggaagtatcaagttttaaggcatatactaataccaggctcttttcaaaatgttgggaataggctgggcatggtgactcatgtttgtaatcctagcactttgagagaccgaggcaggtggatcacttgaggccaggagttcaagacaatactggccaacacggcaaaaccctgtccctactaaaaaatacaaactttagccaggtatggtggtgcacagctgtaatcccagctactcaggaggctgacgcacaagaatcacttgagcctgggaggtgaaggttacagtgagctgagatggcaccactgcactccagcctgggcgacagactgagactcccaaaaaaaaaaaaaaattgggggaatatagtggagaacaagaaaatgcagatatctgtggtctagtttatattccagtagatcttcattaacaatgctaaatttctaagcaaaatcttgtgaaatttcaactattaaatgcgtttaaaggttgaaattagaattttaaggctaaaacacctactgcgttatcctatgcaagcatatgaaaataagtaattacgagcactggttaagaaaaaaagcctcctggaattgcttcccaattatcatgatatacaacatatttaattatcccaaaagcatacataaatgatgtagaatatacgttaaagaaaatataatgatgtaacatgaaggtttactgctcacaatactcaggagactgtctattaagtataaataattttttttcagagcttaggtactcaaacccttaaacattttagaacgtcccccaaaactgccataattcttaactataagtcatttcattttacacattcgtcatttttgtagtttctgtggcttcagacctagcatacattaaaggaaatgactgctttaaattagctttccaactggatagttctcaagggttaaaacacgaagacattatcttgtagctctaatagctgattagcattgcagctaacccgctacacgtacagaaaagacagaatggagcttccaaataatgaaataattcactaaaatgaataggagggatgacagaaatcagacagataaaccatcagttctaacagtacttctttaaaggattgggattgaggaggggcagagatgtgacatcaatgaatctgtaaggttctagatcttaaattctatgtagtggacataaagttaattgtttcattaatctaaatttctgtaggcctgaaatatttaataatttaaaatagactcaccgatcgattacaatttctttctgccttagaagtccttcttttattttcaacattgattcccacttactgaaatcctgatagccaggtgaataactttgacgagatgatccagtcaaaacctgcagaaacatgtttacacaattagtatactaaaatatttaaagaaaatatttatatattatcatattttcccaaagatttatattaaaaaaaaagaactccctctttgattttttaatactttcggaaatcacactatgaatacaacataacttggacaatttcaaggaagttctaaaggaaatgtatacatctaatgaagaattaatgacaacagaacgtttatcctggcaaattataaaactatataagatcttggccaggcgcggtggctcacgcctgtaatcccagcactttgggaggccgaggtcaggagatcaccaccatcctggctaatacggtgaaaccccatctctactaaaaatacaaaaaattagccaggcgtggtggcaggcgcctgtagtcccagctactcgggaggctgaggcagaagaatggcgtgaacccgggaggcggagcttgcagtgagccgagatcacgccactgcactctagcctgggtgacagagcaagactctgtctaaacaaacaaacaaacaaacaaaaccatataagatcttattcccattaccttgtggaagtggaagtggaagttttctggaaatgagattaatcattaagggagtaatacaatgtaggaatgtgccatggcttaactagacaaacattagcaggagattttccacaagaaaataaaagcagtatctgtagtattcagacttcaagttgacatgcatcacatcatcatttagttacattagaatttcaaaatcacaaatattttcactcagtagtgagacaaccaaatgcctaggcagataaaaaggggtccttggagaatctctgacccactccacaagtgtgcagatgcttctgtgcagatgaggaaacctgcccagggctcatgtgggcatgcccatagctgactggagcccagcatgcgttctgggggaaatgggtggagccatggggaattcctgccttatgcgggggaggagcctgctctcttcagctcacctggtgacctggaaatcaatctgtgaggtggaggacctgttagcagggctctatcttgctttgatgattgtttgtttgtctgtttcttttttccttttcacccaataaattcctttccaatcacccttcaaggtgtctgcatgcctaatcctccctggtcgtgtgacaagaacccaatttttttctacaacagtagtaagtatatccatagaaaatggaaaatatataaccatctactaagtagataatttggatgaaatatatcacttagaaaaaattgcttagaatgtaagaaaggtttcagatatttaaataaaccaacggtagaaactaacatggcagatatccttatatttcttccgttgaaaaagcagcaaacatttaaaaatattggtgttataggtttgactgtattccttaaaaagataagttgaagtcctaacctcttgtaacttcagaaagtgatcttatttggaaatagggtctttgcagatgagtcaagctaagatgagctccttaaggtaaggcctaattcaatgtttggtgtccctaaagaaaggggaaattttggacctacgtacacaaggaagactatgtgaagagacacagagacaatgccatgtgaatatcaaagtagagattggaatgacacatctacaagacaaggaaagccaaagaccaaaagctaggagagaggcatgggacaaattctgcttcacagtcatccaaaggaaccaactctgccaacaccttgatttctaactttcaacttccagaactgtgagacaatttctggtgtttaagctagctcatttgtgatactctgttatatcatctctaggaacctagtataactggtaaatcaaataggaacacagttctttggcaagccaaaagatgtataaacaccacaaagcaacttcaagagaattcaaatgtgtagtgatatttttatcctttactttccaaaaatgctattaataagaccttcaaaataaaccagtaattgcataacatcaaccagtcacagattaactctttgagatgactgtcaagtaatattaggatgggatgtttcatgcaggagacaggataggatgaacagactaaggatagagatcagttgaaaagaaggcacatacttttgtcagatgggaagatatttcaaaagtgacacatagtgttacaggggcaggttagacatctgcctctgaatttcattctctcccttgcctaatatacaataagggctgatattcagccagtatgcatcagtacagataatgttagctgttagaatactgaagtagtttcactgtggttggtaactaactgctgtttacaccactgtgcggactgtctctttcactgtccaggccactctccagaatgccccatgatccaacaaataacacagttactccccagcacaagtgaccttcaggaccccgctccatccataaataggcatcctttctgattagctagttcttgtacaagtcagtcccgcaaaatcttcccagttaaacactacctacaatcttatttatacttaattggcagagctaacattcaaacccaggcagcccaacaaaggagcacctgatcttaaggaccacattattccactgcttctactattgagacaggtttgcagcagaactggtttcacaagatacaggtcacaaagacctggcttataaaataggatggggtaaaaaagctggccaaaacttgccaaaaccaagacagccatgaaagcgacctctggtcatctttacttctcattatatgctaatcataatacattagaatactaaagtaaactcccaccagtgccataacatagtttacaaaggccatggcaaaatccttaagtcaccctatatggtctgaaaggtgaaggagaattctgggaattccttgccactttcctggaaaattcatgaataatccacctcttgtttagcatatgatcaagaaacagccataaaaatagccaaccagcaaccctcagggctgctctgcctgtggcgcagccactgtttcattcctttactttttcttttttttttttttttttttttttttaattgagacgcagtctcactcttgttgcccaggctggagtgcgatggcgcgatagagctcaccgcaacctctgcctcctgggttcaagcgattctcctgcctcgccctcctgagtagctggctgtagaaccatgcccagctaattttgtatttttagtagagacggaggtttctccatgttggtcaggctggtcttaaactcccaacttcaggtgatctgcccgattcggcttcccaaagtgctgggattacaggcatgagccaccgcgtccggctctactttcttaacaaacgtgctttccctgtactgtcggctcgctgttttccttcccgcacaaagccaagaacccatgtggcctcccaggctgaaccctagttttggggttttccctgtggcactatggcctaattaggtgttccaaatttcatcataaggactagaaaactgttttgaaagtaactgttctcagactgtgagaaaaaatttaacactataaacaatattattaacagaaactctctacttaatgaaactccgcattacctactgattatcaatttaatgggtaagtcatttgataaaatctcttttgtcaaactgtggctcaaacaggaaatttattaaagctagtaaaagctaaacaaaagagcattatcactaattccaaaactcaaagtaggatttggaaatgcttaaaatgatgtggtgaattattaaatctgctataatttataatactaatatttcatttacttgggagattaaaaataaatatctatttttatttacctactgagttatacattatttaaatcctaataacagttgacatgtactttaagtattggtttttgtatattatattattttgtatattattagcatgcctaacaaaaatcttctaggctagattaaggatttatggtctcctcttccaaagatctaaaataggtagattctctatttccaatgaccacacaccagcagtcatccacaccatattatttgaagctatatttcaccttatacatcttgtgcctatttcagtaagacaagtacctaggcaacagatgatgatcttctcaagaagacattaacactattttactcttcacaagtcatctgctaaaaaaaatttcccatggctgacaattaccttaagaaagtggcttttcttttctttttctttttttttttttaacgtttcttggcatcaagaaaaagattaaacagaaggaacaactaggcataaagagaaacagcaactgacaacactatttgctttcatagcactttgaaccattggcaggatggactgctaaagtacttgccaaatacttccataaatatacacaaaacaaaatatgagaatgtattattctgtgttgtaactcccttgatctaaaccctttagaaataaacaaaaattgagagctctgaaactgggaaaacaggaataaagaaaaaggattcctttccctgtaattaagatacaatatatttaaaatttaccaaaccagcagcagtcttccttatgatagtcttccttactaaacttaaaccctgattcataaaatagttaatagagagaacaaaacctgacatcctaccaaacgctgtaggttgacttaaaagtaattttttaaatccatgtgtatctacctacctctaaacatgacagttacggagacattttaccttctaaggagaatggcttttataatgaagccagcatctatactacattaaatgaagttatagaatggaatttgaagtacctagcaaaattcaagaataaaaaaatcatattgtgaagtctcaaacagcaaggcaactatacctttatgattttgcattctctataaacaactgatacactactaaaggcatacagaaaaggaacaactaatgaaaatgtattttcattataattgacagtctaggttccagtcttgacagagctaaaagaaaatctgatagaaataacacagaatcattttgcactaaatgtggaaataaatcaggtatctaccccggaaccatttatcttttgaaagtcctaaacaaaggtggaatagtgataagggaattagatgtgttcaaattgattcttcctcacatttccacattacaatcttacagagaagttattcaaaaactgtcaatttaatgtgtctgcaaatgttaaaggttttctgcctttatttataagacaaaattatcttctcttacacatttgatgagtgtttttatatgtatcacataggctaacaacttataaaatcttactagtatcagccaggcatggtggcttgtgcctgtaatcccagcactttgggaggccaaggtgggtggatcacaaggtcaggagatcgagaccatcctggctaacactgtgaaaccccatctctactaaaaatacaaaaaaattagctgtgcatggtggtgggcatctgtagtcccagctactcgggaggctaaggcaggagaatggcgtgaacctgggaggcggaccttgcagtgagccgagatcgcaccactgcactacagcctgggcgacagagcgagactctgtctccaaaaaaaaaaaaaaaaaaaaaaaaaaaattcttactagtatcaattatctattaagtttcaagtattatgcccaaaagcagtgaggagaaaaagccctttccctctgactatgatgccatagcaactttgagtatacataaatatctacttttaaagttctagatggcactgtcttagctttagtacattaatatatgattgtggaaaaggaggaaagccaagcgcaattgccttaaaaccttcagactaaaagttattgaaaatgaagcacaatataaatgttaatgttttcttttgttttattatagaccaggagctactgtggcttgcaaactatgttcttgcacaatactggctaacatgaaaaaatagatgcagagtgacagtatcactcttggatgtaataaaatccaggccaaaaaaaatcattaaataaaaataaagttttataaaactttataaggtaaaagataaaagttaccacgaagataaaataatcacaaatgtttacacatttaatagcatatctcatatgagaaaaaactattaagaataaatggagacataaacccacaatcatattaccaactttagcacacctctaagaaagacaccatgtaaagtggggatccagttcactcttttttttcacagcctgcaaactaaaaccggaattaatattttcaaatggttgaaaaaaatcaaaagaaaaatattttgtgcaacgaactaggcattgaaggaacatacttaaaaataataagagccatgtatggaaaaaaaaaaaaaacacagccaagatcatactgaatgggcaaaagctggaagcattccccttgaaatccagagtaagacaaggatgctctctcacaccactcctattcaacatattactggaagtcctagccagagcaatcaggcaagagagagaaataaaaggcatacaaataggaagagagaagtcaaactatttctatttgcagactttatgattctatacctagaaaaccccatagtttctctccaaaagttatttgatctgataaacttcagcaaagtctcagaatacaaaatcaatgaacaaaaatcagtagcattcatatatgccaacaacttccaattaaagaacacagtcccattgacaatagccacaaaaaagaataaaatacctaagaatacaactaactagggaagtaaaagagctctacaacaagaattacaaaacactgctgaaagaaatgagatgattccaaaaaaaaaaaaggaaaaacaacccatgctctggataagaaaaatcaatattgttaaaatgttcatactgccaaaagcaatttacagattcaatgttattcctatcaaactaccaatgacattccttacagaagtagaaaaaacttgtaaaattcatatggatccaaaaaacagcctgaatagcctaggcaattctaagcaaaaagaataaagttggaggtataacgttacccaacttcagactatgcaacaaagctacaataaccaaagcagcatggtactggtacagaaacagacacacagaccaatgaaacaaaatagagagctcagaaataataccattcacccacaaccacctgattttcatcaacgtcaacaaaaacaatcaaaagagaaaggaaaggactccctgttcaataaacaatgctggaataactggctagccatacacagaaggctgaaattgcaccccttccttatactatatacaaaaaatcaactcaagatgaattaaagacttaattatgaaacctaaaactataaaaaccctggagaataacctaggaaataccattgtggacacaggccttggcaaagatttcatgatgaagactccaaaagcaatcacaacaaaaccaaaagttgacaaatgggacctaattaaacaaaagagcttctgcacagcaaaagaaactatcaacagaataaacaaacaccctacagaataggagaagatatttgcaaactatgcatccagtaaaggtctaatatccacaatctataaggaacttaaacaaatttacaagcaaaaaacaaccccattaaaaagaaggaaaaagacatgaacagacacatctcaaaagacaacatacatgcggccagcaagcatatgaaaaaacattcaatatcactaatcattagagaaatgcaaatcaaaaccatgagataccatctcataccagtcagaatggttattactaaaaagaaaaaaaaatcagaggttggcgaggttgcagagaaaagggaacacttatacagtgttggcaggataaattagttcagctactgtgaaaagcaatttgatgatttcccaaaaactcaaagcagaattaccatttgacatggcaatcccattattgggtatatacccaaaggaatataaatcattctaccggagacacatgcacaacatgttcatcgcagcactattcacaatagcaaagatatggaatcaacctaaatgcccatcaacagtagactggataaagaaaatgtggtactatgtatatacatagtgtatatactatgtaatactacatagccataaaagaataatatgtcctttgaagcaacatggatggagtaggccattatcctaagagaactaacataggaacagaaaacaaaataccacgttttcacttaaaagtgggagctaaacatcgaatacacatggatacaaagaaaggaacaacagataccagggcctacttgatgaggggggcgggtggaaggatggtgagggtaaaaaaacaactacctattaggtgctatgcttgctgcctggatgacaaatcatttgtacactaaaccccagtgacatgcaatttaaccatgtaacaaacctggttatgtacccctgaaccccaaataaaggttggaataaaaaagtttgagagcaaaaagtaaataaaactgtactgtgttttataccataacaataaatctaaagatttagatgaaatggatcactttctaagaaaatatcaattaccaaaattaactcttgagatagagtatctgaatcatcatagaaaggattgggggaaaagtaagtctactcctaaaatgaagtactgattttttggatggtttctacctaaatctaaagaaaatataaaacagtagaagaagaaaaattttgagaaaggtaatagggctaggcttgaaaaataatgaagcatgttataaattgacagtatttaaaacaataatacatcttaaagcaaatacagaattcaaattaatacaatactatcattttgggggatcactgagattaaacaacacacttctaaataatacacaggtttaactgactgaaaatgaaaatatcaaaattttaaggaagcaggtaaagcagtactgagaaggaaatttacagcactaagcagttatattagaaaaagggaaaaagctctcaacctaagcttccatctttagaaactagaatataagcccaaagcaagcagatggaagacaagaaggctgagaacaaaaatcaatagagtttaaaacagaaaaaaacagaaaaatctattcagaaagataagctagttcattgagacaatcaataaaatttataaaccattacctagactgagaaagaaaaaaagaagaggcaagttattagggagtaaaatagatatcactacagaccatcagacattaaaaagataaggtaattactaggaacaattctacacacaccaattcaataacttgaattagaccaacttcttaaaaaacacaaacttacccaaattcattcaatatgaaataatctgaatgtcctataaactattagagtaattgaatttataattttttaaaagctcccaaaaaaatctctaggtccaaattgttacactgtaggattctaccaaatgtttaaagaattaacaccaatcctccacgaactcagaggcggaaaaaaaatgaattatttcccaactcattttatgagttcaacaatgctctgataacaaaaccagacaagacagtaggaaaaaagaaaatgacaaaccaacatccatcatgaacatagatacaaaaaactttaacaaaatcaaaccaaatccaatccagacatagagctatacatagataatacgtttggcatacggttttcccaggaatgcaagttaagtttagcatttaaaaatcaatgcaagctgggcgcagtggctcacacctgtaatcctagcacttttggaggccgaggcaggtggatctcttgaggccagcagttcaagaccaacctggccaacatggtgaaaccccgtctctactaaaaattcaaaaattagccaggcgtggtggctcatgcctataatcccagctactcgggaggctgaggcaggagaatggcttgaacccaggaggcggaggttacagtgagctgagatctgagatcacacgattgcactcccgcctggagaacagagtgagactccgtctcaaaacaaaacaaaaaaatcaatgcaatttaccacattaatagaccaattaaaaacctactagaaccaataagtgactttaacaagattatacaattcagggtcaattttttttaaaaaaccaattatatttctatatattaacaacaaaagggcaattaaaaatgtattatcatttacatcaaaaacattaaaagcttagaaataaaaatgtaataaattatgtgtaagatctgtacactgaaaactataaaatatcactaaaaaaactggccaggtgcggtggctcacacctgtaatcccagcactttgggaggccgaagtgggcggatcatctgaggtaaggagttcgagaccagcctgtcaaacatggcaaaaccctgtctctactaaaaatacagaaattagctgggcgtggtggcacatgcctgtaatcccagctactcaggaggctgaggcaggagaatcgcttgaacccaggtggcagaggttgtattattgacataaggatagacagaccaatgaaacagaataaagatccacaaatctaatgatgcatagagtaaactgattttttaacaaaggggaaaggtaattaaatgggaaattgaatttggtatttataaataccaaataaaggccaggtgcagtcagtcatgcctgtaatcccagcattttgagaggcctaggcaagtggatcccttgaggccaggagtttgagaccagcctagccaacacggtgaaaccccacctctactaaaaatataaaaattagccaggtgtggtggtgcacacctgtaatcccagctacttgggacgctgaggcacaagaatggcttgaacctgggaggcagaagttgcagtgaacaactgcagttacagttgagccactgcactccagcctgggcgacagtacagactgttttctctaaataaataaataataaaaataaatactcaaataaaactaaaaacacgtccacatagaaccataggcaaatgtttactcataatcatccgaaactaaaaacaacccatgggtctgtaagataaacggataaaaacggtactacatccacaaaacacagtactattcagcacacacaggcacacacacaaatttataacatgcaacaacatggatgaatctcaacagcagcatgaaaagtgaaagaaaccacactcaaaggctatcaactatctgattctatacatagggcttctgcaaaaggcaaaacaataagaatcagatcagtggttgccaagcggggtagaggactaactacaaaggggcaaaaggtagctttctggagtgatggaaatgtcgcacacttctcttgtagtaaaatgatcctcatataatcgcagtttcactttctctggtttcagttacccacagtcaaccgttgcctgaaaatattaataatggaaaattctagaaataaagaaaattcacaaattataaattgtactccattctaagtagtgtgatgaaatcccacaccattttgtttcctctcacccaggaggtgaatcatccatttctccagctcatccacactgtatatgctatccacccactggcgtgtagtgccatcttggttaaaggaccaactctcagtatcgcagtatttgtgttccagtaatccttattttacttaataatggccccaaagtgcaagagtagtgatgctctcatattgttataattattctattttattattagctattgttaatttcttactatgcctaaattataaattaaatcttatagatttaatttattaaaggactactgtatacattcttcaaaactcaaattatagcattttatgtaaatttaatctttaaaaatcttaaaagttgcatgtaaattatacttcaattatcatattaaaatttgatttttctaaaattgtaggtaaatgtttacatatctcccactcaacaacagtagaagcaaaaagaacttatcataataaaattgaaacaacccaaatgtgttaacaaaggaatagataattaatggtggtagaagtatacactagaatactatatagcaataaaacagaactactattatacaaaacaacatagattaaattcagagacattatgctaaacaaaagaatgctagcacagaccatacataatcaataatggtaagtcagaacagtagagatgggtaggatataaggtgtcaccataaagactgagaagagtcacaagctaaacctactgggcattagaaattttgtatcctgacctgagtggtgattataaggggagatgtatgtgggtgtgtattggaatggagctattattaaagattaatattcctatgtactttactgtatgttagacatcaacaaaaaatataatacaggaaatacttatactttatttcactttctaccttagaagaagtattgaagggaaataaaggcctcatctgctagaagagaatccttaagtcccaaagatgcactatagatgacagaatgcactgtcgtggctgtaagttcctatctcatcatcactttggtgcaactccacatctgcaactagccatgagataagagaaaaggccagatgacatatataccctacaccaagaatgcatggatgaagaatgaagttgataacaacctacaagctggttcttaggcgctgtcagaactctaggagaacaaagaagccttctattaaggcagaagacaatcctgcttcctaatatagaaaagaggaaaggattttatattcaaataacttctcccctatatccctttagtaacacattttttcccaagtagttagaaaacaagaatttttattcagtaaagtcataactggctttgagaagcataccattgcatggcagttatatattactagtaaaatatacatcttgacaatatcccagaaaaccgaggtacttgttttgatagaaaaacatgtatcaaaattcacatattgataaatcataaaattactgttgctatgctgttctacttagaatttcaaagtaatctatcatgtttctacatcactgtaaccaatataagtaatctagaacatgttaatttaagcatataatttataacttattaatgacaaaactttgacatgaacatgcaatgtaaaaggtagttataaaccttgtaactatgtgagttaatttgaagaaacaaagtatgccatcaaagtaacatttcaaaatgtgtaaaggtgaaacagagacatttttacaggtaaacattttatatatatatttagtagctgccaaactcagggagcactgggaaggcctcatttagatgttttacctaaaaatgcatatgacacactgttctctaccctaatgtaggcatgtagaccctaaccatatagatttatagacccagaaaatatacataggtacctcttcttggaaatggcagattccactctcaaaattgagtaaggatagcaggcatctacaacaatcccaaacacatgctacttagatgagatccggatactatgaaaagttgccaaaatatgtcacttaatggccaaacatgctcctaataaaagtttactgtagtgcagctgaaaatagttcaaaattctttggcctggacaaatactgttaaatttagataatccagtgctaccacacttgactggaatacaacctctgcaattcttcaagtttgttatctctccttcacttgcctttgtctctgagcttattcatcactcacaacatgtcacgtaacacagtaaatcttcctctgtttcctggaatagtctatctgaagagatactctacaagtgttttctggtaagagtcataccttaactaaaaagtaaataaattcacaaagctcagtaatgaagatgaaaataatacaaataacataaaatttaaagaatctttattcaccaagagaaggaaaatatgaattatgttattactaaaagaactgtgcacttaatataaaatctacgtcttaactaagcccatgtaattatttatggagtgcattattacgtatttctctaacaacaacaaaaaaaccattctatcagtcaccccttcctattatactgaagtctgcatcttgaccctcaaagtttatattatagaagaaactgtttttaataatctaattatttcttcaatgtgtttttgttactaactctgtaagctttttgacatcctaatatgatttactgaaataacaattcaagtaaattgagttacttgaaaggtaaaagaccctgaaaaaatgataaaaagaaactgatgatataaatatatatataaaaaacatcttaagaatgcatatgcatgaagataaagggaactcaaagtatttctgatttccaacatgctaaacaactaaattactattatctcttttcttttggagggagaaaaatttttcctcttaaaaatcaatccagtttatatatcatcggttagtattatcatgtctttaaaaaattccaacaaagaaatgagccatgcatgcaacatgatctcattacaatcatagtacaaaagtgaagagaagaaatggtttatccaagacagacagtaacttactttctttaagcaaatcaattagaagattaggtaaaacaaatgaagcttaagtattcaaattaaggttaatcatggactttacttataaaacaaatagaatgtaatgttttccaagcattttgttgctataatttactttttaaatttttagatgaaatataaacagaatttaatgaatcaatcccttgtaattaacaaaccagacaataaaaatggaaaaaaaattaatgatataattgacaatttatgaaacaggtatctatgaaactgaaataaaagaagtttatcaaaatgaagtacttaatacaatatggctctattttggatcttgcccaaggttatgaatagcaaatttactacactatataaccagcttctactaaaacaaagctatagtacaggtgctaacattttaatttattttaaaaatcagactaacaacatatatttaatcaagtctttatcatattttactctcaagggataaaaatatttgatagtcatgcactgcataataatgttcctgtaaatgctgcacccttaagattatacctcattcttactatatcttttctatagatatatttaggtacacagtaacactgtgttacaaattgtttacagtatttagtacaataacattctgtacaggtttgtagcttaggagcaaataccatatagcctaggcgtgtagttgttagtcggctataccatctaggtttgtgtaagtacactctacgatgtttacacaataaagaaattgcctcatttctcagaatgtattcctgtcattaagtgacaaatatgttaagggaccaaagcactgcctacattatcttgaaatgtagcaatgaatttttctaaaaggatataaaagaaactattttttacttttttttgttaaattttattttaagttccgggatacatgtgaaggacatgcaggtttcttacataggtaaacctgtgccatggtggtttgctgcacctatcaacccatcacctaggtattaagccccgcatgcattaggtatttatcatgatgctctccctccccccaaaaaaagaaactactaaagggagctatcttgaggggagagggagcatgcttttactttctatcaattgggatttatctgacttttcctaccatttacatattacttttttcttttctatctgtgcagttatgggtcactaatgttttcttcttttatatgttaaaaatatcatttttaaaatggtctcaggagtcaacaataatctcatggtgaaactgttgagtggagttcagacagctccctgtatatgtataggtcataaaacaggaacaagttgattgctgatgccgatgtctttttttttttttttaaatctccagagtccagttcatcactggcctatagtacacaattaacaaaaagaggatgagtagctagaacaccctagggatatttatcagccttgaaaaaaatccaaaagtatttccaacagcaaaaacaggtactgtaattagcatactgtaatagtaattatggcagtggttcctttcctgtatcatgataagttgggtcttattcatttgtgccctgatactcagcacagcacctgacaatgtttattaactactgactgatatgaaaatttggagatttctacagaaggttaccattttgttagcaatgatatgtgttaacagtaagaaatatctacacttaaaagattatagctcaaagatcagtatgcaaacctatgtttgattaaaaatcatgctttctggccgggcacagtggctcacacctgtaatcccagcactttgggaggccaaggcgggcacatcacgaggtcaagagatgtagaccatcctggccaacatggtgaaactccgtctctatactaaaaatacaaaaattagctgggtgtggtgatgcacacctgtagtcccagctactagggaggctgaggcaggagaatcgcttgaacctgggaggcgaagcttgcagtgaaccaagatcacgccactgcactccagcctggcaacagagcgagaccccatcttaaataaataaataaataaataaataaataaataaataaataatgctttctgacccttgcggtctagcctcatttcagtcagacctagggaaacttcaactaatctgcacaactaattttagtttgctattaatatagagataaatttgaaagacagtcttcaatggccatacttcgttctattttggaagtgtgaagtttcaggagcatgttttcattgtctaacattcattatacggactcatacttatccaaatattgaattttgggttatgttactttttcaagttagctaagggaaaaaaaatcaatgtattaatactggagtcaacaatcaacttttcagatatccatagtaccctcaattaagcaataagcccattgagaaaagaatacattaacggggcagccttacaaatgactttgccaaaggcatcctcttgatcctaatgttggtcctggagcccactcatcacctttgaccaactgaagggcaaattaaatcagcagatgatgagatgttcatgcccttttgctatgctatgcaagcttttaatttggagatgagttaaggatgaagtat

SEQ ID NO: 564 - DNA, 7243 bp, Homo sapiens
tgatgtttcactacgtaaaggtattaatactcatagacggattcctacatactgtcctcaaactagtgctgctggttaatcctacttactccaatgtctaaaatattctccgtgaatgaggtatgcacgcaaccactgaaacaaaatctatgaactcaatgaccattgaaacaaaatctatgaactcaatgacaaagaagcaatatatgttcttgccaactcaaacttacatagatgagtcatccaaatatatatatttttaattgtctttttccatgttgttttaattatttcataatggcatatgttgtgtgaaagaaaacaacaataaaacaaaacatagcccaaaactaacaaataaaaagattactcaataattaaagtatatatcagattttctcttccatctcaatgtaataaattctcattggatatgactaccctgaagactgtcaaaaggagaagatagctgttgtttataaaaataaggtagtctgcaatcctatcagcctgaatgcactttctctcatttgatcttgtgaaggtaagcagggtccagcctggttagtacttggatgggagaccctctgggaatattggaagctgtaggcttttttttttttttaaacaaacaaacaaacacacacacacacacacaaacaaaaaacagctgggcgccatggatgatgcctgtaatcctagcactttgcgagtgctcaaggcaggctgatcacttgaggccaggagttcgagaccagcctggccaacagggcaaaatattgtctctactaaaaatgcaaaaatcagcctggcttggtggcgcatgcctgtaatcctacttaggaggctaaggcatgagaaaggcttgaactcgggtggtagaggttgcagtgagccaagatcacaccactgtgctccagcctgggcgatagagggagactatctcataaaagaaacaacaacaaaagaataaaatgcctttgagcaagcaagtttacatctagagattttccaaagaaataaaattatgtgcactaagatttaggtaaagtgatattcttcataccattatttgtaataggagaaaatatagaaataaccaaaatgttaaaaacaggtcaataattaaataaatccagatatattcttatgataggacactgtgcaacctctaagaaatcacaatgtaggataatgtttaataatatggaataaagtttgcacaacatgattcaatttaaaatgcctacagaaatagtctacattatataatgtgctccgaattttgtttaataggtctttgtacatgatgtaaaatatatgttgagggtcattttttaaaatgcatatgaatgtccaattgttctagtaccatttattgaaaatattattctttctccaccgaactttctttatatctttgtcaaaacaattgactgtatatgtctgggtctatttctggactgtgttccactcgtttatatgtttatccttcagcctgtaccacactgaaactagctagtataagtcctccaatcctttttcatttgttatttatttatttacttacttatttattttaggtaccagagctgccagcaaagtcctccaattctttttgaaaactgtactggctattctagtaggtcttgtgcttttatgtatacattttaaaatcatcttgtcaatttctacaaaaagtctgtgggcgttttgattgggattgtataaaaagacctcaataacaaaaaaaatcacccaaatcggccaacttgaatatttaaaaagacatacagattgcaaataacttaacaaaatatgttcaacgtcagtcatcagggatatacaaattaaaaacaaaatgtgccaattctgagcacagtgcctatgagttagttagtcctgctccacaaggagcacttaaagtcacacacacacacacacacccccacacacacacacacagagatggctctacacatctagcagaatgtcaaccaagcaaataaacaaaaatgtcacaataccaagtgttagaaattatgtggagcaactggaaatcttacacaagactggtgtgagtgcaaaatggtgcaactacttcgaaaaatagtttggcaggttcttataaagttaaacatatattttgctatacaatccagagtctcacttttagattatttacccaaatgaaataaaaacttacgtacatgcaaaaacttgaatgtgaatgtttataaatactttatttataatcatccaaactggaaagaacccaattgtccatcaactagtaaatgaataaactgtagtacacccattcagtggaatatccagctataaaaaatgaatgaactggatgggtgcggtggctcacacctgtaatcctagcactttgggaggctgaggcaggtggatcatgaggtcaggagatcgagaccatcctggctaacacggtgaaaccccatctctactaaaaatacaaaaaaaaattagctgggtgtggtggcgggcacctgctatcccagctactcgggaggctgaggcaggagaatggcgtgaacctgggaggtggagcttgcagcgagcagagatagcgccaccgcactccagcctgggcgacagagcgagactccgtctcaaaaaaaaaaaaaaaaaatgaatcagctattgacgcacacaatgacatatgttgtgctagataaaagaagccaggtcacattctatgtgattttgtttataaatgattctaagaaaagacaaaactatagatgtggaaaactgcttcctggttgcagggggcctaagggcaaggggaaaagataaggccattttttaggtggtagaactttcactgtgaaatttaatagttacacaactgcataagtttgtcaaaactgatagcattgcgtatgaaaaaaagtaaattttagtgtgtttaaattatacctcaattacaaacaagtacaacaaaacaaaaaaaagtagaaaattaaaagttaaggctgtcatggtagtacttcataactgttgacaactcctgctttaagcattcaatttcacatgtaatttttttttttttttggtgagaaggagtcttgctctgtcttccagcctggaatgctgtggcgcaatcttggctcactgcaacctacacctccagggttcaagtgattctcctgcctcggcctcccaagtagctggcattacaggcaccctctaccacactcggcaaatttttgtatttttagtagagatgggatttcactatttggccaggatggtcttgaactcctgacctcaggtgattcgcctgccttggcctcccaaagtgctgggattacaggcatgagccaccgtgcctggcctataattgttatctcaaagcaaccttctcaataaagttctgtcgaaataagtaaattttcaatgttatgaaagtgacacagaatatctaaaatggtaaaagatatttaactactgatcacatcaacacaaaacaggcaatgtcccaatgtcacataataagtgggaagctaaaaacaagaactgggtgggttttgacttacttttcatgaattagtcttttggtatcatcccaggtgacctctaagcggtttatctccctgtcaacttcaggtgcaaaagctacatctttctgggcaatttgcttggctttgtctttcaaccaacatagttcatgctcgtgagaattcaattcatcttctagctgattaaacactcttaacctgtgaattaaaatgttattttcctattaatttactaaaggtagtaaatgaatatttcttctccgtaagtatatgatgagtccataaagcactcatttagacagctagaaaaacttttaacacagaaattaaattaatgtttatcaatggaaaaagtacttttaaagttaattttgcaaaataactcagactgtacctcagaaaacattgaaagtcattcttactactcaccatcaaccttctattaagtttgtattttctttctactttgctttgatggtagaagattttcaaaactaaggctgatctcataggctaactaggtaaatacttattgtaaaatctttggtaagaaatgtttctgggccatgaggttcaatccatgtaaataatagtgtttaaggattacagttgtttcattcaatatcaaattagctttactgagctctgcagaatatatatatatatatatatatactttttttttttaaacttaaattacctactttgttgaaaagattaccataaggaaatgatcatttttgtccctaatctattagtatctcagcatttataaaaagtggccatatcaccagccacagtggctcatgcccataatctcagcattttgggaggccaaggtgggagaactgcttgagaccaagaattcaagaccaacctgggcaacagagcaagaccctatttctacaaaaaattaaaaaaaaaatttagctggctgtggtggtacatgtgtatagtctcagctatttgggaggctgaggctggaggatcatgtgagcccaaaagtttgaggccgcagtgagccatgattgcaacactgcactctagcctgggtgacagagcacaaccctgtctcaaagaaaaaaaaaagtggccacaaagaggcagccatttactcttcattcttacagtttggtataggactgtagagttcacacaatgagtctacatgctttatcccatttaattcctaaaagatggtggctgggggcaggtgttcttattatccccaccttacaagaagagaagaggttttcccaaggtggcacagtgaagcattagtatggctggaatttaaataagtccattaattcaatacaacattttctgcacccgatgtgtgactttggtgagtgcagtgttgtgggtactgatgtggctcctgagctcaacctgggttttctactctggcaatttgaggatctcctgtctgcttggtctaagaaggccatgacaccctgcagcaccaatgatactgctggcatccagggtgagtgacactaggcaccttgttctctctttattctggaggctattttttcttcccaagtatcattcccttttgtaaatttattcttaaactaatcagataatttattgcctataaagggtataacctcaggagcccagtcccaatattgactccactatcatctgactaaatcctcgacataatggttgattctggttaaaaggaaacaaccagcaatggtctttcaggaacaacataatctttaccaattatgaataccttggcatgaatgcatttcagctgtttctttgcccactgaaaaaaatggaagagcaagtggccctgaaaacaggagtcagaaggttctattaagaagaaaaaaaattgaaaagaaggctacagttttaagaaaacagttacttttcaaatttactaagggaacttatctttgacccgtttgcttctcaaatgaactcacctgacaaaagctcagctttgcttacttaaacccactcctctgcctctccatacctctaagcaaacagttaaaagcagttgtagaaaatgactctgccaagctgattggtttcactttaaatgaacacagagctcaaatgacagttcatcaccttcctaagctcccctctacaagagaactgtttcacaccattttctttcctccaacatctgccctctcctctgaactaatgagcttgcaccagtctctaccaagaggctctcagccaccaaggaggaatttcctcatactttttaccaccaaaactactaggatcactacctttctcttctgccttcattcttgttatagaagatgaatcccttctcccatcagtaaaaaaattgtttaaaaacagataataagatctacatattctttgctcataaactgactttagggaaatccaaagaaattttagtacgtctcaagtgtcaaattagtcgttaatcttatcttcaaagtggtaaaaaaaaaaaaaaaaaaaaaaaaaagaagaggaagaagaaattgctaaatatggtactatcaaccaaaaagtatctgagacaggtctcaatcaatttagaagttgattttgccaaggttaaggacatgcccggaagaaataaatatgaaattacagaaacagtctgtggtttatacctttctccaaagatgattttgagggcttcaacacttaaaggggaaaaatgggctggaggggaaagagacagaataaggttaatccatgtgttgcaagagaaaagaagcaggcagggaatagtcaattacgaattcatctcgtgctcagtaaatcagcactttacctaagacaaggtgaacatagagtagctacctatggaattatttaatcttttctctgtatctatctgtttaggaacaaaaggaaaggcagctgcttgcatgactcaactcagcttaatttctttcttttggcagagtgaattggggtcctgagtttttattttccttgaacagtactaataaagttttgcataaaagttaattccagaacaaatacaaaagaaaagagacaagtggccgtgacagtttcctatttacctctgctgaagagcttggcgggtaggttctttcaatcgctctttgtcagtcctttcttcaatgtcctcaatgcttttcagaagctcctctttctggtcttggaatgcttttttcaacactgccagagcatctgcctcactctgcttggttcccagaaggttctggatcctctctacctctccacagagctgatcagccgtggctctgcaggaagtcctttgctcagagctcccgattttcagatggtattgggctttggaaagaatgccatccagactgacggcagcagattctaatgctttagcattttgaagagcatcattgaggtccttttctatcaaatcagactcgttcttattcatactgttggttgcttccactgtttgcctcagctggcggagaatgccggacagagaggcatggctctggaggaattctgccaaatgggacagggcaagctgccgcctctccacaacctggctggcctcctcaaacagctggaagcagtcctcagcctttccctgcaggaggtggaggtcctcagcacggcccagagaacccaactttgctaagtgaccctgcagactctgcaattcgccctttttgctctctacttctgctgcgtggtcctggaaggga

SEQ ID NO: 565 - DNA, 3944 bp, Homo sapiens
tgatgtttcactacgtaaaggtattaatactcatagacggattcctacatactgtcctcaaactagtgctgctggttaatcctacttactccaatgtctaaaatattctccgtgaatgaggtatgcacgcaaccactgaaacaaaatctatgaactcaatgaccattgaaacaaaatctatgaactcaatgacaaagaagcaatatatgttcttgccaactcaaacttacatagatgagtcatccaaatatatatatttttaattgtctttttccatgttgttttaattatttcataatggcatatgttgtgtgaaagaaaacaacaataaaacaaaacatagcccaaaactaacaaataaaaagattactcaataattaaagtatatatcagattttctcttccatctcaatgtaataaattctcattggatatgactaccctgaagactgtcaaaaggagaagatagctgttgtttataaaaataaggtagtctgcaatcctatcagcctgaatgcactttctctcatttgatcttgtgaaggtaagcagggtccagcctggttagtacttggatgggagaccctctgggaatattggaagctgtaggcttttttttttttttaaacaaacaaacaaacacacacacacacacacaaacaaaaaacagctgggcgccatggatgatgcctgtaatcctagcactttgcgagtgctcaaggcaggctgatcacttgaggccaggagttcgagaccagcctggccaacagggcaaaatattgtctctactaaaaatgcaaaaatcagcctggcttggtggcgcatgcctgtaatcctacttaggaggctaaggcatgagaaaggcttgaactcgggtggtagaggttgcagtgagccaagatcacaccactgtgctccagcctgggcgatagagggagactatctcataaaagaaacaacaacaaaagaataaaatgcctttgagcaagcaagtttacatctagagattttccaaagaaataaaattatgtgcactaagatttaggtaaagtgatattcttcataccattatttgtaataggagaaaatatagaaataaccaaaatgttaaaaacaggtcaataattaaataaatccagatatattcttatgataggacactgtgcaacctctaagaaatcacaatgtaggataatgtttaataatatggaataaagtttgcacaacatgattcaatttaaaatgcctacagaaatagtctacattatataatgtgctccgaattttgtttaataggtctttgtacatgatgtaaaatatatgttgagggtcattttttaaaatgcatatgaatgtccaattgttctagtaccatttattgaaaatattattctttctccaccgaactttctttatatctttgtcaaaacaattgactgtatatgtctgggtctatttctggactgtgttccactcgtttatatgtttatccttcagcctgtaccacactgaaactagctagtataagtcctccaatcctttttcatttgttatttatttatttacttacttatttattttaggtaccagagctgccagcaaagtcctccaattctttttgaaaactgtactggctattctagtaggtcttgtgcttttatgtatacattttaaaatcatcttgtcaatttctacaaaaagtctgtgggcgttttgattgggattgtataaaaagacctcaataacaaaaaaaatcacccaaatcggccaacttgaatatttaaaaagacatacagattgcaaataacttaacaaaatatgttcaacgtcagtcatcagggatatacaaattaaaaacaaaatgtgccaattctgagcacagtgcctatgagttagttagtcctgctccacaaggagcacttaaagtcacacacacacacacacacccccacacacacacacacagagatggctctacacatctagcagaatgtcaaccaagcaaataaacaaaaatgtcacaataccaagtgttagaaattatgtggagcaactggaaatcttacacaagactggtgtgagtgcaaaatggtgcaactacttcgaaaaatagtttggcaggttcttataaagttaaacatatattttgctatacaatccagagtctcacttttagattatttacccaaatgaaataaaaacttacgtacatgcaaaaacttgaatgtgaatgtttataaatactttatttataatcatccaaactggaaagaacccaattgtccatcaactagtaaatgaataaactgtagtacacccattcagtggaatatccagctataaaaaatgaatgaactggatgggtgcggtggctcacacctgtaatcctagcactttgggaggctgaggcaggtggatcatgaggtcaggagatcgagaccatcctggctaacacggtgaaaccccatctctactaaaaatacaaaaaaaaattagctgggtgtggtggcgggcacctgctatcccagctactcgggaggctgaggcaggagaatggcgtgaacctgggaggtggagcttgcagcgagcagagatagcgccaccgcactccagcctgggcgacagagcgagactccgtctcaaaaaaaaaaaaaaaaaatgaatcagctattgacgcacacaatgacatatgttgtgctagataaaagaagccaggtcacattctatgtgattttgtttataaatgattctaagaaaagacaaaactatagatgtggaaaactgcttcctggttgcagggggcctaagggcaaggggaaaagataaggccattttttaggtggtagaactttcactgtgaaatttaatagttacacaactgcataagtttgtcaaaactgatagcattgcgtatgaaaaaaagtaaattttagtgtgtttaaattatacctcaattacaaacaagtacaacaaaacaaaaaaaagtagaaaattaaaagttaaggctgtcatggtagtacttcataactgttgacaactcctgctttaagcattcaatttcacatgtaatttttttttttttttggtgagaaggagtcttgctctgtcttccagcctggaatgctgtggcgcaatcttggctcactgcaacctacacctccagggttcaagtgattctcctgcctcggcctcccaagtagctggcattacaggcaccctctaccacactcggcaaatttttgtatttttagtagagatgggatttcactatttggccaggatggtcttgaactcctgacctcaggtgattcgcctgccttggcctcccaaagtgctgggattacaggcatgagccaccgtgcctggcctataattgttatctcaaagcaaccttctcaataaagttctgtcgaaataagtaaattttcaatgttatgaaagtgacacagaatatctaaaatggtaaaagatatttaactactgatcacatcaacacaaaacaggcaatgtcccaatgtcacataataagtgggaagctaaaaacaagaactgggtgggttttgacttacttttcatgaattagtcttttggtatcatcccaggtgacctctaagcggtttatctccctgtcaacttcaggtgcaaaagctacatctttctgggcaatttgcttggctttgtctttcaaccaacatagttcatgctcgtgagaattcaattcatcttctagctgattaaacactcttaacctgtgaattaaaatgttattttcctattaatttactaaaggtagtaaatgaatatttcttctccgtaagtatatgatgagtccataaagcactcatttagacagctagaaaaacttttaacacagaaattaaattaatgtttatcaatggaaaaagtacttttaaagttaattttgcaaaataactcagactgta

SEQ ID NO: 566 - DNA, 1763 bp, Homo sapiens
tgctcttcattatggctgcattataacctaaaagatgtccaatcatgttattatacaacttagtatggaaatgcacaccaaaaacaatcaacacttggtataatctttgttcattctaaaaataagtacatattttctattacaatttaagatttttaaataaaataggcttactttcagattgtgatttcatttttcaagatgaagtcccagttccacccccttccttaaacgtagcctttgccagtaccagctttcccctgctgcaattccaaagcaagatcatttgtgctcctgaacacagtgcccacagactatgtcatgttcgctccaaactttacagtgggggtgccagagggcgggcggcggggggaggagggagcggtgttggcgcaggcagaagagaatgaagaaggaaaaggaggtagtctcaggctggttaggtttctgatttagatagctgctgctactacttatgagaaactctgtttgagagaaaatgtttttctgtcacttttaaaattattattccaagcaaaatttataacccaagagaaatactagttcaaaaggaaaggggtttgctgctgatttctaagttctggcaagaaaagtgagtcattctctccaaaagtgggatccctattccccctacccccaggagggtgtgaacaaaagccaacaagcaagaagacagagaggaagctcagaccacccagcctaaaggctgcatggatacactaaaacctcacagttcaccagaactgtttgttaccagtgtttcggtataaaatttgagaactaaatacaacaatgtattaaataaatttctaattttattagcctcacaattactcccgttagcaatgaaatgtggtgaaaccaatctctgaaaactatctaaaggtttctcactatgacaaagtatcattaatagttaatccagcccctcaacagaacaaagcctcttttaccctgactctgtcaagtagacagtagaagtaacacaagttcttagataactgtgagctgttaccaaactcaaggtgaaacccaatgctgtgttcagcaggaggccaagttttaaagcttttcctgcattattcttaatatatgaatatcatttattttactgataaaatacataaattttacagattatatcatagagtaatattcagaaaaaataagtatttttataatcttaagagacagttttttcataccagatattaacagacaactgaaactacttggttcactgatattgggatgtacaaagtcaaaaattaagctgagcgcagtggctcacgcctgtaccccagtactttgggaggctgaagtgggcagattgcttcaggtcagaagttcgaaaccagcctggataatatggtgaaactccatctctactaaaaatacaaaaattagccgggtgtggtggtgcacacctgtcatcccagctactggagaggctgaggcacaagaatcgcttgaacctgggaggcagaggttgcagtgagagcgaagactgagatcacaccactgcatgccatcctgggtgacagagtgagactgtcttcaaaaaaaaaaaaaagtcaaaaattaagatgttattatttattttattattatttgcaatttttgcatacaaacaactgtgaattcaccaaggcaatgaatgcctgatttctaacttctttggtaagccaacacccactcaaatcatctcaaaaacaaacttcattatgttaagaggtggtaaa

SEQ ID NO: 567 - DNA, 4273 bp, Homo sapiens
tccaaataccttctatttccaaaaaaaattactcttcctaaccttaaaactaactgcacaaaagatatccacaggaggagaaaacagtgatatttaaaaaataagtgctcactttgtaggccaggcgcagtgtctcatgcctgtaatctcagcactttgtgaggtcaaggtggttggatcacctgaggtcaggagttcaagaccagactggccaacatggtgaaaccctatctgtactaaaaatacaaaacttagcaaggtgtggtggtgggtacctgttaagaccagctactaggaaggctggggcaggaagacagcttgaacctgggaggtggaggttgcagtgagcacatatcatgccaccacactccagcccgggtgacagagtgagactctatctcaaaaaaaaaaaacaacaaaaagcaagtgcttgcttcagcagcatatatactaaaattggaacaatacagaaaagattagcatggcccctgcccaaggatgactcacaaattcatgaagtgttctagtaattttttacataaaaaaataaggccgggcgtgttggctcacacctgtaattccagccctttgggaggccaaggtgggtaggtcacgaggtcaggacttggagaccagcctggccaacatggtaaaaccctatctctactaaaaatacaaaaattagctgggcgtggtggcactcgcctgtaatcccagccacttgggaggctgaggcagaagaacagcttgaacccgggtggcggaggttgcagtgagcccagatcgtgccactgcactccagcctgagcgacagagtgagactccatcaaacaaacaaacaaataaataaatagaaacaaccaaaaagcctaaaactatggatgtaaattgtgatgtatgaaatgttacattggaaattataacaatataggttggataatacccagaaatgtttattgtaacaaatattaagtaataacatttagcagtttgtgtatacaaataatatacaaaacaaagaccttcaaaaatttcttatctgaagtgacaaatttaattaacgtttagtaatcatggattgctctgctcaggattatgttcaactgtatacagtatttttaattcaaacaatacattacagaacaaagagtattttaacatttatccctcataaatgaaaactgctaatattacaaaaaatagctccatattccctgaaaagtatgtcctgagagccaatctctttcctgctttccagtagtagttactttctgctccctgctagttcattttgtacagttttatgagggagagagagacagaagagaatacacatatacatttattaacaatatttggtaatgagcttttggaaaatgtttataaacagtatcatgctttatgtaccatttaccaaacattctagcctaatgctgtaataactgatctaaataccaactaatatactatatttataccattataacatataaatatacacagatttcttccagtcatttatatcagaaaatgctatgatgtttctgagtttgtttttgttttgttttgtttttttgagacagagtttcgctcttgttgcccaggctggagtgcagtggcgcgatctcagctcactgcaacctccgccttccggtttcaagtcattctcctgcctcagcctcccaagtagctgggattaaaggcgcccacctaattttattttattttttattttttgagacagagtctcactctgttgccaggctggagtgcagtggcgcaatctcggctcaccataacctccatctactgggttcaagcaattcttctgcctcagcctcccaagtagctgggactataggcacacgccaccatgcctcgctaatgtttgtatttttagtagagatggggtttcaccacactggccagatggtctcatctcttgacctcgtgatccacccaccttggcctcccaaagtgctgggattacaggcgtgagccaccacgcccggccaatgcctggctaatttttgtatttttagtagagtcggtgtttcaccatgttggccaggctggtctcgaactccgacctcatgatccacccgccttagtctcccaaagtgctgggattacaggcatgagccactgcgcctagccctgatgtttctggtattaaaatacgtatacagtttggctgggcacggtggctcacatctgtaatcccagtactttgggaagctgaggcaggaggatcacttgaggtcaggagtccgagaccagcctgaccaacatggtgaaacccagtctctactaaaaatgcaaaaaaattagccaggtatggtggcacatgcctgtaatcccagctactcaggaggctgaggcgggagaatcacttgaactcgggaggcagaggttgcagtgagccaaaatcatgccactgcactccagccttccagcctgggatacagaccaaaaaaaaaaaaaacaaaaaaaaaattaattaacttaaagaacactacttattggctgggcgcagtagcttatgcctgtaatcccagactttgggaggccaaggcgggcagatcacttgaggtcaggagttcgatatcagtctggccaacacggtgaaaccccgtctctactacaaatacaaaaaaattagccaggtgtggtggcacatgcctgtaatcccagctaatcaggaggctgaggaaggagaatcgcttgaacccaggaggcagaggctacagtgagccgagatcgcaccaatgcactccagcctgagcaacaagagcaagactccgtctcaaaaaataaataaataacactacttattatcaaataattattaaacttctaataaaggaagacaaaaaattcccaattccatgactgattatttatagccacaagataataaagcaaacaattgcattatcattcagattttaaaagaactatgagcaaataattcaattatcaaaaatcaactcatagctttaaaatgaaccttgggctggatgtcgtggctcacatctgtaatcccagcactttgggagacagaagcaggagaactggatgagcctaggagttccagaccagcctgggaaatacagtgagacctcatttctacaaaacattttcaaaattggtcatggtgttgtctgtctctagttccaactactggagatgctgaggtgggaggctcgactgagcccaggaggtggaggttgcagtgagatggtgccactgcactccagcccgggtgacagaacaagaccatcttttaaaaaaaaaaaaaaaaaagcagccgggcgcagtggctcacatctgtaatcccagcactttgggaggctgaggcaggcaaatcacctgaggtcgggagttcaagaccaggctgaccaacatggagaaaccccgactctactaaaaaaaacaaaaaattagccaagcgtggtggcaggcacctgtaatcccagctactcaggaggctgaggcaggagaattgcttgaagctgggaggcagaggttgcggtgagccgaggtcatgccattgcattccagcctgggcaactagagcaaaactccatctaaaaaaaaaaaaactttgcttatcgtataaaaataaaatatataccaaattttcaaattaaataacatttactaaagccaaaagcacaaaatgtttatttatgaaaaaaatcaaatgttatcttatttacaatttatagtatttttcttgaacttttcttaaaaataaatttggatattgatttgttgccacctactggttaaattcatatttgaatggcatttcacatcaaatattcactacagttaatagaaaacacagagaaaaaaagtaatgttcttttctttacaacgttttactaaactactatgataaattctgctttggaaaagtctgtaaagttacctcacaaaatggtggcttgacttttgacagtatcttcactcaaatttttctttagtgtgttgggactgttttaaaataccattataatttattagaaatataaaacctttaatgaaaatactttcaagatgttatttttaaatttacaactcaaacatgtatatgtaccagtttttcagaatattggagttatatagaatttagggtattaccatctttttacagttgatttcttaggactgaaaaccaaaaaaaaagttctcattacatttgttgttatacgtcttaagtaaattttactctatagcaatctctcctctaaattcctttttcata

SEQ ID NO: 568 - DNA, 38716 bp, Homo sapiens
gagtatattaaaattgaaggacatttacttgctgcttctaagtggtgtgaacccactgttaaacactgagtatgtattttatcccaggttctaagctcagcattgtgggcaatataaatatcactcagaaggatataaaacaaacttcttactctcaaaaatctacaatgtagttaaaaagttgtatcttgaatctttctttcaggttaaggtaaaaacactgcttttattatgtgagggtagaggaaaataaagggaagttgatgcatcctctttaagtcctctcaatttatgttacacacagctgtagttgtcatgtgattctgaaatcgtagaaaacactgaggcgtacttgtctaatatccagaaatgtaatcttattccttcctcccctctctcagtgggaatgacataggagggagtccctgggtgtttcttcctaacctattaccatgcatctcatgtctgcagtctctccctggctttgtctttgaggagtgcataggaaatggcaggactgacgttgagggttgggcatcgagtgcatgaggtcactagttcgggtcattgattgtcatcatccacgtgtataggaagagaacagtttttggatgttttccaaatgctgggaaggtgtgcaaattgcactaatttctcctctcattctacatttctctaagaagttaataacattatttaggccctgttcaggctgtctgtcaccatgcagttgaagtatttgtgtgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtggctcttgtctatctttgtgtgcctaagtatatgtaccactgaccttcaatcaagaggatagtcattgtccaaagaagactttggacatagcagacacttcttcctctcaggagaggaactgccctggtagccctcacaccttctaccagacctgacgctcctactgtaaaacctgtgaggcgggaccaggcgtggtggttcacgcctgtaatcccagcactttgggaggctgaggtgggcagatcacctgaggttgggagtttgagaccagcctgaccaacatggagaaactccgtctctactaaaaatacaaaattagttgggtgtggtggcacatgcctataatcccagctatttgggtagctgagggaggagaatcgcttgaacataggaggcagagtttgcagtgagccaggatcgcaccattgcactccagcctgggaaacaagcataactccatctcaaagaatgaaaaacaaaaccaaaaaaaaaacctgggaggcaatttactaggaatttctggaaatttgattgcctcacagccaccctgaaagagatctatttttttacccctctagccagtcgttctgtaggagtgaattaatctttctagccagttctcaccaggatttgatgaagctcccagggctggcatctacagagattactggatgttgaacaatttattcactacttccttggctcagaattggcaggacgtaattatcttaaaaagtgaggtatgtctgtgtttggcatttctaggatatgaatgaaccatcaagcttcgtgaatggggcagtttctccaggctgcagggacgcctctctgaaccaccctccctacatgccacgtaagaagccttggcctccttgactggcagagccatgactggaaggattacactggaggagcccgaggccaggggcagccccacagctgagggcacatcctcatggctgctgtggtttactggggaccagagacaaaagctctgcacgtgctttacccagccgggcatgggcaagtgactagactcattgagcaaatttcttgaaatttgtccagaaagcacttagcagagctcatggcacaaagggttctcacagctgagtttcttagtttttaggcttgtgtgaattccatcacaggaatttcttgtgtcatcagtgagtggaaattactggcttccccttatcatggagctgatggactttggagttacacttgggttcatatcttggctccagaaattgttctctctaggagttttgtgacttttcacagattatgtgatatttccaaatctcagtttgctaaattgtaaaagacggataatgagatcttcttcatagaattatggaaataattggaagtcaaaagcctaaatcagagcccgtcatgtagtgtttgacagctgtacgttcttcctgacacctctgcttccttcagtgaacttgatgttggaaacacagcaggcgccaatgcagctcagagctgggggcgctgtgctcatgtctctggggagatggagagcgacacaggcaggactgaagttagtcttaagatccagggcccagtcccttgaagagaagtcagggagaaacagaatcagggctgggtttcacctcgccagttcttcctcctcagatttggagtccagggacaggggcctgagcagcaagaccctttgtatggagagtcagcagatcctcccagacggctccctggtgcagcactacaacgtgcacaacctgtatgggtggtcccagaccagacccacatacgagtgagtctccgtctcccttctccagctgtcacaacctatagcgattgccagtgactgacatagctaccctagttttcctttcattccatttctaaggattaagaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagagggaatggcgtaagcctatttctataagcaaatagtgaatttttttttttcccgaagtcctgggtaccaaagtgctttatgaaagccacttgttttggggtagacagatctctcctgtttgaaaaaggaaaagggatggaaggtttcctcaataggtgacctcctgggacatgaggcaagtgggcccaaggccatcacaattatttaacctctttcctaagtattttggtttctctgtcctggaaaatggtgccactgccacaccttgtttatgtttcattttagaatgccagaaatgtcactgcatatttccctagagcccgctggtatgattactacacggtaagtttttctgaatgtttatacaacacgggaaaatggtagagagtacaaaggctttagatctgatagaccttaggtcaaatgctggctctgtaacccacctgctgtgtggtcttagagaagccactttaacccttgtaacctcggttttctcacctccaagtggagtaagaccacttccctcatagaactgttgtgaaatgacacataaagcatctcactcaggtttttcgtgggtgttctctttgtgttaatttttaatattttcttatatcactgctatttacaatgttttgtaaaggcagatgcttttgagattgtgttgcaaactatagtttttgtttttaatgtttatatctttacctgctgtaagtttgtaagcatagaggcctttttgtctctgtctttttattaaatatctccttccatagcatagatgctcaaagaagggcactgcacataattacctaaggtaagcaagtgattaggcaatgtgcaaaacacacacagaggtatgggacccaacccttgtgagtctaagcagtgcaagtgcatttagaaatgaggaagcaatgaagagctccttgccgcatagtttctgtgctattatgttccccaaagacttatctgggaagccagggtcttcccgggcagctctggggtggtgggctcttgctgggaccctgacaagtcagaccctgattcttggggaagaatcaaagaaggcatttccttggtctctaatggggcctcttctgactttctgaggagaacatcgttgagggctggaaatacagcaaaggggtacaagcagggatacaggaagcagagcatgtgctggcccctttcatccaaggggattgcagtgagattaggtgaaaactggagaaggatgtgcattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaacagaagatgtctttggttgaagaggaaaagacaaaagaaatcatggagcaagctatttagaaaaagatgaaattttgatgtttaattaaaatgaagatgaatttcatagttaatattaatgaagaagtgtcaccttaattaatcttcccaagtttgggtaactattactcattctagagcacaagctggcaaaaactatggcccacagccaaatctggttgttagctgatttgcaaataaagttttattggaacacagccatgcatatttgttcgcttgttgtcaacaataactgcttcttacctgtaaagtagcagctctgaaatgagaggattttgcctaccaggggacatttggcaatgcctggagatatttttggttgtcacaacagagtgggggtgaggaggtgatgcggctgacatccgaggattctgctaaatatcaaaaggcacaggatagccccatcgccagagaattgtctggccccaaatctcaatagtgctgagactgaaaagccctgctctagttgagaacatgtaggatggaagcatggtcccttaggttctgatacaggtgagagagtagcacctcttcctgtcacacatcaggcaaatgtagtttgtacagtggaagcaaaggcaagagaccctaacaagatattatagcagccttgcaagatttcttgcagcactgggtgaatgcagaatgggtaatggcaggtatgttgcaaagggtgatgagcaggcataagttcagaagggaggatgagatgtctggcaggatgcattgttcagggaggggcctgtcctctccttagtcatctcttaccttcttctgcctccagggtgtggatattaatgcaagaggagagtggaagaccttgccagcccctcttgaccacattaatcttcatgtccgtgggggctacatcctgccctggcaagagcctgcactgaacacccacttaaggtaagtgacaggactcaggttttcctttacatgtcagttagctcaacaatttgtaatgaagtccaccaaaatgtaagcatcactctcaaacccacatgcaattctactcaacacttgttttttctttgtttgcttgtttgtattttaacctttttcagactctatactcttcgactaattattaacagctcttttatgtctaagtgggtgagttgataggtctaagagtgtcatctttcaatctcacaattgaaatggaagtcaaaataggagccaccacgattcataatagttttagtatactattgggtctgattgaatatttcctaataaaactattgctgaaaaattgtttattcctctacaagatgttaaaattctagatcaaagtctatgtataaattaaccatagctaacatccagtgagtgcttgccctgtgcctagaactatatgaatatgggcatttccatgtggaaattatctattttttcttagcaaaaggaaaacataaattctgtgaggttagtactgttaccaccatttcatagatgagcaaaaaggctaagtgatttgctcagagtcacacagctactaagtacatgaatgcggactaaaattcacatctctctggtatcaatactaacattcttagactccctattcatttgattctaaagatttaaataaaaatgaagaacttaggacatttgaaaatagaact

SEQ ID NO: 569 - DNA, 32684 bp, Homo sapiens
gaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagag

SEQ ID NO: 570 - DNA, 31338 bp, Homo sapiens
gaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggc

SEQ ID NO: 571 - DNA, 28880 bp, Homo sapiens
aatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggc

SEQ ID NO: 572 - DNA, 29824 bp, Homo sapiens
aaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtac

SEQ ID NO: 573 - DNA, 31881 bp, Homo sapiens
aaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccat

SEQ ID NO: 574 - DNA, 142395 bp, Homo sapiens
aaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccattgctaatcatccattctccttgttttatgcaatgtcaaagaccacttcattttgctttggataaataagttttatttgatgaatgctgttgtcatttaaattacatacaaaaaaaatgacacaattacattaaatacatggaaattaaatgcccgtctccttcctacacacccacacacatttacatatctatacctttgtcatgtcatctcttcccacaaattataattttagccattttttctgtatttaaaatgaataattatctttcaccagttaaaacacttttatttgcttgcagaaacgtaatcattttctaataaaatagtagcagacactgcagtaaattctagccagaatttggttattatattaatctcacttcccatcactgaattcctttgcagggtaattagattgctatctgattctatcttgagtccaccaagtcaaggtgcaggcaggtggaaagtgtgttaaataagtgtcctgcttgatgggttctttttaatgccgatgagtttgtgccagtacaaataaaattatataaattactgtcaatcattagaggtttaaaaaagccaggttatttattatgatggtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggctaagagtttcttataagcatttcatacatggctaattatttctccagctttactatgcacagctatcaacctaagccctactctagctgatcatccctaaattcccttcagaatcctgccatattagagtaggagaaagagatgatacttttgtgtcaagtgagtagagtgagaatatgtcagttttcatatttatagagtgacgtttgacatctttaaagagaagttcctgaccttccctttgtctttttctaaccaagaaaatgtcagccacttccattgcctatctccagccgcatctagtacttctctctattccaaagcttcaacatactcttctgtcattatctgatcatctattggtcttcctctttcatttcaattcaagggaccttgacttatttctcatggttgtcttatcagaacagttcctgatgaaattaatttactgaatgctggaacaattccagccttcattacataaggaattcagtgaaaccttccttaagctcacaactctagtgtcaattatatattataaacacacaatcacaaacatttttaaaaacatgtctgcattataatgtcaaaggtagaaagaaattgcccatcatcgtccaggttgtcttgaccatccttaagagtgccttctacatttcccttccatattttctttaatgatagaaaattgtgtagaagacaatagaagaggaactaccccctctaggtcaataagacttttcaaccacccccaaaggtaatatctaaattgtacaaccagaatttacctgactggccagcatatataaaaggggccattacaaaagtatggcacacaggtcagaatagagatattcttctgaaacaaattacaataaggtcgggtacagtggctcacacctgtaatcccaacactttggaaagccagtgcaggtgaatcacttgagcccaggagttccagaccagcctaggcaacataatgagaccctgtctctccattttttagaaaaaaaaattagcagggcgtggtggcacacacctatagtcctacctacttgggaggctgaggcgggagcgtcgcttgacctagggagttccatgctgaagtgagcagtgattgaaccactgcactcagactgggtgacagagccaaaccttgtctcaaaacaaaaaatgaagaaactccacaaaatcacaatgacctcctcctccacagtcaatgatactagtggtgaaaatgatatgaaattccggcaacttttaaaaataaaatttattcctacaaatttttgttgtcgttgtttattgtttttgagacagtttctggctatgttgcccaggtcataatacagtgatgcaatcatggctcactgcagcatcaacctccccgggctcaagtgatcctctcacttcagcctcctgagtagctggaaccacagtcacacaccaccatattcagctattttttatatttttttagagatggggtttcacaatgttgcccaggctggtctcaaattcctgggctcaagcaatcctcctgccttggcctcccaaactgctgggattacagcatgagccgctgcacccggcccaaaaacatttttgaatctccttaacttgtttctaaatcaccactcttatttccactgaccacttaaacagatgacttgaattagttataaaactgctctggctgtttaatagatttgatataaaatacttttacattataatagatttgttttagatatgagtttttctttttgggaaaatgatattaaaataaattttacttatatttttaaaaaaatttctcattttattgatagggtatgttttaaaaataagattctagtcttccattaattaaaacttgtgctaaaaaattaaaaaggttagcctttcaattttaaataccaaatatagaaaacatacatgttaatttacagaatgtgtacttgataaaccaaacttaaattgagcaaggaacaacatgacgcattttaaggcaaatacataataaatgctaaaatgttgtagcaatattctggctttaaagaaatattgattaaatttattaagactgggctttgtctcaacacttaatggcaactatgatttaaaattaattaaattatgtttaacgctactgtgcatgtccttgaaacctcagtcaaattatatggtcattagctttcatttttatgataatgaaacaaaaaatacagtttccaaaatatatttttcactaaatctatggctaaaattgaatttaaatttctaggtttttttatttaatcaaaaaggaattttacaattcaatcaattgattgaaactaaaacttcaaattagggaggatttaattcaagcctgctattgtatttattattatttaaatataacatgcagacgcctaaactacacagcagacactctattaggttttgtatatatagaatcacacacacatactcccctagtttgtgagaaagtgctctaatattacagacacagattaaagtttagagaaatcaacttgtccaaggttacatagctagttgcacacacagaattttaaatcattcttatgtgactctaaaagaaaatacggaagtgaactgattaactttgcagttaagtttgcaggaataccctgggcaacacagaccctctgtcacagccaaatgttttgtttcgttgttgttccttaaatatgaccaatgctgtcaattctgcaactatattcttgcatttcctcatggctggaaggtctcatttttttttctgtcctttagatattaatcatcctttaaggctaactgagagccacatattcaaagaagacttccaaaccattacactattgaactatcccagcttttacctttctcgtttgggaacttagagactcaacttatggtattattaatactgcctatcctcagaccccagagacaaaacatgctgtctactttctcagtatcctccagagagcatgttatagaaattgacacatagaaatgatctagtcaatatttatttactaccagttgctggtacctggaaacattcttagtagtcttggttttcctggagtcctaatatagtatagtacagccagagacctgtttggttcacagaatttaagtaaacttcttgatcttacggtgtctgctagcatcatgagaacaggcaatgcaatatcttaagaccagttaaaaggaattagttttgagaaaagcttatagaggttacaccactttgcccttcacagaatctttcatttcagccacaaacccacattatcaattccctttataagctgtggatgacttgtcaggaaagatagtaacagtcaaccaataaatggaacattgtctccctaattcattcagagatgtttgcccatggagatactacctggtgatcttgccttacaacatcttgggcccagagatattgctgagattcttgtatttcccctctcatgtccagcattaatgtataagtcaaatacccatattctgtaaattctacacatctaccagtaggcaaggctggagatccaagttcttattatttaatcaactaatcagaaaggaagttctggctgatatttagaagttctgttaacatttcatagaagtaaatgtacaatttcccagaagaaaagtatcttgggaacacagagaccatctacatggacaaaagtaggggctaataatgatatgttacctcttgatattttagagaggcaacattgcttagtgcataagagtcaagacctgtggttgaagtcctgttcaactctgtactctcaatattaccttaggcaaataattaatttctctacacctttatttccttatctgtatctatatctctgtcggttgagttacagagagggtagctatgaccattaaactagatattttctggcacagagtaagtacttaatatacaaattttatatatgtttcatatatcatatataattatatattagagttgtatattatataacaaatatacattatataatgtagtttgcaaataaatattatataatgcaacatgtaatattatatagtatatataatatataaatgtagcatattatttaaaaattaaaaatatgtataaacatatatttagaatagcttacttcaattttatttgaggaactcattttttggctgtccacaacataaggagtaatggattattggtagattttcacagtctgattgtcttttattagatttagatcttctttctttccttctcatttctaactttattcagtttatagtacttagtagtttacaaaatatgtttacatatatcattgaatttgatactcctaagaaccccataagcaaagtatgatctcttattatacatattctatagataagaaactgagcatctagaagttaagtgactgctcaagatcacgtggctaggagtttacccaaagcctaaacttaggtcttctgatttctaatctagtgtttctcctactataatatttcagtctgctttttcctttcactctaaggcttattattttcactaaattcaaattgccttttctgctttgttaaatactagagttagacatttgtaaagttaaacacacacacacatacacacacacacacacgacattaagggcaagatatatacttccaaggtttctgagaggtacagcttatacaaggaaaatcttttgtaagaaattgtatagatctacttattcatgtgctgagtacacattttcaattttgactattggtataatttagagaaattcaattaaaaagaaaaaaataagtactcctctttaggcatttattctgttcacctgaaagtatattcatagccattttttttttgttaatgttaaataacagatccctttccagggatcctttccagggatccgttaagtgcagtccatgttagagttaatgaaatagtaccacagtttcagagataataaatatatgggggtaaggaactcacattgctacgcttttttattctgtttgaagtgatttgctttttgaaaaattgaaaatcagtggaaagctagtgaataagactgattagatgcagaaaaccacttgtgttctacaggtaaattagaaagtttgttgctacaaaaaacatcccttcgaaatgtaggcatacacaatgatttttaaagttgttagaagaagtctgcacatgagctgttcattttctatttagaataaacgatgtgagtggttttgactcctttctcccagtggcccatgccatacttcaaatatgaaaggaaataaaactgcaagctttaaggaaaagataaactctcatgcctgctatatttgcagagtaatcaaggattatggtatatttatcccatttcctcactcctcccttcttgttatttcagtcttcctcatcaaaacacttacttttcactgaatcctccaaattagcttctcatgcatattcaccggcagatcacacagtgactctgtaatggctgcagcctctttgcaattgaggcacagtgggccagacccccaccaggcaggttgcctgttgctggtgtaggctctgggaggtgaacatcagctttgttattccagctgggtgctgcagtccttgaactagcagctttagtcttccttaagatagcatcgtcgttttaatgagagtgaatgcatagcaataaatgctatccaagtcacaactggaattctcctaaggggagatgacctttcatatttttaatgaagatttatctttcaatttccatgaagcaagtggctaggtattttgttatttcatacgaaaataaaaggcatctcatagtaattttttctttgaaaattatttctcaaatttttagacttttagtggaagcgcttttatcttggaagattccactaaaaaagtagaatatttaccactttgggaggctgaggcgggcggatcacgaggtcaggctgaccagcatggtgaaaccccgtctctactaaaattacaaaacaaattagctgggcgtggtggcaggcgcctgtagtcccagctactggggaggctgaggcaggagaattgcttgaacccgggaggcggaggttgcagtgggccgagatcgcaccactgcactccagcctgggcgacagagcaagactccgtctcaaaaataaaaataaaaataaaaattaaaattaaaattaaaaaaaaggaaaagtagactatttacaagatttacaagtaacctagttggattataacccttcctcctgcaaatttatttttctatgatcctagaaaggtcttcatagtataaggattcttttggacttttgtgttggagataacagctaaaagaaaaatatccatcctctgacacacatacatacctcattgtatttatttacttatttattttttattttttaatgaacttatggcttctactttcatagcaactgactagaactacacaggaaactatagacagcaaccttagttatttcctggtttaagtgatgggatgtaatcatactgtatagttgtgaatagataataaaattgcatgacaaaaatgaaattgagaacagacttctgccacccttctgtaataaacagtataggaacaacactagacactagaatgataagaatgtgtcaggaatagcccaatacaggaattcattttttgtctgccttggcatactgcattctttatcaacaaaagttatttttaaaatgtcacataataataatatatgttgtccctttttttaatcttaaaggatcacatgttaaataaaaggaacaattagtagactatatgaataccttcaaagcaattttctaaaacaataaatgtagtcagatttgaaaatcaatcaatttaattatatttgaaattatgatagtaaaaatctatatagtcttaattattagattatagtttacctatcttcattgcatttgatgaaaaactttaaagtagaattatactttgatataatttagttttacttaaatttgttgttgcactaaattatcaagctatattttctttcctggttattctaagtagtgtcaagcacatatcagaaaacccactaaattggtactttaacttttaaaaacagtcttattagtgccatgtggtttaaaacttagcttaattcaaacagatataattttaacttaaaactttttttgggggacggagtctcgctcagtctcccaggctggagtgcagtggcgcgatctcggctcactgcaagctccgcctcccgggttcaggccattctcctgcctcagcctcctgagtagctgggactacaggcgcccgccaccacgcctggctaatattttgtatttttagtagagacggggtttcactgtgttagccaggatggtgtctcgaaaaacattttttatatattaaagtgtttttcaaatttgacaatgtagaaaactataatattttatttcaagaaatgtgtataccttaatccaattagcacctagattctgacctatgttggcacatagtatgatcagccagggcaccagcatcttgattacagaggtgattggatagatccacccatgtcaagcagacccaaatgttttcttttgacttcgggctttccaaaagatacagtagagataacagaaggattgatgaaaggctgaaaccacactatgaacagcatacgtaatctactattaaaagttcctaattagggtagcaacaaaaactttagtcagatctggataaggcagtatctctggctgtgttcttgtctgtttctcctcatcctttttctgttattctcttaatttcctgcagagaggtagacattttagtccacctattttgttaatacaaaggagcagtttctttatattgtcgttaatttactgatcgtataggattatcaacctctttcattgcttaatgttcaaattttaaaaacactttttcataaactatgcttgcttctattgctctaacaatatttgttcctatgttctactctaaattatgcaggtttaaaatctttctcttattttgctgcattcttgtgaagtctgcatacagattcttgattcaaaaaatcatggtttctgtacctcttcctcaggagaggttttacagattctactgatttttggtagacagaaaccaacttttaaccagtgtactacttggaaaaactctttccaaatactgtagaggaaagatgttgggctttgaagccaaacagacttgtgtttgaaacctggttcccatgtttccagctgtatgacaatagcaatttacttcctaaacttaatggagtaatatcgtattaatatttatcccaaggtgtgactgtttggattaaatgagattatctatgggtgtcccaaagtcacgcaaatcacaagttcccatcttgttttttctctgtggttacttctttttattttttttatttttaattatttatttatttatttactttttgagaaggagtctcgctctgtcgcccaggctggagtgcagtggcgcaatcttggctcaccgcaagggctgcctcccgggttcacgccattctcctgcctcagcctcccaagtagctgggactacaggcgcccaccaccacgcccggctaattttttgtatttttagtacagacggggtttcaccgcgttagccaggatggtctcgatctcctcctgacttcgtgatccgccctcctcggcctcccaaagtgttgggattacaggcgtgagccgccgcgcccggcctctctgtggttacttctaatgttggaagtcatcacagtgaaattctttgtgctatcttcaccatgggaatctttctgtttattccatgcccaattacatatatttcacatttcaaactttatcttgagtgaaaagaaagaaggactagctcctgatatattcctcatggatattctcataaaaatttgagtgtttcttttccagtaaagtaagttaatcctttccaacgctctgattattagctcagcacctctatggtattatagttctttttgaaaaatactgcaataattttcattttcataaattcagtggaaactgagttgctccaggtagggtagcccaaagctgactgacaacttcaaagctcacagacaagggcaaaaagcatgtgtgctgctccttgtgaataatactacaggaaaaaaaggcaaaattcctattcaggtaggtagatggtcaaaagagtttcctacaagacagtgtcacgtgcaattttatctacattgttataacttccctacctgacaagacagtgtcaagatttgttaatgagatggcctcacaagtgtatatttaaatattttatgaaaagccattgtagctttctatggatctgacagtagttaaatgcatgagctcccaaggcctatttcaggggctacgtgtatatatctttttccttccaaagacagatgaaggtgtgcaagtcactctactgatttgcaaggacaagaaatgtgctttttctctaattcattctgatattagctattggagttctctttgccctatttcagcactgtttgtacataaatacaccttattactacagaaaaaaattccatgatgaaacctgaagtgctttaatgcactggtctgtagacacagcccatttttttttttctctttacctttgattatcaaggagtaatttgctcaccagcaaacactggataatgtaatatataactttctctaacagaacagaatacagtgagtaggcatttttgaacggtctgttttgatattttggtcccactattctaaattttggggatgcttgtgcggaggtaatgcttaatctggtatcaaataattgctatctgcatctgtgctcattaaatatcattttttaatccagaattttttcctgtactaaggacaaaatgaatattaggccttagacatttttatgtgacatctaaaaattgaagcaggtatatctctaagtaaactaataatggttgatgattttcataataaatgtgcacatttaacattttcctcttcaaattctaaaggttggaaagtgaaggtgaaatcctatatgaaattgtctatatatgctataggttataaatccagattatcattttagattctgtatgttgacatgacatgtaagaactgatgttgtatgaagagtaataataatgatattagaacaaaatgtaatttcctatcagcaatgattagtatttaataataaaatatattaataattaaacattttgaatatagccaaaactttgaaataagaaatgaaacacttaggtaataaatgagaatttagtcacaaaatactgaagtaatattttagctaacttattagcatttagccaaataataagaaaatacttaggttccacttacctaaaaataaatctagtgatgtttccagatgtttagaaaatcattttctttaattaagagatagatacatttctgtgttgtaataaagaatgcaaggagatattttcttataaacctgaaaaagatgtcttctgaatattctggaatctgttttgactcatcggctctattagactttttagttaagtgtctgtttttaagaagatataattcatggtgtactcaaaataatactgttggcagactgtatatgagctgtggaaaggattgcaaactgtaatgggaagtattataataggggatctccactctgctcagatacagggaacatttgataaaatatttcttgaatgaatgattattttacataattattatctagtataatgctatgttttcagataaaaatattttatgtgaaaatatttttatcagaggtcaactttaacgccaccaaaaaattgaataaacatttttgttttgctttcatttcaggtactagaaaattaccttgcatatcattaatagtttataggacttttatttgggaggtagttttcaaaaagttatgatttttgtctagctctgagctctataccagcctctccatcccatgcaattttcatatgtcaacctattaattttgaaacaaaacaaagatgcattgaaatatttctaaatgtccattctacatcgagttctgcaggcgatagtgttgttgcataggcatttaaacatttaaaaacttttcttttctttctttttttttttttttgagacgcagtctcaatctgtggcccaggctggaatgcagtggcatgacctcggctcactgcaacctccgactcccaggttcaagtgattctcccatctcaggttcccgagtagctgggattacaggcgcccgccaccacacccagctaattttttgtatttttagtagagacagggtttcaccgttttggccatcccgacctcagatgatccccccacctcggcctcccgaagtgccgggattacaggtgtgagccaccgcacctggccaaaaatcttttcaataaaacgtgagttctgtgggttgcttggaaaaatatattctagggttctttgaatttaaagacactaagtactctattgcagtcttgaatattaaaactcaaattcacattcacattttaaggtttatgaaaagtcaaaaagtccagaggattatttagtctagacctcttaacctagagctgccaaaacgtatttgagcagaaaatctgttttctctatatttctgttgtcttttttttttttttttttttgtaatccctaaaaacatccaaggaaaggacattgaaaatccctgggaaagaaagcaatgcctcctgagtttgaagactgggtctcctatcttttttctttacagtctcagacttagggatgtctttctttggataaactatttacttccttcattttctttacttgatctttcataatgggttacattgctattaaccaaaactatgaaacatgaataaagctgagaaaaccatcagtcaagtaacaggaaagtgcgcatatttgcccatactatggacatcccaatgttcccagcgggcaggggacaaggaggacatgaacatattctccaaagccaggggagtttcaataacatttttaaagtaatatgttgccattatggttgtcaaaactataatggcactatgttagataaaacagtatgaaaagcaatatcataaaaaagtagataaaggatggcatgattttatgtgttgaattccccaagatatagtacatttgtttttttccttgtgaccttggacaaaagtaacgatattctataaaaatgtggtttgtataactggagttagtgtcaggggtaaaatgaaagttggaacaagcagaaaaagaactatgtatggaaaagaaagaaaggattgtttaacaaactggtgatatgggtttctgtgaaacttgtgtagataagctggaaaaagatgaatgatggaggagcacccaacaaatattaatatataatgtcaacttaggggtaaatatcaagtgttatgcgtctctttgggtccttcgatttctccatttcgtacagtgctttagaaaaagacacacagatgtgctctcctaagttttttgtttggttggtcctttttattttttgagacagagtctcgctctgtctccaggctggagtgcagtggcacaatctcggctcactgcagcctctgcctcccaggttcaagtgattctcctgcctcagcctcccaagtagctgggactaccagtgcacgccaccatgcctagctaagttttgtatttttagtagagacagggtttcaccacgttggccaggatggtcttgatctcctgacctcgtgatctgcctgcctcgaccttccaaagtgctagcattacaggtgggagccactgcgcctggccttttgttgtttttggttttggtgattggacaaagaactctggagagctggagggatgacagaaacattgcctgacagaattatgacccaaagcacaactcaagcatatcaagcgctctgagaaattttaaaatatcatattgaatagtgtttaaatgtgctgtcctacatttgattggaaaaggacacctgcataaagacctaagaatgatttagcggcagtgcacacaaagaggagtcagttatttttacttatcaagcttgcaacagcacagtgtgaggattttgcgttcctgagcctttagtgtcaaattttttgtgtgtaaatccaggctctgacattagctatgtgttcttggtcagtttcctaagtaagtgtttgtcaattaaatcttttcttcatagggtttttcttattttgttaaataggattgttaagtggattaaatgagataggtgtaaaaaaatgcatgttatattatctggcacataaaaaatgtggtttatttcaataacattagatgttattatgttgtcttaattgtttgtatctggaaactttgtttctggatacgccatttaacaagaaatagaggctcactggaacatgctaagaggaaggaagagatacctgtcctatgaggcgtgcttgacaggattcgagtctggagataaagaccatgtctaaatgtcattccaatcctgggattccatgattttagagtatttctccttaatcccttcacttctctgttctttaaaacaaaacaaaacaaaacaaaaataacacgcatttttcttcatagaattctgtgatgagttgtattggtttttgttttgttttattaccatacacacacgttcacgcacacatagagcaaaattatctaacaattccatttttgacataaagttaaattgttttaagtcaggcatgcaatattaattaataccaactggttcatacatacaaaacaattaggccaggtgtggtggctcaagcctataatcccagcactttgggaggctgaggtgggtgaataatgaggtcaagagatcaagaccattctggccaacatggtgagactccgtctctactaaaaatgcaacaattagctgggagttctcgtgcgtgcctgtagtcctagctactcgggaggctgaggcaggagaattgcttgaacctgggaggcggaggttgctgtgagccaagatcgcaccactgcactccagcctggtgacagagcgagactccatctcaaaaaacaaacaaacaaacaagcaaacccaaaaatacaacacagtttcttataaaatgtatgtgaaaacagaatctaattttgtctctctttttctttcttactttcttcttcattttttgaaaggagtgggaacagtagataatgacctactgattgacacaattgctagacttttatccccactaccagaggtggctacccgtgggctccaaatcctattctgaagcatcaggttgccaagcaagtttgcacactgcctttctttcttcctttttccccctcttgtttcccctcatacatttttgtgtcagagattgataagttttgacaaaaggctagtggcttacattaaaaagttagaaccccaaaagccttagcctatacaataactgttcatttaagctctagtgatacatttacaccctggtatgtcagaagaacttttttttctgtcgcccagggtggagtgcagtggtgtgatctcagctcactgcaacctctgcctcctgggttcaagcaattctcctgcctcagcctcctgagtagctgagattacaggcgtgcaccaccacgcccggctaatttttgtattcttagtagagacagggtttcatcatattggccaggctggtctcaaactcttgaccttgtgatccacccgcctcagcctcccaaagtgctgggattacaggcttgagccaccatgcccagcctagaggaattttttaaaaagctaacactttttagtaaatatttacttgtaattaattgtaattattggggaatagatttttaaaaattaaatacttagggctgatccaatcattacatttgtatatttaagtacatcccatttaaacttgtctattactatattaaagttattaaagcaagtgaaacaggagtggtgacttttctttgagggaattttaatactggtggaaaaggccagattgccaacttttaaaactgaaatatgttgtcagtgggaacaaagtttgaaagaaatgtaacacaattttattaccaatgtctctaaggcgataaaatctttctaaacttggtagaaaaatataagaatgcaacttcctagcagccacatggcagttaattttggcaatctgttttgggccattgtaacccacaaatatcaataataactgaaatggcttaaatcttgtctaccgaaaggcttacgaaaaaggaaaagaaaggagagagggagtgaatatgggaggaggtgaagatacaccttaatggtgattcaaggctgcagcatattctgtgtacaaataaataggcttcaacacctgctgatgtgctggcatctggcctgaaagcaaccaacatctgtttgtaattttcagtgggagcccatgacagtgaagaactgtatactgtcactgaatatatggccttgttaacatactaaaaggatccagaagtgagatcatgaatggataatttgggacatgtgactcccatgtgatacggtgataagatttgttgggttttctttaaaggttgccattagagttttatcctgaaccattatttaatagactttaaacgttggaaagtgctttctagaggaaagcttattttaaaagagaattttcccaaccagcttacatcttccacacttttaggggatatgtgttttattggggtagatatggacattgtacaacagctcaaatttatgtaacccccagtgcccttgggagagcccatggagaagaacccagagtgtgagcaggagtcacagtggggttggctttgagcctcaaggcaggtcagaggggtacttcaggagtcctcctcccctgtctctaaaaacgctggagttcttgtgcttcttgattatggctccaattgtgatattttaggcagtaactcaccgttttgtcacctttcctctgatacaagtgctgatcaagttggtaaactcccaggtcagaaaattggggaagactttcctacatttctgttgagggaaatgaggaactgaggccttagaatttctctttaccatttcctcataatcaggaaagttctagagatgattttgtaaaatagtacattcatatctatctcgatggatcatgaccatttttctagtttcacggattcagtgaatgaattctctgttgtaattatttttaggtgtaacactatatgtagatgattgataaaatgcctaactcctaagagtggtgagggctccaccataataactacacatgatacatcattacaatcaggctttcattcagaatttctaaatttaagaaatattacctattatttgataatcttatcacctgccatcattcatttttgcaaatttgaaattttgtatctaacttagattgctgaattagattagcctaatataataaattcttattacattatttttatttaatatttaaagtgaagactatggaaggaatttagtaatgcttttgctagttaaaaacagtatttagttaataaagataaaaacaaaaatattgttctgcacaggggtaaagaggtaggtatctgtgacttctcttttattggcagttaagtttttgcctaagtgctgagactagatttagagcttccttctacagagatttgcctacgtttacaaacatacacattcctttaaaaatatgtgctgcatttcctcaaaaatctaatttttattttttaagaagttcaaaatttaaagcacttctactgtgactgtagaacaaaatagtggtaataattatcaagaatccaacatgtagatttaaacaagctatcacagttttcatctaattagacttttaaattttttttgtttcgtgattaattttaaaatacgtattcagggaatcaagaaaattttcaacttaaaaaaagtggatttctctgtgaataacatacaaaaaaagcttagtataaaaataaaactcttgaatatctacataaaggccataaacaagatcaatatttgtaaagcaatttcctttgctcattaaaaatgcacaaatttaaacacattaatatttaatttcatttttaattataaagaatacaagtaaaaatcaagcatgttcatttttgatggcttttgaaaagtgaagagtttgaaaaaaagaaagtgaaaaaaagtgaagagtttgaaaagtcagtcattttgttttcattttttgactcaggattgcttgggagagataaggacatgtgtatagatacagagacctgggtatggtaagtagtgggagtagaaacccaggtcaaagttgttgcagcatagaagtcatcatccaactagtctccatagacaatcattttaattttctatgcctggttattaattattctaataaaattagttatttgttcctaatttctttaatactgactacttttcacagttttaaagtatcgctaagttatttttgcccattaaataatatttctaagttataatatattttccaagtaccagaaagtaaacccaacaacgtgaaattaaactgtgtaatcttaattgagtgagatggtagttttgcctggagccactagtaaatctgtacttctccaagtgttaattagtgagtctgtattcaattttgctcagagaacatttgaagcactcaatatttaatttcttattatacaatgtctgttgctagaatcttgtacctgcgtcttagacacatgcatgttgttcatcctcagctccagaaaaacacaaccttaactaacatacataagaatattatatgctgtttatttttcaaatgaggtagttaattgttttaagttagattgtgctattttgaaaagaagggattccgtaagaggttacagtacattcagagtacttaaaatttatttctactatattttcttgaataattactataagttggcattttctatgtgctgtcttttataaatatctcccaaacttcattttatctctgctttataaatgagaaaattaaagattcaaagaagtgaatctgttcaacatcatctaacctgtaagttctaagctccaggatatgaacttcaaaacttatactccttaccacatgttatgcacttataactgtgggtttgttactcgctgtagacagttagtaaatgtgaattaagtcagattttttttaaatccctgctccattaactcccctttcaattatttctattttcaatagtatgcttcctattattttccagatgaaaaagtcctttaaatattttttaacaatgtaaaacagatgggcaattccttgagacttgggtctccaaaattgtagctgacgtattttactttgtgtttatttatttgtctactaaatatgtttttgctgggaaaaaaggtctgtccatagtgatataaaatcactctccctagatgatttcattacatatttgatccaacagagaaatttcgggtcttgatacatttcacttgggaaggtacatagccaatatctgattccctctcaattttttttgttgttgttaaatattttctaaacaagtatttttttaattaagtctcaaacagctacttctcaaaattccattcctttctgagctctatagaggaaagatatgataggatctataaacctaaataagcaaacagccattagaaatcttaaagatggattgtattgatgataatatagacacctatacaccacgctccattgactaatgagaatgttataataggaagtgcctcagacctctttgtgtgccaaaatgccagcccactgagaagttaacgttatggtcaatagtgtttgcaaccctccagaaagctccgtaaattgaacagactgttaaccttcacttaagctttcacatcagtctaacgggtgctctgtttgctgctgactgcccgctagagactcactcattgaaagatatgtagttcatcattcatcatttcacaaatttggttccaggaaaagactaaaaattaccctaggcacaagctgtttaatttccaccccctcacatgaatctaacaaacaaccaaaaatacaaacgacattgagtagaaaataagatgtaagttttggtgcctcagtgtcatataatgtaaaggtatttatgtgaaaataacagcttgccttgaagtttcttagtgtacataatattgcagagaataacccctttcacttttaacccacgttctcttaaacctctttctgatcctatttcctgactcttacttgctgcttgtagaagctcatgattctacaattttagatccaaccaaggcagcaagctcaaaattcacccccaaacacactctttcccctcacctaaccaattatatttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaagattcaagagatttagtaagtacttcggcaagatctaaatatatggaagcaaattagaaacaaaccacatttttctgagctcaaagcccaaactattttctgcctatttcattatttcttctttcctggcccacactcctgtaagtgtatgtttcgtcttaatatatgatgtttgctttattaagtgcttgtaatgaagaatgcttgtcaattgagatcatatttaggaaatgttagaattgctgatttgttttgtgataaatattattaaaatgtaagctcaaggtaagctggatattttgtacgttttcatcaaagctttatccccattacctaggtcagtctgtgcctggaaaatagcagtgggtagttaataaatgctgaataaatgggatgtttagatacatttggccaagcgacactctcacctcaaatttgtgtgaaaaatcaccccaagaaataaaaggcaattagagacaattgaaaaattaattcagctgatagaaccacttgtcaaatattacataattcagaacaatatgactgaatcatgatgaaggctaaaattctgggtcttaagcaactttaaacctttcaaggaaaggctgattgacaaacacaccttctgtgtttaatcaatgccacaaaacatacggacccaagaattggtggaaatctagactcatcttcagaatggtaaattattcttgagttataaggcctccattgcctaagtgactaaaatgtatgtttccagaaagatttagcattttcctacaggttattatatgcaagaaatgcctttctccaacaggtgatagaaaggtcagaatcagccatctcctaagatactttattttattttgttatattgcaataatatgcaatgcttcagtgttataccaatgaaataaaatgataaattataatagcagtagctgagctttccaagattatacaaattaggtttagaattgaaattttatgaaaacaataatattttaactgcggatagaatattgaaagtgacctatgctgagagaaaaaggagaaaatttaggttacaaaaatatcagatgcattaatccaacataattttgtaaaatggttatcaaaggtcaacactcaatgtaatgtattataataaacaagaaaatgatggccatttttagcaaaaaaaaaaaggattatttgaataatccaattttattttacttagagacatttttcatataaaattagaatgaaatttatgttttaagctactttaatcatacatttttgttgttgaacaggatgctaaggtacagaggaaatcatgcttccaagttgattgccaaataatagtagcattgtctaaactcaactagaaattttgtcaatgcttttttttcttattgcccaaaatgatgcagtgagaattgataagataaggatattctgaccacgaggagtttacaatctagaaatgtggtcatatgcataaatagctgtaatacaataatgactatggcaacagtgaagaacaaaagagtgatctggcaataagaaaaaataagatttctgttccctctaaagaagccctttctagaactctagtgaaagttaatgggtaatcaatctaccatcacaagttaatgggtaatcaatctaccatcacagaaaaagtctagtctggagtgggtgacttcaagaaaaggtttccccatagcaaaatcaagtgtaactttccaaaggctttgagattatattttcacatctgtttttgtcgtttgcatgcatatagaatcacacatttatctctttctgttactgtgctatattacacaaaaacaactggttgggttttctcaagaggatattttggggtgacctgagttaaaatagaggttatatcatcatttaaattcactttgggcagccttagaagacaccccaaagacataggctatcatcctagagaatgctataactgctgataataagggacgtgccatagatattaagatgctaccgggagggaaaataaacagtgatttataacgcaagccctgatttgaaagtcacaaggtcagacacttggaattgcaggtgttgatttgtgatcaagaggtttttcacatggacaactctagaaagccttatgcagagtgagtaacagcacaaaggtactactagaatattggcaaaaattaacccaagcaatgcagagaccagatcactctgaatgtgtttctattttcatagatttcacctagtatatttaggttaaagaataaggcacaatgaaccttccctatctctaaaaaggaaaagaaattttttttgctttcattatcacttttctaaatactgagcagctcgttagtatcctcactctgatctataaatataaatataatattaatatatttatgatattaagtataaatattaaatatagccgtattaatatatctataatatttaatatataatactcattaatagataacgaggcaacactatggcattttgttccctatgttttaatatcttggagatggttatcttgtagtatgttgcagaaatgcgttatccccatgagagcctttggaatgtgatgacaaccatagtgtgggagccgacagagtcactgcttaggtgggaaatgtctaatagaaagaaaagaaaacttagaacatagctttgaggatcttgtattgaaggatggagaagacagcaatctgagaaagtgaccaaaaatatccaggagaaatactgggaggagtgtagggtcctggaagtgaaggaaagagaacgtctcatgaaagaaagggaagcgaggcacagtggatggaggcagctgttggaaacaccacttgaattacttgattgtagttcaatcagttttcaaaccccagtgagggaaaacctgagatgtctgtgggttgaggagggaatgaagttgagcatgagaatctgaagggagaaggaaggcaacgacggctcacagattcctcatcaccaaaggaggggaggtggatcagggaaggtttgggcttagctttttaacacaccattgcagctatttttaagacaaatgtaagaaactcagaacaagagatcgcttataaaataattgaaaaaatacatagtttaaatcagttcttataaaacattgaggtgacaagattaatataggtcttgttacatttttatttttccattgttaagtgtaatgcaatttatataaatatcagtttcctttagcattacttttgcatgaccttagctctatgctttattcatatatgctatttcatataaatgatataaccctttgaaattcaatttagaaaaataccctaaagatattgtgagccatatttatacacagttgtataacactctccttgtactagagctggttttacataacgatttgggattgagttccttttttatgaatgcatttttgaatgccacttctcttgtaggcaagtgtatgggtattgtatatttgtccctgatgtagattataaatctagatttataaggcatcattaggcctagcagcccaagttttcatatctatttcttcaagacaaaatatttcaacattactaataaatcatgaaaagtactaacataaggagactgaaataatttgttaaatgttatttttcaaagtaaaacaatttcactcctaggctttagagtcaggaaaacaaacaaacaaacaacaaacattgtttaaaattatgggttcttccatgttacactgatactaccatatgacaccccgagcttcagttttcttatctgtataatgtggacaatcatcattgcaccgaaagaattcagtcaatgctaatagagtgcctagcgcataggaaaactgtcagaagggtacctttagctgcaagtaatggaaaccccacttaagtctagcttaaacaactaggaaatttatttgctgacataatttggaacatgagctggggaaacagtcatgattgatttaaggagtccactttcctttccacagtggtgcattcctttatttgcttgttgtctttggggtaccccttttatgttggctagttacagaaatctacattcacatcctcgcactacatcattcatcagaagagagtgcattatttccataagctctcttgttgtagtaaggaagctttttcttccagaagccggccctgcccctacatttcccctgtgtctcagtggcctgaccgtgctcacttctgaagcaatcctaatggctaggagaaagccaagggcctattggccaatgttcttaaaccaattattgcaaaggttatgggattatccttagggtcacttttggggttgtaggctgggtcagattcttatgtatcactgtatgaagaagggaatgatactcaaaaatattagagttaaattttgaataatagtagggcactgatgaggcatcaaagtgacacctatatttaacctgtttggggccctattccttcacaccaaagaaggaaaccaaagcataagtcccatctgagccaattcagttcatgcgttgaatcacaatatgttggtggtcctaaaattattggcccaaagttgagtatcttggtgttttgttttgttttgttttgttttgttttgttttgttttttcggagtcccactctatcgccagactggagtgcagtggcacgatctcggctcactgcaacctctgactccctggttcaagccattttcctgcctcagtctcccgagtagctgggattacaggcacatgccaccacacctggctaatttttgtatttttagtagagaccaggtttcaccatgttgtccaggagggtttcgatctcctgacctcgtgatccacccacctccgcctcccaaagtgctgggattacaggtgtgagctaccgcacccggcctaaacctgagtatctttgctctctatcattcccattttcagcacccgagccttaaataaggtaatggaataaaatgaaaaacttgtgcaaatgctttacaacatagttaggtaagtttatctgaaaagataaactaatttcctatatatgactttgttacattattctcctatgagtgtcaagttattttaagaattcagagttacctattaaaaataaaattgacgagttatcaaaataggcctagaaatttagaacatggctaaaactcatctgtacgaaagaaggaaggaaggaaggaaagaaagaagaaagaaagaaaaagaaagaaggaaagaaagaaaggaaagaaagaaagggaaagaaggggagggaaggaaggaaggagggagggagggaaggaatgagagagagagagaaagaagagagaaaaacaaagaattggggtggtcgtgtgcacctatagtcccagctactcaggaggctgaagtaggaggattacttgtgcttgagaggtggaggttgcagtgaaccatgatgatgccactgaactccagcctgggtgacaaagtgaggccctgtctcaaaaaaacaacaacaacaaaacaaaacaaacaaaagaaaacaaagcaaaattacaagctgtaatttcacacctgtggtatattttattttgcttaaacaatatgctttaataaatatatattgaaatgacagaaaaataatattttaaaatgtatctgggtctacacattaagatttagtttgcagtattccaaacatcatttaatggaattaaataaaatttccaaatttataaactaaagaagtgctgctttcttatgaattcccactctaaattcattaatttaagatacatgtggcctttctttgtaactttaatatttaaggaaaattcagaatacttagcctcatccttaatcaaagtgtaataaattacaaaccccaccaaaatctctacctactgaaaacttctaaaggtaggagagagtatagagcctacagctgactccctacaatattctacatagcaaagtgaattaatattaggcttaacataaagcatctgttttctaccattgacatttacacacacatacacacacactcccccacacatatagagtttgttagggttcaccaaaggtaattaaccatcagatgtatattaatcacacacacataaacatgcacacatatgtattaactaacacacacacatttacaacaaaatagtagacagaaaaccattataagtgcagtttggtaactttaaggacctttgatgagaaatttcaaagttggtgacagttcatatgaggaagggtttttcctctgacaatcagatgagctaattaatcagcatttgacccggctggatcttagccagcctaactgttaatgagtgtgcactgttttgccagcaagagcacagtctcttcaaaaaataattgtcagggtcatttttgctatgaacaaaatcttattttgaaatgtgctagacttttttaaagcaacaataagaatgacacgatcattcttaaatatttcttattaaatattatggtaccaccaaacatgagcattgttttatttttttttttttaacaaactcattgctcttcatttatagttttacattttaaagtcatatgatgagaactatttcttccagtttgctttctgctgccaccagacttgataccacaaaaggtgtctgggtgcatgcctgtgatgatattgccaggccgttcctttcttggggcctgtgtatacatgggcctgcctttttattagcacctattataatatatggccattaattattagctgtacatattttctactagactgtcagctccttggaggtacaaaacttatttttctcatttgtacagcctctccgatatcttttatcaacttcatgtaatcctgatagctcagtgaggaactgaggagtggggtcccctaagaaggacataagtctaatttttaaagactaggtgtagggctgcagcttggctctcagctgtgtatgattccaaacaccgaagtatctccacgtcatcaccttttaatcacattttagtgtgatttataagcacatatttggaataccaccacaaacacacacatacaaatgtcattgttatttatatgcacgtatgatggtaatatatatgtctgcaagtttgtgtgtgtttgattaatatacatctggtgattaattttctttttcatttttttttgagacggaattttgccctaatcagccaggctagagtgcaatgtcatgatctcagctcactgcaacctccacctcccatgttcaagcgattctcctgcctcagcctcctgagtagcctccggattacaggtgcacgccaccatgcctggctaatttttatgtttagtagagatgggggtttcaccatgttggccaggctagtcttgaactcctgacctcaggtgatctgcccacctcagcctcctaaagtgctgggattacaggtgtgagccactgcgcccggcctgatgattaattttcaaacaaaccgtgtgtgtatgtgtgtgtgtgtgtgtgtgtgtgtgtaaatgtcaatggtattagaaaatagatgctttacattaagcctgctatggattcacgttgccatatagaatattgtagggagtcagctgtaggctctatactctctcccaccttcagaagttttcagtaggtagagattttggtgtggtttgtaatttattacactttgattaaggatgaggttaagtattctgaattttcttcaactttaaagtacaaagcccacatatatcttaaattaatgaatttagagtgggaattcataagagagcagcacttcttctttagtttataaatttggaaattgtaattaattccattacatgatctttggaatactgaaaactaaatcttcatgtgtagactgagatacaactttttaaaatatttttctgtcatttcaaaatatatttattaaattaaaatacagtctttaaacaaaacaaaatataccacaggtgtgaaattacagcttattatatgtatttttttttttttaaatttactctgtcaatcaggctgaggtgcagtggcattatcactgctcattgcagtctcgacctccccaagctcaggtgatcttcgtaccttagcctcctgagtagctgggactacgagtgtatgccaccacacctggctattttttaaaaatgttggtagaggtaggattttgccctgttgcccaggctggtttccaacttgtgggctcaagctatcggccggcctgtgcctcccaaaatgctggggttacaggtgtgagccactgtgcctggcccacatatgaaattttgaaccaacaatcttctgagctctttttatagaaattgatgtaagatcacaattatttagtgatctgatatattttagctgctgtctataatatttggaaaggatctgcaatattaaactgctttacatttcagttataaaaaaaaagttaaaatttcatgtcactataattattacaggtcacctcattcactgtctttccttttccttagcatccttagatagccacagaacatttccttaaacatttcttgttacttatttcacatactcacaagttcccccattccatttctagaaagcttttggaatgttttataaaacagtatgagcattattgctgtaagaatgctattgaaagtggagtgtaggtaggcttactatacaaagtggagtgtaggtaggcttactataaaaaacaaggtatactaaaacactcactgctataaaaaacaagcctcaaagacacatgcacatgtacgtttattgcagcactattcacaatagcaaagacttggaaccaacccaaatgcccatcagtaatagactggataaagaaaatgtggcacgtgtacaccatggaatactatgcagccataaaaaaggatgagttcatgtcctttgcagggacatggaagaagctgcaaactatcattctcagcaaactaacacaggaacagaaaactaaacactgcatgttctcactcataactgggagttgaacagtgagaacacatggacacagggaggggaacatcacacattggggcctgttggggtttgggggataggggagggatagtattaggagaaatacctaatgcagatgatggattgatgagtgcagcaaaccaccatggcacgtgtatacttatgtaacaaacctgcacgttctgcacatgtatcccagaatgtagagtataaaaaaaaaagcccccaaatatataatggaatgttgcaatgtaagtttatgtgttattcaagtgagattaaaaatgtgtgttcctggtttgcagaaggcaccctccacatgatagaggaagcagagttttcctttggttcctctgcatccacatagtataccaggaagagaaagaatagaatagagcacaaaagagattttcatgagcttttgtagaaaaagcctgagcccctttcactcacattactttggccagaactcagtcttctgactctgtctacggaggaatgaattttagctgtgtgccaggaggaaagaagaacaggttcatattagctttccggcttcgttgtcttctcacattttgttcccaccacattgacttttctgtttgttcgtttgttttgttttgtttccagaaggcactacagggtcatgccacaagttgtttcttctacaaggaatgcggaatgcttcccactttatgcaggttacccagctgacttctatttttcatttaaaactcaattcaaatatttagttatcaggaatgtctgctctaatatgatacatattattattcataacacacaatttcaacatcagtgagaatttttttgatgaatgtttatctcccgaagtagactgcaagtttttaatgacaatgatcatgcctgtccaccctccattattacacagctcctatcaaagtcaatagaatatgaaattatgtttttaattaatgaaagaaaactccaccctccaactcttaatgacagtacaggttgagcatacctaatccaaaaatctgaaattcaaaatgcttccaaatccaaaactatttgagtgccaccatgacatcacaagtggaaaattccacactggaccttgtgtgataggccgaagttaaaacacagatgcacaacacaccatttattcagcatccccaaagacaaagagattctctcagcctccctgagctgtgatatgtttctgtgcatgcccaggtttccccatgcaatcacgcccacaaatggtatcacacagcatggtaggcagagactgaaagcttgccattcttgattgttgctgttctttaacagctgatacaggtattctggtgatgctactgtgttagtcagttatcctggacacattgttttttcttatattaatggtatgttagatttttttactgttaagttctgacatgtgactaagcataagaaaatgcttgcttattggtagcatataaattcagagtcaggaatgatagtgagagaaaacaaccacagagaaaacagtccacaggtgtggctgagatagtgatgcctctgctttctgatggtgcaatgtatacaagctttgtttcatgcacaaattatttaaagtgttacataaaattaccttcaggctgtgtgtatatggtatatataaagcataaatgatttctatgtttatacttgaattcaatccccaagatatttaattatgtatatacaaatattccaaaatctgaaacactttttgtcccaagcatttcggatgagggatactcagcctgtactcccatacaatgaggccttaaccacagaagaaaacaataggttcttcaaagaaattggttgtgacatttaaagggtcaaaatgggtggtaaatgtggaataataattgagaaatgtaaaataattgagaaaatagccaagaatacctgagtatgaaaatagatgtgaaattttagcagtctatcaataaaatcttgatcaaacaccacttattcagctgccatatatgagtgtcaatgaggagactgtagagcagttagcatgatttttacattcagtttattaggtagaagaaaccctgcatccattgtcaacattcattctgaatgcaatgtcactatctattttattggcttctttttcccaatgcaatatttgtgatgaagtgttccccaagttatgcttttatcttctttgtgtccatctaattctttgtgggtgatgtccactactctgacagcatcacctatcataaaatgctctggatctataattccagtcctgcctgagtcctgtttctgcattttctttgctgatctttactcaaagatgctctgaattcctctgaaacttaacctgcctcaaattaaatttaggataagacttctccttttcaatatccttctcctccagtattctctgtgttaattcagagtatcaccatccatcagttatcaaagccaaaagagtcatttttcatttcctctgacccatttgccatgaccaagagaagaaagagcttcagctcctgagcctaggatgtctgtttttgccaattatgccaatccaaatccggctgtcatgaaacctggatggaaaaaacaaagccagtgccagctctgttcagtaggatggaaaatctctgtggcttggtagcctcccaggttcctacagagaaggttcattctgagatgaggatctctgtggcatatggtcttcaggaggagaatatctatgagaaaagagtctccctaaaccagaaaaatgagaaatgcaaagaagatctggacaaggcagtggtggaagtgtcccctttagatatttggttagtgctggcattactgcctgtggaccagatggtcccaaagttactacacactgcactgtatgcctgcctgctttcctgcctgctccagagtctactgagaagctgtattatttgtggatgtatgtgacacagtctctgcactgtagttataagccatgtgtcgctccaattcctaagaatccagtcattccagagattactcctcatacatgaaaatcctccagattcctactttctgataaagaaatattattgtgaacagatcagaaccaatgtaggaattcaacctcaagttcaaaaaaatcatcttctagatcaaaatgaggaaagactgcaatttaccattcaaggcaaaaatatccatatattgtaccagacacctattaacttcaataaggatggtcccaggttcaagagtgaggagaagagacccacagccagtgaatgaaacatggggtttatttgatggggacatacgggacagtccagtggtggcaggctggacagaaccgctacagcttgcaaactgcatgcagtttatgtagcattttcacttagcaccctctccttagcaacctccaggttaacaattcatttcttaagttgttattgctttcaggtatgtctgccatacagggtcgttctcggggtatgcttaagttattgctgtcaggtacatctctcataaaccatagtaatccagaccaagactgctcccttccacaggccaaaacctccaacttcatctttctctgtcccttgcaggggtatagttaccctgtttactatgtttattattattattattaatattattattattatttatccctgactggtgataccctgaaagtcttcccacctgagagcttggttattgcttccaaccccgggtgaacccctaagctagaccagtccgttagtgaccagattccagtgaagaagggggcagttggcttgcatatatggttcatgttgaaccagcccttcatgttcctggagctcccactaaggggatggagaagggatcaggaaagagggttgaatgaagaagagaaacacgtataaatgtaaaaacatgcatctgagaaaagaatcttagccccgttcttaaattcagaactctatttttgtgcttttaaacctgtcagtcctcagcgtcactccctccaccactgccatctcagccctgaagcttcctggtttcttcacagaacaaagatcagtacttggaatgtggcaagtactcattaaatgttttggattgtgcaaaacagtcacaatcaattggtacctctctattaatgctcccccacctctgtatctctgctcatgctatttctcatttgcaatgctcatccctccttatttctcctttgaagttttattaatctcaactgaaaaaaggttttcttcttgaccaaactccaatcaggcttccctgaactctttttcaactaggcctgacttttagacgcctgtgtttgtgtgcattgtctaattgcagtaagaatcttgcagagttggtttaattttagcaagactcttgcagagttagtttagccaggttctcccatgcttcatatctgatcaccatcaatatctaattgggttccccaccctccactatcctccaggtgatgtgaagggaatgatatctgatgaccctggcctgtcttcagcaagaatcctcataggttagtttaaacagaattcctccttacttctaatgtttcttctaagtaattttccatccactgactcacatcgtgctttttggctgtaattccccctcattcatgctgtatcaggaattgaacccagttctgttctgaggtcccttttaccctattgcaataatactgaatagaatctgtttctattgccttaactaccgtccagttctaatgttatttgatacaataatccatcttgtcatgttccatatgtagccttccaggcttttccagatgagcctggcttggtaatcattatctcttctaggatcttacagctctatttggtgtttgcacgtctattactttattctataactgattttcttactagtgtttacacacacacacacacacacacacttttcataaatgtgactccctataacccaatatacattttggtatatttggatcattgagtaaatacattaaactttttgttttcttttttgtctcaaaaacttacaaatcatctggcttttaggaggtgatttgtacacaaattacataaaaagtgaatttctttcatggtgttaactgttgagaaaatcttacgccaaccttttcaggagccatggtggttccgagatgctttaaaaataaattaccaatcctctgtaattttgcgtcctctcatctcacctactcataataaatgaagagaagatatgtcatgcctcacaggcaatcatatactgataaatatttaatgactggctctcaaaaaatattaaaaataccaatttgtagtgtttgctgatttttatgatataaatacacccaccatgacagatgcctaattaccaacatgacaacgctgaccctggagttaggaagaggtgtgtagtgacacatcatcatatctttaccatccatatatgatagctgtgaataaactcgaggacataagtcatagtaaaatccaatttttaatgatggatatgtttaaccactggcttgaaacttcctgatatttaattataagctctcaaccactgtgtgggttggctccagcacatcagaaaaatggattgcagcatattcagattatataatcactctcagtagcataacaaggatattacttggcataaaaatttcataaattgattatagacccgtgttatcaagaaacatactctatatattatttcatcactagtgttccttgaaactgaattttacaaggttctaacattgtcacatgcctcaaatcatcctccaaagatactaataatctagttattgagttatataaatgtataaggaaggtacgtgggaaaaatatataatagtatgaatacatggaattatgttgatcatgaccattattccttaagaggaatattatattttcagaaagatttgaagaacttaaagcttatacctccagtggcccactaattcacagtctaaaatgacagaacatgataaatttcaatatcttatacaatttctcatagcctctggcaggagcaattcttgaaacagtaggtggaaatatactcattaagctgcaaaattgcctatattcaggacacctgccaagcaagcattccctaaattaccacctgttaccataacatcaaagacatccaaaatacttgcttactaaatctagtctccctaagtatatataattttcctataatgctgcttgatggtagagcagtatcttaatttcatatacataaatcaaagttgtttctggacagctagggctcgaacctggttttcaacagctattcctgaggtatagttgatctttagtgttctatttgatgttgagttatagtcacactttttaacttgtccaggtgtaaatggtagttgctgaggcctttatataaagcaaatttactatcactgatacatgaaagaaaatcattttactgatattgtagcactgaaagttgtcaatggattatctaagatgattagaagctgtggataaattagtagtaggccaatatattttgcttgagatcatgtgtcaatatagcagcatgctccggagcagacatctataactaataatcatataaattctgctatatatgtctatagtcagtctatccacatagattttcagtcactgttacattcagtaaatagaatgtaacaatatcatgtggaaacttggttagataattctgcaagacatatcaaatggatgagtgataagaggaaaccaactgctttatgacaagctgaggtggagtgaattggtacaaggacacccagaagcacaatgtcaggtgatgaaaaggctgtgtaataatgagaggaaacagtaataggagaagaggaaataattagcaatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgacttaaactctttatatctctgtttcctcatttgtgaaatgctgattgaaatgatatcatatttcataaggacattgtgagggttaaatggaataatgcaaagaaagcccttggcactgcctactgtgatgaaactgttccaaaaagtcagctattattttcatccccactgcctaatatgtagggtgtcagtaaccgtaaataaatgttgaggttgaatgaattcacattaccatccaagatactttcaaaaataaccaggaaaaaaggcatacatccctttagaggaagatgaagaaaaatgttattgcagcacgggagagcactgtattcttattaaggagtttatgttctggatagaacttcataggaggcatggcattgatcatcactggtcttttatcatcattatcattatagtttggtggccgttgttggcataaatcaaaatcatagaattgtagatttggatgagagtgtaaaggttatttagtgtgctttactataatacgatcatctgctataatatccgtgagcatgtcacctctggtcacgtatccacagagaataatctcattgttggctttagaaataaaataaatacctgagagtccataatggcaattttaaaaaaatgaatacattgagcataaccacaagcataaattatatggcttaattattttgacacgcacacacatacacaggcacatgtataagttttatatatagaagtatatataaatgtaatatttgccctttcttggtgctttacataatactcatgcactgtttcactaatcctttgtcttcccagaaccttagttatatttagcaatgttatttcacaatttacaaaagaaacacaacttattttgactccgacattatggacatttctggggatactgctttttggattgagttctaaagttggacataaataattagatcaacattgtggagaaaatatactataatttaaattttacgttgttatttttattaatgtgggtacaataaaataataaacatgacagcattaattaaactatgaaatagcatctcacaaaattgctaaaattataacaatcagcaaaatcctctctactccgaacctcttctcctagagtcacatgcatcttttggctcctgtttctcctctgaagaacactgcagccttacaaggtcataactgtttcacctcctttaaacttccaggcatacgcatgctcctctcttcagtcacactcacttggataaacctcagctcacaccaaatccagtccctgcctactctgtttaatcatggaggcaactaagtcaggctggagaaaaacatgcaactttgatgacttgtctcactgtgtttcacgaccattgaattaaatgggctgtttctgctgtctgggcaccatcccattcataaactccagatgtcaacacagcaattgtctcttcttttttctgtttctcgattttacctttctactctatcacttccatcgtcataataacatgctgttatttttcctttcaaataagaataaaaaaaaggaatctcgatctgacaggctagttgagttcctgcctatttctctgcacgtcttttggtagatctcctggagagttattttttatactcactgtctgtactgtttcctgctgcaattatgttttgaacacctcaagtttagcttttgtgctcactactctatcaaaatatgtcttgtcagtgttaccaatggttttcacatggctcagtccaacagtcaattcacattcctcatttatggacctatcagaaacatttaacacagttgtcctttttttctggaatacttttgcttggcctctggaaccccttccctatccacttctttactgtctcattggctggaacttcttttcctctaaaaattagagcgcctcagattttctttctcaaacttctctatgtaaatcactctttaggtgatctcactcagcatcatggctctaaatattatttatattctgaggaaaaaaatacatagatacctttactcagaactgtttcccaaactccacattttcaaatccagacttcattttctccacttcagtgatgtaaattctcaaatggagaatgcactaaatgcactaaaaatgaaaatccttccaattccccaaaagcctctttgttccagttccccatctcattaactgacaattccaaccttttagctttggtcaaaaatattggagtcagtcatttttttcccttcactccttactttccctgtcatataaaaaataactaatcaaaatatatgttgtctctgccttcaagatatgtctagaatctaattacttttgcactaccaccattgggcaagccattttctcttacctaaattattgcaataacttgctacctgttttctcttcttctgccttgaacccatgaataatctatgctcaatctactagctaaaataatcattcaatattagagacacattgtgtctcttctctactcaaagccctctaattgttttctgtcaaagccctccaattattttctgtctcactcataataaaagccacaggttatacaatgcctcctataagtctaacatggtctgggatcccgtatttcctctctgatctcattgtgttctactcttcttcttgctaggcatattctacctgtgcctagaactatccactttccttcctccttttatgtctatacctaaatatatccaccaatcaggccatttccctgatcatcttatagataaaaatctgaactccctttttccccgccgcccataattcttctcctccttatattatgctttaatgtattccagcgctcacaacacttggcttaccatcagctttttggttgcttgtgtgagccctctcacacaaagtttagatagctatagagacagagagccagaaagacgacagacagagatagatagatagatagatagatagatagatagatagatctctagttttatgtactactgcatcgtttgtgcttacaatgcctagaatataagacactaaattttttgaatgaaatacttaagaaattaattatgtactctatgcttttgatggcattctgtaaaactatgtgtaaaatgttgatttatagagatttatatttcccgttaatttccgttatgctttctgaaacatgtttctctggggagtgaaatgaccttaaacatacttaagggttagtctaacatttatctttgagagcattttctcttcggaagctggccacctagacacattaatttttcccacacaatactggttaaagaggtatttcagtggctagcgatcctcaaccattcgtaagcaacactccataatagtcagttttcaggagcaggaaaatgaaggctaatcctagggcacccatgatacctggctgtgctaagtagcaaaattacgggcattttcttttcattacaactcacgtactgcaaatatgttatctgcattttgacattaaattatattgccacataaaatatgtttaaataatcttatttttgttctcattagtacccaacttaaaaatacttacaaaatagttaataataaatactttaaaaagacgttttaaaataaataaaaataaacactttaaaatcgctcacaaagcactactttcatttccgatgcattttttctccattttttgcacacataatcatattctaaaaggtgaggtggaaagagttactggtcctaaaatatctgtttgtaatgttttgattatacttgtgctttgggtgtgtacacgtttacatatatgcatatatgtgtgtttgtatccaggcatgcgtatgtattctgtacctttttagtacttgtattgttgcatcgctgaatacacaatataatttttacttatcctttttatgacccatttgacctccatgagaaaacatgtggcatattcccttattcatctatgcatttccaaaacctagcttagtacttgacatataatagctggtcagtaaatttgctttattttatactgaaatatattgctctaagccagattttcacaaattgttatgagagatatagtaattctgcaatatgtgagtaataatattctagggtttcacatacagaataatctgaataatgaactccctcttgggatgctgtaatgttcattaacataattatactctctaagaaactaaaaattaccaacaaaaggcaatcgttttaacactgcttaagatataaacaactaattttcccatttccttttttaaatatatctcccctgatatcttaattttagaagcagattgcattatgataaatacttacagagtgactagaatattgtttggcatagatctaggttgataatgacattaatgaactttgcaaaccgagttcaattccagaaatgggtactgtacttttctgagaaattgctatctcatgtggcagataacttatatatatgaaaaagtatagtaagaaatttgaggaattttgacttaaatgtgtgaagaatttttataattgctgtgcctacagtgaaaatggctattttgtcacctaaacagtcagggagaacttggaaatgtgaaagtccttaaaattctactgcttactgtagtctcagtatgaaataatgtaattatgtttacttgtaagttatcctatggttgcagataggaagactcgatactataaatatgtcaattcttcctatatcaatccatatttatgttaatataaaagtaaaaaataagccaacagtgtgtttgaacaaaataagcttattttagagtttatatgataaaagaagtatgcaaaaaaatctgcgaaattatgttgaagaaaaacaacatgggagagctagctctataagatattaaaacatataaagtctcaataaatagaacagtatgatactggttcaaagaaacaaaacaggaatatgtgcaaatacataggaaaaattattatacataggaaatggtatgaatgcaaaaaaagtagaagaattaagttgactccatataccatttcttatacaggcaaaattccaagaaaataaaagatctaaatgaactaaagtggtagcaattagaagagtgaatataattttaaagaaagtaaaaaaaataaataaataaagattgaacccaaatggatgtacaaagcattcaaaacaagaatccacaaaaacttgtaggtaaagacaaatgttttattttgggaataatgcagaaaatggtatcaaaattgacttgagttaaataatcaatttgaagttgtggaaacctgaggatgtcatatgctcagtatgaaaactgggtttgatgttagggaaagatgtatgttaatttgcacggagacccttaagattatatgcggctatagagggaaatgtggctatgatcttaaggatgagtttttggcggcatccactgaaaagatgtaaaaagtaggagagtaacttgagtgcatagactaggcatgtcaagacctcaagggaagaggtagtttgaagaatttattaggtgatcaacagcatctaatgttgcaataggtgtttattcatacagagtaagataagagatagaaagacagcaaaggaaagaacatgcagggatattgcttctaagttttccactatgactttcaatgatcttcaatttccatttccacaaagaatgtttacttgatatttaaaaggaaattaattgtaggcatctcttatttcctttgtattttaatgagtcatcatttcaaaacttttgtcacatgtcagtgttaaatatgacataactacgttgcccttgatactagttaaaattaaattttttactgattggaaaatacacatagtgatttatttcagagggtaaaaaatattatactaaagtctattaagaatcagttgtgctaggagtctccttcaatgtgtttcaaatatttggtgtgttccaaattaagacagagtggagaacgaaaactttcaagtttgaaacaccaaagattgtataggatgggggagaccaaatactattaaaattcaccagggtcattctatcttggaggtctcttaggaatccatgttccatctcttccgttattcccagataacagcatgattttgccattgtcttcaatttccagatgcattagaagtgtggcaagatacaattagagtgtgtaacttaaatgctagtaagacctattcaagcaagcatagggctctgcacttacagaaatgtacaagtaaatctaatttactaaaatatatttagtacatgtaaatttaaaatattgcgatagctgggcgaggtggctcacgcctgtaatcccagcactttgggagaccaaggcgggcggatcatgaggtcaggagatcgagaccatcctggctaacagggtgaaaccccgtctctactaaaaatacaaaacattagccgggcgtggtggcgggcgcctgtagtcccagctactcgaaaggctgaggcaggagaatggtgtgaacccaggaggcggaacttgcagtgagccgagaccgcgccactgcactccagcctgggggacagagtgagactctgtctcaaaaaaaaaaaagatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaaccctaagccaaaagaacaaagctggaggaatcacactacctgacttcaaactatactacaaggctacagtaaccaaaacagcatggtactggtaccaaaacagagatatagatcaatggaacagaacacagccctcagaaataatgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacagcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcagggacaaaaaaccaaacacctcatattctcactcataggtgggaattgaacaatgagatcacatggacacaggaaggggactatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaacaaaaaaaaaaagaaaaaaaaatactgcaatatcttcccgccttttacactgttttttaataattattttatatcctttctaaactgaaagttccatggacatagagactatgtcttgtttctttattgtattcatttcactgtatggctagaaactagggctggccattttgtgtattattgtacttgttccatatctcatattatcagatgattgatattattatcatcattgttttcattttaccaatgaggaaatggattcagagattaaacaccttgctctggatcaaacataactcttactctggaagccaaattcttagccacctcatggtgttgccctagtacctcaactgtattaatgcacttagtatagtcatgttatgcagaaaaaaggactctaagatggtggagggtctcagagccaagttatgtcactaatgaactacagatattcaatgtaaattcaggaagaaataagagaggtatgtaaactctcatgaatatttgaggtttgccatatcatggatgataataatcatgctgaagtattatttctgttagtattattattttaattattagcatttgaatccacaaaaagaagatagaatgaagtgtggtagatgtaacacattttaattcaatagtgagcatagttgaataactggcatagtgatacgactgatatgattcatctttactgctggtgactaggcagatagtagatgattatctgtctcgaatgctgttgaaaagtctaaaagtgctgagctaacttcttccaagtgttatgaatctatggaatttagtatagtgctcaacatttatcatgttgagaataagatttccattgacttgagaaaagtaaaacataatctataaggcaggaatatcagctgttgttattccctaaggtcaacttaaatgtaaacctctgatttacatagaacattaatatgtatgtatacatttttagaagcagatttgattgcagtcataaatttgctaaagtcctaaatgcattgttggcatccaaccatttactgttttggcataattattaatatacttactattattctgcctatgaatgtgaatgagtgtgatatcagaataattagaatgagtcatattataaatcctctgtccaactttgaattatattgtatgtatgcttgagcattatagatgtaaaaagtgacatgagttctacatggaatataatacaagtattacatcaagacattttcatgtagattattttagtagtcgtagaattttactacattgaaggaattgatattatgacatttttgataggcaaaccaagagtgaccctttcaaattgtacaatgtcaacttctatgaagaaagataattgaatattgttatttgttatttagaagattgaaaaatttcagtcatattgtcatagtctgttgattgattaagcctagccataagtctataacattcatttttatgttttgtctcttttgtatggttatgtggaatcgatgctattactttgacctccaatatttaattcaacaagcagaaatataaccttttcacttgacaaaacccacttattttgcttgagaaattataaaacaaaaccagcaggtgcctgagattcagtacttgaaattatcatttaaagcaaagtgtcttgtatggtttcaacattgttcactccattttctggcagctgacactcatttactctcaacaagtgaataagcagtcggtgagtgtccctgatgtcaaggagctgtcataatttccatggagttagctctgtttggcattacagaaattcactgtgatcctgctgacaactcttttgtatagtcataaagtatacagcagaacagtttgtcccagggctaaggtcaggctttttattttgctattatgagaaatcaataaatacacaatactatttatcttatttattctaaggaaggaggagaccaaggcatattttcctccttctaattcaaaatatttctaacattattattagattagtactgatgggtcagtcagtactacaggaaaacaaaatatgtagaaacagtgatagtctgtcaaagtttcgagctaatttcaaacagattgggtaacgtttgaatcttctatggaagcattccccaatgtttaatcttcaagatatctctgaatttatcttcatcagatgttggatatgtcccatgtgtccaatgatcacacttctgcttgacttccagccccagcccttgctcctctacctggagttgcttccacttcacacacgaatgggcatttaggctgccataacccaaactcaacgagcctaaaactagatgggccatcttttgtttttctttttaaaatttatgtttttattattattttttgagacagggtctttttctgtcacccagactggagtacagtggtgcaatcatggctcactgcattctcaatctcctgggctcaagcatttctcccacctaagcctgccaagtagctgggattacaggtgcatgcatcatatctcgctaattttttaaaatttttatagagttgggggtctcactatgttacctaggctggtctcgaatgcctgggctcaagcgatcctcctgcctctgccgcccaaagtgctgtgattacaaacatgagccaccgggcctggccttcaccatctttcttcttaaatcacttattaacttgggatttgtcacaattttatcatccaaacctaaaattttccctcatgtgcttccaaaatcttctgaatttacatattctcttaatattctccttcaagtttaccatgcctcagtccctttacttgctttaatggtatttattcctttcttcattttgtaaaaaggacacattcatttaaaggaagcagaaaatgcagaaagattaaaaggacataaaaaccccttgcaatgttatctatatttaagcattattaatatttggagctaaacttcatgttctccatcttttaatgttaaactaaacaaatactttataaagtatttcttgatcatggcagcaggatgcattctctttttcttgctgcctgtcaatatcacttgagtggcatatacagtcctattgaagatattcgtgcaaatatattgttcctttttccaggtttaaaactctttaaggccaaggcacatgcttatacatttctttgtttaagacagatctggtacagtgtataatgttaattcaatatttgttgaatgaatatgcttaataattcagatctatttgaattatcaccgtgaataaacaagtttaattctcttctatagaatgaaaatatgtgtgagtaagctggttaggaggaagtgaaattttttattcagttaataatgacaatacagattacatgcttcagtgaagcaaattcctttgtataaagtacaatacattgttgggttcacaattgcagagtcataagaaaatgtatttctcctcatatttctctcttacagaatgtaccattcaaaataattgatgtaagtataaagaattgtctttttgtgctactaaaatttccactacttattttcatttgtcttcccagcacttcttctgatcaattgtatatttttaaggcttttggtattcattgttgatattccatttcattttatatgttctatctctaacaatttcatcttttttgggggatgatctcccttttttctgtgtataattttaaatttcaaatttcactgtctcagcaacatgtagtgtacatacctcttactttctcctaaactagtcagattgcatcctattttttgcagaaataattcaaagtttttcctctttataaataaaattatttccaagttagggaaataaagacagaaatccagccatactaaataagtagtactatagaactgctttcccaagaccatgcatacttggagacactcaaggattatggcatttgtcagtccattttattactaggtctcaaaaatctcatttactatttcctacttcaaatgacccaagtttcttcacattgatcatctaagttttgcattctttggttagagtttcatcaaaaagcacctagtgttgcactcacatgcatcttattctgatgatcaggtggtattgttttgtcttcttctgtagtgagcattatcggtatttgcacccaccccatagctgcagtagtatttattcacatttctaattttaggattgtggaatttttttccatcacaaacaaataggattttatatttttcttccacatagtccaagggtcattctgaaaacaggatttctcatgtgtcaccccaatactgcactgttatagtattctgctgtgaatactgtgactactaattcactatatctacatttgaaaattgaaacatcagtctgtttgctgttcattttgtgacaaacttaaaacacttgagctttttgaaggtcttggtacatgaatttttatcatatacctaaaaacactcagatactactgctgagagattttgggccatggtagaggtgtttgtccaaaaatagaaaaaagtaattggttaagaaatatatacaagtaaacagaattatttctaggtaagttttattctactcaataatacaaaatgcactttgcatggcattgttgtgagatgtccattataggccttcctacatttgattagaaaaagttatcataattctagatagtataggaatcagctggagatttcttaggtctaactccagaccagtggttcacaaagcatgcttataagaccagaaacatcatcacctgagtacatggtagataagtaaataatggtctgcaccccagacacagcgaatcagaaactctgagggcagagctctgcaagctgtgattgaacaagtctcccaggtgagttccatgaacactaaaggctgaaactcggcgagaaccattgtttttaaccaattaaaatacaatcttcaggtgagtcatatacactgccaaaattgagaaagcttgagaatcaccgaataataataatcatcattttcaggtggtacttggtaaatttacaaacatgtaaacctgtgggatttgcctagccagtcacacatttattaggattattctcgtgtagtcgtctcctaggagagagcagagccctgggtgataggaaaggcttgaaacatgagcagcacccaaacagagtagttttggaagacttgacatggcaggaaaaaggtgcacatttgacaggtaaggagaacctgcatgttcggaacctaaatattactggctttgttgactttgtgtttgtgtgtgcaaatttggagtgcaatgggataatgctaaaaatgtggcaagaatgaaaatactagagcataatgtaggtagataatattaaggtcagaataaaggaaaaatatagggaattcagcattagtgaaagtagttaatttaatattctactatcatctcaaaatatgacaatattttaaatcccatttttgagacatgattgcactttcttcttaatagctcctcctctaataatcttgatttatatctatgcaaatctagacttctaatggttccggttgttttaaacatgtaatctggtctctgaactcaagtagttattctagatttagaaacagtgctagtcatctgttagcactttaacacgtaaacctatcctgaattggaatatgttttgaaaatgttccatccccagagtaattttgttcttgccttgagcccctggtgccccaatgctgtttatacattaatttagtctcttatatgcttaagaagaaagtatatgaatgcaaatgagaaagtcccaacctctgggatttgaatctgaaatttaaaacaagctaaaagagcatcagaaatggaagcaggattaccaataacatttatgatttaatgatttcaggaagcattaaaatgatagttgtgtatttataagcaaagccgtttatgtattttgcttttacttatttcatttttgagataaggcctcgctctgtcgccaaggctggggtgcagtggtgcaatcacagctcactcagcctctgcttcccttgctcagcttcctgagtagctagggctacaggcgaaccccattaggcccagctaatttttgctttatttttttgtcgatacagagtctcactatgttgcccagtctattctcaagcccctgggctcaaggaatcttcccccttcagcttcccaaagtgctgggattataggcgcgagccaccgcacctggtctattttgcttttaaagttaataaactactagtgttttagttggaaaaaaaattctctcatgttatttgtagaaatgctgtagaagaaaaaaatacataatattatataaaatttgctgccttttcacatgtgaaagtatttgaggtctaaaatcaggtatatctgagggcaaaaaggcaaagattcatggtcattgaaacaggaatcttaagagactgtatctacaaagaacatttcttgtatatgttgtagacactttagcagtaaaattttctattttgttctctgtctcttcagtgagaggtacccttattaaaactctgcaagggaatatataatttaaattacatattttggtataactttaggcaagctttatagtagtaatgcttttcacatgtattgtgccttcagactatcttgatattcaagtagatcagcttagcctggaaatccagtggaaatatggattgtccacaggccaaacagaaagtcttcttttgcaaaatcacatgcagacttttcaatattgaaaggatttgttcaaacttccagttctctgatgatatatacataacatataaaaggttatccttgtccatcgatgagtcaaggggataaatgtgtaactaacactatctacaataaaaatatttttgttacatcagattacagccccaagctttatttaaattgacaacaataggactcatgtaatagtgtcgtgaggattaaattagatttagaatctaaaaagtaaaaagagcctagaataatccctagtagatacgacaaacatttaataaaaatagttattactgttaacagatatgtgatttatattagtaatgtaaaatagcatactctctcatactcacatggaccttttttcttgttccatgcaatatgttaacagcaaaactagtttacaggtgagaatgacaagaagatgtgaaagattatttcagctttccctttctttaaaaagctagcatttcaagacataatttttttaaaaatgaaaattctaaattgttacttactttaaaagtatttaaaagagattctgccaatggtttaatataagaacaaaaaggagtatttttcaggaaatcaagccagagattatgagtatccattcttgttggcagaccttatttgcttattttaaaggcagtgagcaaaagatgtagaactccaagagacagacgttgattagaagtttttctttaagatgtcatttttattttctgaaaaagcatttatttttaaaacttggcacggattattaagacgggtacagcttaaatttcccattaaaaaatcatatgtcattcccaaacctgttcatatacacagagaaaaatacttaggtatgtactcattactttggcctttccttaatctgaaaaatttttttataaaactgagtatttttgtgatgttgctccatcagctcatttaaaaactactatatgatcttgttcaatgttgtttaatcttaggaccactttgtttcacttatagctctaacatctgtcttttttttttttttttgccacaaactcttttgtttctgtgtttagtagctatccatgctttttgtcctcccactcactaccaattgctctcaatatgatgacaatttaagagaattgtagcaagctaattgtcttccttatattttccctatctatagatttgtttactcaaggagctctatgagaagtgtcaggcatttgcagagacaaattgtcttggttgcatccaccactgttaaaacctccaatgtcacagggagacttgtctgtaatttctagagtcactactggaagtctttttatgaacacaggtcatcattgtggccacacaaaggctctggcactaaagaactctgatagacaatctataagaatgaagcttacattttggctaacagtcctttaatttcttatctccaaattttaagaaaattaagtcttcatgatttattcatcatacataacattttgttcatttgactttcatggtgatttttgattatagtaaaatccaacattcctatagaaatataattcaattaacatgtgttctaaaatattctaccatctacattattgagtaaacaaagataaatacattttatttaatccagtgtgtcgaaagagtaaaaaaagataaaattaatttattttatttaatccaaaaatatgatttttacatctgttcaatatgagaactataggtaggatgttggacatattttttaaattaacgattccagtgtgaagtgtattttatacttgcaacacagcttagtttgaactagctacatttcaaatgcttgatagtaacagtgacctatgactaccatattggacaccgtgggaatcaattccaaaataaaaagtataaattacatgatctttaagtgttctttcagcttttctttcacagttttctgttgagtgatttctatacctctaaactacgtgttccaagaaacaagtagaaagtgaatatatccttgaaatatttagcagtaaataaaaataagtaatttattatttcttatcattgactgttttgggaaggaattcactaagtagaccctttatcatattatcatcaaggaatactacttatttcttggttactactatctctttgatacatttaaatacattattaagcttttattatgacccgtgagtcctatttaatttttaagcaatgcatttgtagaattcctctggttttactagagttaaccttttattttctgctaatgacttaaaactcctcttagaaatgtatttaaatgctcacgtgtacaaaagggaaattgactaataactgattaagttatgcacaatattttatgtgtaagctttatttttataaatcgtgtttatggtcttcctaaataagcagttaaggaaatacatataaatgttagtaaactatcaattatactgatactatacatgaattagacaaagttaaaaaatttagaaaatttttcaacctggcatataacatgtgtccaccttgaatataacaaatccagagacacaagaaaaagccaaatacagagaatatgattctttggttatgagcatgaagcggtgctgcagtgtttggggaaaagggccacaatcatgtctgctggggattcaccctgtaattatatcaccatccagctgaatgcaaacctgcagggaaaatggttaaggtagtcttgtcaaatgttgtgcttgcaatctgtttctctgcatgctgacaagaaggcaataaagtcaaagacaactacacaactaatgtatactggagaagaaaactaggctcagttgcaatgtactgtaacaattttgaagttatatagtaccactaacttgagtgacctagaaaaattgaagttcaagatggtagcattatataaaccagtgaatcgtgtcattaccgtatggatacaaaagtggattatttattttaaatattctattcagttatctgcgtatatctatcctgcatatatccatatttcacagactgcaagaatacatataataaaagaaggcaaaaaaaagcttttgaaaaaagaaaatatactgggaaatgtaattttaattctgtaaattgtaaaatactaatcttggtgatttgggggaaggagagctgatggaaatgaccaacaaaagttgaccctttgctaaataatgaaattgtatcctctgcctagcttacttgatctcttttagtcagcacagctgtgtgctattaatattttctcttataaggaccctgagcctgaaaaaaattaagttgcacagtacacaatcattaaactaaaaagctagatctatctaactgcaaagctcacattgtttacaagttacttgaaagtctagaaaattcagttctgagtcttgccagttatgtccccaaacaggaatttgacccattggactcccttgtgaatcactagattaaccaatgtgcttattagagcccttcagaagggccaagacatttcttcctgtgaaataaatatggaaacaagatattaaatatcttctgtgtttcagaggaaaagtcatgctcagatattaaatacatacaaaaatgtagcaatgaaataattggttgcaggtgctgttggtgactcacccatatctcatcaacacacatcactcttgtgcattccaactggaagcacctgagactctttctgaaggcttttctggccaaggtgtctggctcaactgaagggcaaatggaaatgcatgcattcatatcacctgggagcagccctgaatcaatgactggcagctttgtggatcaatatcctagttcctttgttccttggtggggagaaacctgagacacagtatacattgcttctcaaagttgagcagtggtgttgggttccaaagatcttcatgtgctacggtggtagtctgctcaacatctcaacatcgtactgattccttgtccccttgggatcataccagtgcttcccttggaacatctctccccacataatattaatactcacgtatttgctcaagttcttctgggagaatttaatgtaatctgtaattccagtgctggaagttagaattttagtatgacaatggtaatcctttaaactttcacaaaacaccactgctccatttgtttttttcctattgcagtaaaatatagaaagagaatctagaaggaagagcacaaagtctataaaaataagaggggatgagagagaaacaggaaagagaaatgaaacgggagttgagaaaaggagggaatcacaactcgggagcagaaatgagtaaaatgtgagcaaagcaaaggatcacggtgaggggaacattttccagaggattcttttgaaacgacttgctggaaatttggaaaatgagcaacagtaatgtcaaatactatagctctttgaaagagagagatgaatgaataaataaaaaatatttatttgttcaggcggaagaatctggacaaataagtgaaatttgcagtgaggatgatgattgttcaatatgaggatggcctttctaaccgaaaccatcttctagggtaaagctacctcttcgtcacttaaccccagcttcaatgaagttgttcagatggttggtgtttctgagatttggtttattactcattatccaataaacctgtgaatttatagtcaaaaaaaagctgatggtgggcagacattgcttaatgatcagctagtatctgcatacctgcttaataccctgtaacatgattttgtctgaaaacacctagtttcccagactagcgtctcttctaatgtcaactttcccactgcactgccaacgcaggcccattcattcaaaatttaagagacatttgtagcattccttttctgtatcgggtttgctcaatctcactgagaggagtcgagatctctacacaattatctcttataatgaaacatgcattgatgagattagatacagtttattccatagaaaaaaaacctaaagttgctgtaaaatgtgtttagttattgtgaatcctttctagttggttataattacgtgattggatgtaatagaaaaagtgtgtattccaggaaacctggtttttttgtttgtttgtttgttttgagacggagtctcgctctgtcgcccaggctggagtgcagtggcgcgatctccgctcgctgcaagttctgcctcccgggttcacgccattctcctgcctcagcctcccgagtagctgggatggaaacctgtatttttgtcttatcttgaactatacctaacaggttaaccttggaaagtcatctagctctggaggaccaaagtttctttgtctataacatgagcttgaacaaaatctccaaattccactacctttggttcatgaatagactacaaagatgtgattcaaatgtgttggaactgaatgcaaaaatttgtgagcctgtgcatttttctgcgagagggaacatagttttaatcaaattctcagactgttatttgaaacattttaagaaatgctgaattgtactaccttgaagatcttactttttctgaaatactttgattcataattctatgactcattacctctttggcaatttcgaatagccatttctaggaaataaacttcttccttaaataaatatcaaagttacactgatcttaaaataatggtttatctagccatgaagtatttcacatctaaaagaaccgtttacgtttttggccaattaaaattgatacatcaaatgttagaaaaaactgaaactgtgggctgaattacacaataaaatttcaagaaatgtagaattttgaaacagtaatagtgactaaagtgaaacaaaatatttttttaaaatatctcataaaagtcaagtctgaaacgtaaaatttctcaggtcctgcataatgtaaaacggcttaataaaagcagcaaatataaaatgactatgataaaatactcaaaaaatggatgttgtcttttgtgagtgtactgcctcaattcatatgtatatgcctgatttaaaataatatatatttggattttattggtgtgatggttttatttggtttgcttttcttgtataatccttagggttaattttttaaaaaaagtaaagaaaaataaagaaaattggagtaataaaaaccctttaggaagtagtttgttagatattcatcattccttgaatcttcaaattcactgctcagcgtggggtagacatcctgcctcactgaacgttcaattactttatgggctacagctcagaaggcgaatcacctttttcataagctgcttgttgagagaagcttgaaaaggatgatattgtgtggaggttcaatacctttgaatctcatagtaaaattacaaaattattgttgatttacataagcatgttatttatctcaaactactcaccagttaagttgagactcattaattgtacattttagggtattatttcatgagattaatgaaattagcgattacaatacgttttatttttaggatgctttcaaattatttacaacctatctgtattacactacaatcatgtctaagagaggaatattgccataattttggggaagactgttcctatgatgatgaatgagtgtatttttcaaaatccaaaggacaattgactgatttctaaaattcaatcctagggtaacaaagaaactctgcacttataagcattgcatatttgttttaaattataagagcagaatgttagttcatttaatgagtatatatatttgactttaatcttgttttgttgaaaataatgcataaacgttaatggaaaataactgaaaccaaagaagggaaaggtagttgtgtcaaacaccatataaaaagataaatatggctgggcatggtggctcacgcctgtaatcccagcactttgggaggccgagacaggcggataacctgaggtcaggagttcaagaccagcctggccaacatggtgaaaccctgtccctactaaagatacaaaaattagccgggcgtggtggtgggggcctataatcccagctactcgggaggctgaggtaggagaatcgcttgaacccaggagggaggcagaggttgcagtgagccaagattgtgacattgcactccagcctggaggacaagagtgagacttcatctcaaaaaaaaaaaaaagtgaaatttctaaaataataaaaaagtcactttaaaaaatcttaaaatatgaaaatgacatgaaatttatagaagtgttgttcatttttatatgtaagcagagaatagtgtgtaatatttaaattctttccctaattttttaatattctttacaacatttgttaaatataaggtatattaaacccaaatggtgaattaaactcaaactcaagacactacatgaagaaaaatattccatcttcattatcactatccattttctgtaacattcagagtagttgaaaacttactttactaaagagaggtgggagagggttaaaatttgttattaatattaactgcctatatgagttttgtgttcctttaactttgttgaatttaattattcaagtaaaagtagtctattcaatcattaattgtatgcaattctattatgttataaactagagtatttgaattcctaattcttccctctgaaaatagtaatataagaattttatatgacataatttgataaggatctgtgactataataaattataaatccaggtgtctattcagttttagacttctgacctcaagcgtgtgaaacaagtgggtatgtaaggagagatcacatcattcacggcatttgcattttatatgtcctcaaaagttttcttctaaaactgactgttttgctaattttgtagtaattttattctagatttgttcagttttgataggttttctccattcactgccaacatccatttgagtattcgaatactatgtagatgtatttttagtaaaatatgtttcatttttataattggatccacacagtgctggagaattctacgtgttaaagatgtataaaaataaaacttatttaaaaattaaatgtaaacttacgttctcacaacagagtaactagtatttcaaaaatgttcatatagccttgcaaatagttgaaaatatatatttagaatttagacatttttattcatcttaacagttctgttcactgggatgcttttccacaatactcttaagtcattgttgtaactgaaaatgatcaagagtaatcatttagcgaagactttgagttgtctccataaaagaacttaagcagggagaatgatactccctgcatttttcctgcagatgacattgcatataaatgacacctgccgaatcatgccaagacatacaatctcatcgtgaccatggaagctcatggctaacggtgctgcctgctagttgatccaaaaagttgggttcctgccagagatgtagagcaatgcagtacattgataattactagctagctctttcacctctcttcccataaatgttaatgatagccttgaaatcccaaagcatttctttaacatttctattctttttgtgcaaaattgtgactgagggaggttaatcagtattgccaaggagactaatggtggaagtttctgctatgactcttatctccagttcataaaatacagagaatgttttttagatatataacacctttagccttttttaagtccttaaagttggatcccttatatcccacatgtattatgcaacatttagctgtgaatatgcaggagatattagacttgacataacagaaaacaatgtttgatgatccagtgagagtacatatgagagaattttgaaaatggtaggactgttcattattattaatgttgttgctatgtgtgctcaccccctccaagtcctttctgcttttttactttctttcttgtaattaaattgaataattttaaaaatattttgaaaccaagtaattctaaatatcatgtggcaagagaagaggaaataaagtgaccttttaacaattgggaattataaaatttgtaatatttatcttctccattaattatatcatcttatggttttctttcttatagagctttcctcatttagctacattgaaccgggacatatccatatatcgatctcaactttagccgaattttcttagcaaatgccgagctagagcgaaatttaagaaggcatagtgataaggaaccgtatccctacccccattttgttatatgctaacataaggtcttgctgcctcatttttaaataaacatttttattttagaatacatttagatttacagaaaagttggggagagaatatagagttcacattcccgttatcaccgacaaccagtttcccctattaactttttaccttaatgtgctaacatttgtcataattagtgagccaatatgcatatattaagcctaatgttcattgagattttcttaggttttacctttagtccttggctttcttttttggttccagaatccaatctagctcaccatattacatttggtcattatgcctccttaggattctcttggctatgactgtttctcagactttacttacttataatgactttgacagttttgaggagtactagtcaggtattttgcagaatgttcatcaactgggattgacctaatgtttttctcatgattagactggcattataggttttagagaagaagatcacagatgtgtcattctcaccacattctatctaggatacacactagcaacacgacttgtcactgttgatgttgatcttgattacctggctaaagtaggatttgttagttttctctactgcagtgcagactctttccatactgtagtattgggaaggaagtccctatgtgcagttcacatgtaaggctattatgtctgcctctttgagggcacagtgttgacataaattattctacatgggccatgtataaaattttattattcctccccatttattcaatcatttacattattatggacacatgaaatttgattttatcataatttggattatattctaatagtaccttgtttctctttttaatcaaataatttcagctctggccactggaaactctttcagttgccctgtgtcctttgacacacctgcatcactacagagtttttgaaaagcatttctttattttctggcattacaacttgcatcactgttatgtatgtgtatatatatatatacacacacgtatatatatatacacacacgtatatatatacacatatatacatatatatacacacatatacacgtgtgtgtgtatatatatatgtgtgtgtatatctatctatctatctatctatctatctatctatctatatatatatatgttttagcttgtatattttttgctccagtcttagaatcaaccttctaaggaatcctggtttttgttgttgttgggtaatggtacttaccagaaaccagtatctggatgctatgtatgctcattgatagtggaatataattgtgcaaggggatatatgtgtttctactaagccatgtatatatgcatatctataaatttctatatctgtgtcttcatatctgtttgtatgtatattcatctgtatgtatatttaacttaatgtgtgttcatattgatgtatccaactataatcaactataatcaattaccatgtcaatcattctaaccttctccccttgctatttgtaacttcccaccccaatagtaataaacgtggatcccaggctgggcgcagtggctcatgcctgtaatcctagcactttgggaggccgaggcaggcggatcacctgaggtcaggagttcgagaccagcctgaccaatatggtgaaaccctgtctctactaaaattacaaaaattagccgggcatggtggcctgtacctgtagtcccagctactcaggaggctgagacaggagaattgcttgaactcggccagcggaggttgcagtgagctgagatcatgccattgcactctagcctggacaacagagcgagactccatctcaaaaaaaaaaaagaaaaaagaaaaaagaaaaaaaaaaacctgtatcctaccattgccatcaatttaattacttgttaaattcttgttatcatgtatgggagtttcagaattgttagtggtagccccctggagaataactttgtcaaacagagaacaggatttatgtgcaatgactctagtcttgcaaactctatttccaaagttgcctaggttagcatcacccctctcccctgccaccacataagtgaggttttgttacattttcatatggttagattatttttttcacattctgccttctgacatgtgatcctgacttcctgcatacgttttaaagcgtttttcatatattaaggttttctcttctgtatagttctatgggttttgacaattgcataatatatattcaccattatggtatcatatagaatagttccaatgccctaaaaaaatgccctgtgctttgcccactcaactctctctacagaaaaccctgcaactaataggtgtaccctctctgtagttttgtctgttccagaatgtcatataaatataatgataaaatacttaactttcacagataggcttctttcacttagtaatatgtatttaacattcattcttgtctttgcatggcttttagcttatatttttaagttcattatatagttgtatcacagtttatccattcacctactgacattttggttgtttccagtttttgcaaattacaaatgaagctgttattaatgttcatgggctgtgtgtgtgtacataagttttcaattcagttgagtaaatacctagcattttaattgtgggtcttatagtgagaccatatttaactttttaagaaactgctaaattgtcttgcaaggtggttgtgggaatgcaaaacggcacagctactttataagacaaattgaatgtaagttcttgttactttgtgttctcactgagaataatattcttagttttgtggatgttcgccattctagtagttccgtagtgccaccacatagttgttttaatgtgctctaacttaatggcaaatatgttgtgtattgttaatatatgtttacttgtcatctctatatcatttttgataccgtgtctttttgattatttaataaatagcccaatttagtaattgggctattttcttaaggctgggtttcaagagttctttatttaatttggatatatgtaccttatagaatatgtcttgcaaatattttctcccaggccatgctttgtctgttaattcttttaagtgtcttttgaagagcaaatattttaaactttaataacgtccaagatcaattttttatggataaaggcttgtgtgtacctaaaaacttttctctaaatccaagagaaaatccattttattctaagtatagttttttaaattttacatttagaactatgatccattttgagttaattcttgcacaagacatatagttggtgtctgttatttttattttaatatgtgaatgctcagcattattactttttttatcaacatttcaacaaagcagaaagattatcctctcttcatttcaaatgcctttgttaaatattaattttgtttgtgtgggtttattttactggttttctactctcttccattttctattcctctgccaatccctcatagttttgatgactgtagctttatttgtcttggaatacagtagcatgagtccttcagtttgttcttttttcagtattgtagctatttcatgtctctttccttgccatataagttttagacatggtttgttaatatcagtaagatagcttgctgagagtttgattgggattgtgttgaatctataggtcagtgtagaaagaattgacatttagaagtattgagtcttccaagtcataaacctggaagatatttccaacaccctcttctttttaccctgagaaataacaaaatagtgatatttttaacatgttttcctcattaaatatgtcttataaattatgtaggtccagaagacaaaaaagaaaaataatctccatccaacaaacagcatagattaagattaaatagatatacaagtatctgggtcttgccaattaggttttcaagtgcattcatacaagaaatttactggaacacattttgatatatattaattataaggctgctttaatattatagatggcatagaaattaaaattcattgtgcagaagattgacacatatggtcagagaggaaaggagactcagggagcagcacattattaattagaagatgggggaggataaacataagactctctggagaaaaaattaaggacatgagacaagaaataacctgaatctgttttgaagggatagagatgcataaaaggactggggtattagaaaagactactttgaaaaaaatgagagttttgagttatgagaccagaaatgaatggcttagaaaggcatcctcttctacccacaaattatacttgaaaaataataatcaaaatatcatatgttttaaaaataaaacacaggcttattatttgaatctcaaaatttattttcaaattaacaaactagtatttgtctgtgagttacaaattctatacatttgaccaagttccatttacagagtgaaggcagattttcttcttaataaaagacgcattttaagaattctgaaatgtaattgaaagaaaagactggcaaagacatatgaggacacaaatattccaaacaattatttggttgttaacatgccaacaaaaggttggttttcaaaagaccatgtttttttaatttcagaaaaatacggtttcagtaattctcataagtaattcagcgatgagctatcagctaccggtaatgaattctcctacaaaggaataatttattcccagtgtactcacacaagctgggatgttaccaggaacttgaagctgtaaaagaaccctatcttattagctacaatgcctcactcataatacatacctcatgagttacatattaaatgatcagaggttatttatcttcatacactagtttggaaatggatgaatcatttctcatttcttctgaaagacatacattgtgcttttgctcaaatttcaatttcagagcttcaaacttgtgatacttatctaaatgaaggattagactcacatttgcacacacacaaagcacaaaacaagtgaactaccatatctaaaggcaatagatattacaatgaaacacattaacaataatgtttacttttctaaaaatgttcagttatatattaaagcaaaatggtatttcaccctaattctatgcaaatgtttttgttaaggcattcagttgcttaattaatggtattgaattttaaaaaatctattggtttgcaaatcaggttcttacgcttgtatctatcattctgttctgagagggttgatttatgggtacctataaataaaacagaaatctaaaaaatttagtgagtggagcccagcatgcttcaaaatggaagttgaaacaccaccgtatactatgatcaaatatgttgacttagagttactaattttactttaggcttgataagaaaggattgtgtgtaatctgaatacttactggtagtgagcatatgattgtgtgcctgtaaatacagaatatcattgataatggaaactcaatgtatccaatgcttagttatttacacaaaatacatcaactcatcatgaattaaagactagatcaaagtcataaaaagtaaaaagatacaaaagaaaaatgcatttttcttagataatatcttcattaaaataatagttaaaaattagtggggcttaaatttattgctgtgtattggggcttgtggtgttctttatgtgtacttcaccccatttaacctgaataacaacatgctagttataacctcatagctttaaaatggaggccattctgaaggcctaacttcattgggtcatctctaatataacattgcttcttttgtaattccagcctcatttttctttatttctgtattagcccattttcacatttctgataaagacatacccaagactgggaagaaaaagaggtttaatggatttacagttccagatggctggggaggcctcacaatcatgacagaaggccaggaggagcaagtcacatcttacatggatggcagcaggcaaagggagagcttgtacagggaaactcccatgttttaaaccatcagatcttgtgagactcattcactctcatgagaacagtacaggagagaccagccccataattcagtcacctcccaccatcttccttccacgacatgtgagaattgtgggagttaaaattcaagatgagatttgggtggggacacagccaaaccatatgactttcctaaactgactgcttgatatttgtatgcattatgtatgaaaatacgtattacttcatgtaaaatgaaagctgtttgattatgctaaagaaaacaattttgtactgtatctagaaaagaaaatgtttaattggtcagcattaaaagaatgagtaaaatcccaaatcaaagtttagaatatactaaatgtaataattacctccttatatcattctcttgtaatgtctagttcttcaaaaagctttataggaaatggacgtaggtactattgagagtagaattttaattttaactcagggaacttaaaacttttatgtaatgaccttcacagtatacattttgcaacctgttattttagggcattatcaatttctcagatcaaagtttgaattacagttataatattctgttcaccaacttccttatttaggtacaaaaggtttaaaagatctaaaatataaatgcatgaaaatttagaaaactgtttttctcctcaaggaagcaccaaaatggaaaaaataatgacactggttactactttcttcttttatataactcagttggttttaagtttcagcttcaattcctcagttttgttctatttggtttgggaaagtggtacattatgtatatacaaatttatgtgtgtttgccaatgagtgtgtggtcacgtatatctttgtgatttattatagtataattttacccagtttttccaaagatatatttaatagtactaaatagaaaatctatgatatccatacttgttcatatgggatatctttttccacttcctttaagcaggaagtaatttcttagactgaaatgagctttagaccattcctatcacctcagcatgcagacaatattggtccctcaagggaagataagttgctgataaatctgtagtataacattagagaactcaagagccacagtatcagattgtcccaacaaaattttagagcaccttgtttatcatatgcggaatctatgaaagctaatctaagagtagatagtagaatagtggttaccaggagctagagtagttgatcaaatgatataatattttaattaaatagagatgtttaagagatctattatacaccatggtgactatagttaacaatacattattgacaaatgctgagagtggatgtaaagtattgtcaatacaaaaataattatgtcaggtaatgcatatgttaaatagctgaatttagtcattcagaatgtttatatacttcaaaatataatgtggcatatagtaaatacatacaattttatgtcaattttaaaaaataaaaaaatgaaaaaagaaaactatgaacccttgagcactttagagagagtagaactttcctgttacattcataggatagtatttagagactgtacttcgatcaagtatatgagcacagaaggacctagtattaagagccccggagcaaaatagtcatctcacagaaactagatcaaagtgttaagaatcatttaagcagctacaaatacttcctgaaccatattttgcccacattacttgacggttattctttatgaattaatatggaaacttaaataacctactgcacactctatataacttattgtaaagaagtaagcatgtaaagtcatacgggctcaaactttcacgtacctgtgagatagtgttccactttatctaccaaaataatctttatttatgataatggttgatttcccttatcttttaggtcacaatacatgcttttgactaatgttatctgcttccatactcaacataattcagaaatgttcttcctaaaaaataacatgctgaatgtcatatgctccaaattgtgtgtaactttaaacaagttggcagagggctgcctcctacaagtctgtcccctggcagttacccctctcactcctcatcagccacacacatagaattacatactatttagaaacgggctaatgtaggcatgagaaatgtaatgtctttgtcataatatttgtcactacttttaataataacccttctaaaacttgtgcaggaagttaatacttttctttaaataaggtttattaaaatccattaaaaatgctataactttatcaaaaatatatcattttttaaaaatgtagaacagagcagttgaatagtttctctaggtgtcaaatttcaacaatatttgttattgccactatataaaatcttctaaataacagaatattttataccaaggaattatggcatatgatttcctgaaaatgaaattttccttgatgatttaacatttccaacaaccctgataatcatcatcaaatatatatttgttaggttattactagttactagaactataaactaggccgtatatttaaaaaacaattttcttcttgcagattatatgttacatggaaaatcccaaaactttatggcacactgtgcatgagtaataacaacaagaagaaactggaggcttatgttttgagactggttcacacagaaactgcaaataatagttaacatagggaatacggtgatgatgagttcattagggagaaataaatattgtattgcattagccttcatattttaggatggggtatacactggatagttaagaaattttattttataaaataaatttgaccatataatgcatagaatatggtgttcttttttttttaagttctggggtacatgtgcagaatgtgcagctttgttacctaggtggtttgctgcacctatcaacccgtcatctaggttttaagccctgtgtgcattaggtatttgtcctaatgctctccctcccctagcccctcattcctagacaggccccagcatatgatgttcccctacctgtgtccatgtgttctcattgttcaactcccactaatgagtgagaacatgtggtgtttggttttctgttcctgtgttagttttctgagaatgatggcttccagcttcatccatgtccctgcaaaggacatgaactcatccttttttacggctgcatagtattccatggtgcatatgtgccaccttttctttatccagtctatcattgatgggaatttgggttggttccaagtctttgctattgcaaatagcgctgtgataaacatgtgtgtgcatgtgtctttatagtagaatgatttataatcctttgggtatatacccagttatgatgctggaacaaatggtatttctggttttagattttgaggaatcaccacactgtcttccacaatggttgaactgatttacacccccactaacatggtaaaagcgttcctgtttctccacagcctcaacaacatctgttttttcctgactttttaataattgccattctgactggcatgagatcgtatctcactgtggtattaattttcatttctctaatgaccagtgatgatgagcaaaaatcacaagcattcccatgtaccaacaatagacaagcagagagccaaatcatgagtgatcacaattgctacaaagagaataaaatacctaggaatacaacttaaaagggatgtgaaagacctcttcaaggagtattacaaaccactgctcaaggaaataagagagaacacaaacaaatggaaaaaaaatccatgctcatagataggaagaatcaatattgtgaaaatggccatactgcccaaagtaatttacaggttcaatgttattcccatcaagctaccattgacttttttcacagaattagaaaaaaaactactttaaatttcatatggacaaaaaaagagcccatgtacccaagacaatcctaagcaaaaagaacaaagctggaggcatcatgctacctgacttcaaactacactacaaggctacagcaaccaatacagcatggtactggtaccaaaacagaaatatagaccaatggaacaggactgtgttcttaaaatatgaatttttcgactgcatttgaaaggaaaacaaatatttgaaatggtcaattgaaatcgaccacattgaaataatttaaagagggtgaaattaatatattcaaaaataaattctgccagaatcatagatgtttgggacccatttcatgtctgggcacctgttattatgggcatgcctcctacactgaactaaaatttacatccctgaaactccaaggctttcggttctgtcccaaggtaaatctacatcctcttccatgtgagagccttctgagtatttgatgaataccagtaagacaaatgaccccaggttcttcacttgttctttacaagagaagttttctggtctcttctgaattctggttagtcttctctaggttgcaaagatctttcgtaaagcaagagttctgaaaagatcaaattttatgtgtgataaaatggcacgctattggaccatactgagtctgctgtttaattttcaaccaattcttaaattatttccacagtgaactacatactggctggtatttttttaagaatctctcacttacatacaaactcactttaccaatctccaagttttaatgtcagtcaatactctcttttgttgttgttctcccaaatacaaatgttcaaaatcttactaatgtaactttcttcagtgcctgctcaaaggctcagaaatcactttttaaaatttactttttaagataaaaattgattaaaagtatatcatttactccaaccattcatatgatgtaattactatgtgttagagactttattagcaagagcatattctgcaaacaaggtagtctgggctttggtctcacaggagtgatgatggacatgtcactatgcgtctgtatgctttagtttcatcaaatgaaaatttagagagtttggttgtgtgaggaggaatgggtttgactgaatcaggaaaccttagtggattcttagtgattgtatttttcattggtaaattcccatgacctattcccaaagctattccagggattttaggatttgatataaaaaactacaattttcatttcatgtgaatatatttttgttattttacagtaagaaaatgttcatgttaaaactatatgagcaacataggacagcaaatgaatttttagtactaaatataaaatgcctcaaatatactggcatccaataataagattttaaaatatcagattttaaaatcgatttagacttaagtaacattggccatgtgttcaaaagatgggattttaatatacagactattgagatctaatacactatgaatatccaatgaatattttcaagttaattattcaaaaatcaacattttctgaacaaaaaaatgaaaaagataagttcttaaccataacgtagagtaacatttacaatccaaaaccttttgatctgaaatatcaaagattataaaaaatattagcctatatttgtagaggacataaactttttaaatataatttaagaatataaatttataaacaatcatgtagtcataaggaatttaaaattataatctatgaatactcatcaaaaatcacattagaatttataaagatcctgaatttatagtaaaagatttattgcttccatgaattagcaatttggctgagctaatttgtaaatgatgtggtcgcttgaaagactatacacaaaagaaaattggtaagcaaaaaaaaaaatacaaaatatcggaagaattactgaattgagagaatgaatgctctccacaatcaatgtcattaaaaaagcaactttctgaaataaaagagaactgtctacttttttctttgtcccttttttagtaagcagtttgcctctggtttaacaatatgaacatacttcctttcccagctggaggcatccgatcctgggaatattgatgtatgtacaccccgtagattatacttttcagactagatggatttctaaattcaagatctaccaaatacttccacaattctaattaaaataagaagtttgggagtcagaaaccttttgccctagaggcttgccccaccatgtattaattttcaccattattccatttaactggggttactcatttttatttcctaaaaaattctatatctggaaagaggtaccattctacagcatttctggcaaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaatagatataaggatggtaccatagcgtctccactaaaaatacaaaaaactagccgggcatgatggtgggcgcctgtagtcccagctacctcgggaggctgaggcaggagaatggcgtgaacccgggagacggagtctgcagtgagcttagatcgtgccactgcactccagcctgggcaacagagcgagactgcatctagagaaaaaaaaaaaaaaaaaaaaaaaacagaaacgtctaagttgcaggaagtcagtaggtgtacttttggagtcatcttaaaaagagacgatagacatttcttccatttctccctttgctgccatctggcaggcagcctacaatgtgattgatccagtaggaagagtaccctatgggccaatctatgagccctgctagctaccctggaaagaggctgaggtgccttttttcaagaccccaacactagctccacaccacccaaccacatcgtttaaatttcagttattttctggtacacactggtacacatttgccaattatgtacaaagactgtcaatgaaatcagctgttcactatgagattacagtgtggctattcttttgtaacaaagtacttgattatctagagtattttacttcaaaatatttctgaaaaccatacttccctgtgccgaatcctcagtcagaagagagctgacaatcaatacagaagtaacatattgttggaaagaataattagaacattaatgaaaactgatctcattcatttttcttaaaaatggaggaaataatgttttctgatttctctccatcattccaagtgcaaggtaccacgtaatttatatgtaattcaaacatcaatagagagattttttttatattgattgctcccactttagtagtgctctataaacaaataaagaaattaactgattttacccctgatcagatgatctttctttggagatgtgacatttaatctgattattcatgaatatgttaatgagagagttatcacatgccagtcattagacactgaatattaaaatgcaaccagtcatgcagtgttgatgacaagcttccttttccaatttgcaaggaaagaataagcaaacaagatgagtctaatctctgggttttgttactttttgtaaaatcttcagtggcacttatatgtgtcaagaaaaaaataatttcttaaaatcgcaaactcagggactgcaatgttttttgtcactcattccaattaaaccaatggcacttaaatttaacaggaatgagactttaataattaatagagtacagttgtgtgtttctaatatgcaagcaattccaagttgataaacagctttggattaccaaagtttactggtaaagctactgttaggaacttaaactagtcatgtattttctgtaagaaattactttgcaaagaatggtaggaaatcagagatttaatctcactccaccaagaccctctgagggcaaagaaaatgtgcgtccaggaataagcacaaggcctcaaacatagcacacacaaaataaagattagatgaaggaagaaaggaatgaaaaatacctggatgtgctatactagtagtgtataaaaatctaatcattatttaaactttgtttctatgtgaaaacttaatggaagattccatattggctctaagaaacacagcagctctcttcctacctgtctgccttagtaaccagcagtgagtgacacttttctcttacaaccagccagtggcctcaggatgctatgctagtaacaggagagcatgaaactcctgaagtgtcaggggctgtcatggctttgtgtggacattcttaggtgaggtacagcgatgacacatcgtagagaagaggaggtggggtagtcaatcgcctcagacactaaaccataaaacatctctgaaagtgtaaagcaaagaagaaaattgtattcatcagaattcttcttaaaagagaatactgggtgtattacaaggacctcttggttaagctgcatggggtagactgtaagaggcttttgtctgttccactcacagcaaagcccgtatgctccaggaattgttagtaattgctgtgtttgtttggtgaagtggatgatataagaagcagggagtgctgccttccggagtcctccttttctgcctttgttctcatccaggtgccaggactcatctctaaaaaaaaaaacagttgagaaaatatttagagtatcagtttgaaggggtttcaaattactctgctaagagcaccgaaatgcctgtctctagccaggagtcaataaatggggcaggaaaaaggagggactgttccagtggcaagtgaatggagccgcctaaagtattgcttgctcactttagcaaactgccttatagtattaaacagtacattatgagactgttttcaccaaacatcttgaacaacagacaggtgcatttttcctgttattaaaatgtgggtcataaaggcaaagctacagagacggaaaacagatcagtgaattccaggacacaaaagtaggggagaggtggactacagcggtgcccacaggaattctgggcagggcaggggggcggggggtgatgggattgtgctttatcttgaatgtgctggtgattaccaaacatatgcatttgtcaaaacttatggaactgtatgctaatcacagtgaattttatggcatgtaagttatattttaacttacgaatttttaaaaggcattatattattactctgaagattcagataaacatacacacacatatgaaattcaggaggtgttactagaaaaaaagcccagtttctccttatctaaaaaaattgccgaaatgggctatgattttttcaatatcttttccaatttttgcctcttataattctgtgtttaaataactaaagaaatctgaaattacttagcaactttgtactagcaatggtcattattttacaacctatgctcagatactaattaccttctcataattgtccagtatgcaactgagaaggtcaaccactaaaatcattttaatttcccttcagcttcactgattatttgtagagagcatttcgtttctaggtcaaatcgtcttaatacacacagatcactctggttgagccaaaccagattttcttcaaaagctctgacattgagaccctgctctggcatttcatttgtttgtatagaaaatgttaggcgtctctttgccaagtctaagctgtgattccaaaatcccctcataaccttgcttttcaactgtattccaaacatatataaaactgaaattgaccctacagtcattgccagaggcatacatagagagaaatgtacaatcacagtgtcattggacacacgcatataaattgcgtatctctaaacttcgcaaatctaatatggtattcacaatttgggcaataatgtcagcaacaaatttaattaaataaaaaccttgagagaaatagtggtttatttctgaaaaccaaatattgaaattttgctgagtggcttactttaaatgatcagaggaatgcttcataaattcttgcagtagcatcgtaagactttatgaccatagattctctgatacatttattgggacaccttgtaaaatagtgaagttgcagaaacacaaaggcatagtttttaatttcacatttttcaatacatattacacatgaaaactaaagttttaattaaacaaaggaagtcttaagtttgcattttatacattgattgacaagatatctcttaacataacatgcatagccaagttccttgtgtcacttgctttgcttttttcattcttccttaatttttactaggattttattttctatttctttttcaacaggaagctctgaagccaccacctagttcacttcaatagttatgtgcttttctacgtttcaccacaattttctcagtagttcagacgtatcactcttgctcgatattgattgagttatataatcactattagcaaatgctctttgatttgatcctttctaatgtgtattttctcagggacaggaccagttttgaagttgaacacacactggtgtgtaatgtgcatgtacagagtgcctctgaactatgcagagtaggaattgattcctaaaccccacataaatgtaactcagactggtttagaaaggctattggatttgaaatggcaaaatactaagatatgggaaaaaataagataccagtttaattttaaaatcagtattaatcatgtttaccttattcttgattttttaaaggaacaaaaaccaacatatatgttatttgatttgtacaaatttgtattattctatataacatccatatatattgtccataaccatgtgatcacatagtgtgtctataaggaccttgtatctagtcatatgtgcacctgttgcagtaacccatgctgtgtaggcaggttctatgacaattcaaatcagttctagtgataaatcaaacctgttggttgcttttattgaatgttgttctatttctgtctgtaagcgtatagccaggttaagagaaactgactgaactaaaggggcgcttatgactattccctaatgatatcacatccaaaacaatgaactgacagtgacttaaattattaagcattaggagaaatccctgtatccctgcagtgttcagttccttgaggctctgacaaatgacctccagtttgttggacaaagtaggcgggatatgaaggcagctcttatacacatactttattttggctggggcaagtatcactggatatctcatttggtagcatattaaaatatgcagatcttcatggatcagacaatattattaaaacagtttaatacagtcaggtgtttcttttttttttttttttttttttctttgagatggagtctcactctgttgcccaggctggagtacagtggttcgatttcggctcactgcaagttcctcctcccgggttcacgccattctcctgcctcagcctcccgagtagctgggactacaggcacccgccaccacacctggctaatttttttgtatttttagtagagacggggtttcaccgtgttagccaggatggtcttgatctcctgacctcgtgatccacccgcctcggcctcccaaagtgttgggattacaggcttgagccaccgcgcccggccaggtgtttcttaacgatgggaatgttgtgagaaatgtgattctaggtgattttgtcattgtacaaaaatcacagagtgtaattccaaaacctagatggcggatcctactatacacctaaggctgtatggtataacctatggttccaaggctacaaacctatataacatacagctgtactaatgctgtaggcaattgtaacactatggtaagtatttgtgtgtcaaaacttatctaaaatagaaaaggtacagtaaaaatatggtaggattatcttatgaaaccaccattgcatatgtgaagcatagttgactgaaacatcattaggcagcgtaggctgtatgcctcaggtgccaattatgtgattccatctgatagcaactatatgaatattatatatttgagactaaaaggctaacataccaatttattttgtatgcagcttttaaaattcatgctatttttacttgtaaaagttctgttcactactttaaaagctgaagcacattaccggaaaaagcatgatgtgacatcgttctctactataaagaaaacacctgataaccaataactttcaaggaacacacaccccatgccacatcctatgcattctaaccattttacaagcattatctcatctcatggaatccccacaagtatcatgtaagatagattctctgattattcccattttatgggggaggaaaccgtacttcagaaggttaaataaaacttgcttgagtgtaaaatatattttcttacctctcactaccatttactatgatacatttactaaggatttattaccctctgaacaggagccttgtgatctcacatttcccaacccctcctccagggagtggagttgatctgagtattcagaagtaaaaatgacagtagttagcaattgctgagaattgtccatgtgccaggcactgtggtcaacacttacaggtattatctcatataataatcagaatctatcaaagacataggtcaattattatcacagttttagtagacaaggacactgaaacttataaaggttaaaagtctttgtccacatcacagctaagaagtggcagagtccgaagaagagggaaggcagtctgactgcatggcctgttctagtaactattatgaaatagccaacggcacccaagacttagtagcttttgaagcttcaccattgaggatgtgcatttttaaagatggggtcagagtataaggaagtcttcctggtcctccttaagttccacggcagggtgcctgcctgtgtactctacctacctgttctaattctggggattatcaggagaagaaacaagaaagctataaaagccttagcttctcatgaaatatcttagcaaaacatttttatgtgaaaaatgtatgccaccttttatgtttatggccttgttttattattttcttcttttggaatatttctttctggagtttacaaaggaattatactgaacgctgatgtgaatcccaaaggaaagatacgtttcttctctaatgttctcaaatgtcaggaaatcatttagagagtgaatgtctttggtggctggttctaatttgcactgttgtttgataatgtgcacactggagatcaattgtctgaagatctccttagggctagaaggtcatctttggtgaattagcctgatgcctcattaaagatatgtcaattctcctttttccttgcaatgtgtagagtatgctctctaagtggagtggcaaaatgtacatgaggagggaaatttagcaaattagtttaatgagaattattgtgtttatttggagacttcgatttgattgaaagaggattttactattgggcttcctttttggcgaaggttatccgtagcacctactgtaattgcttcctgtaaaagagtcagtatccatgcagttgcactaatgtgctcttgtttggtgcatttttctcttctttaatataaagcatcttgactgcgaaaattttaaactccagtgtttgaaggatgaattgatgttgattttctgcaaaggaaaataataaatagacttggagaaaggaaaaggaaacaaatctcactgttagaggtaatgtggaaagaataataaacaaatgtaaggaagacaacatctgcgaacagggtctatctattaatgcttgttagggagaaaatgcctaaaatgtgaataagtaaaagcctaacaagaaataaggtatagcagccttccaatagtttgcaattgaaaagagacaaacttgtccaggcacggtggctcgtgcctataatcccagcactttgggaggctgaggtgggcggatcacaaggtcaggagatcgaggccatcctggctaacactgtgaaaccccgtctttactaaaaatacaaaaaaattagccaggcatggtggcgggggcctgtagtcccagctacttgggaggctgaggcaggagaatggcgtgaacccagaggcggagcttgcagtgagccgagatcgcaccactgcactccagcctgaggaacagagcgagactccgtctcaaaaaaataaataaaaatacataaataaattaaaaagagacgaacttcttccagaagcagaaaatcaaatacttgggcaggtttctaataatttataagagaagaacatattttatgttaattataatgtaggccatattttataagaagtagctggacagttaattctgtttcagttctttttcctctttggatttctttgcttctaatttatttttctgtttctatgattatttctctcagcttcaatctttagctctttctactctttaatctctggttatgtggggtaatggaaggcaggtgctggtgtgacagtggcccagtatcatgacattctgatagattgtattccctttgatctctacttaagagtttcatgcaggtgtttcggaggagagagaaaaaaatgtttttcctgacatttttgtcactgcagagagaattacagttttacaactatcatagagattcagaacagatgaatatatgtctatcagtgagcatattaaaacctaatattttgtgggtttgttgttattatttgcaaacttggcacagtaattgtgaagacaaaaattgttcttcaggctttgtgagtcagattaaaaaaagttttaaaattagcactagtttgtaaatgagaacattcaagaaaagaacatgaaacaaaatatatgaccttaaattatgtataattgaagagaacttttaggttggtgaagctatacttactgttttttaaagaaaaaagcttatcataacttatttaaaagacaaattttgttttgttttgttttggttttttatttttttattttttatttttattttttaattttattattatactttaagttttagggtacatgtgcacaatgtgcaggttagttacatatgtatacatgtgccatgctggtgcactgcacccattaactcatcatttagcattaggtatatctcctaaagctatccctcccccctccccccaccccacaacagtccacagagtgtgatgttccccttcctgtgtccatgtgttctcattcttcaattcccacctatgagtgagaatatgcagtgtttggttttttgttcttgcgatagtttactgagaatgatgatttccaatttcatccatgtccctacaaaggacatgaactcatcatttcttatggctgcatggtattccatggtgtatacgtgccacattttcttcatccagtctatcattgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatctctgaggaattgccacactgacttccacaatggttgaactagtttgcagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgaagagcattgtttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtcttgaatccatcttgaattaatttttgtataaggtgtaaggaagggatccagtttcagctttctacatatggctagccagttttcccagcaccatttattaaatagggaatcctttccccattgtttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagcgtgatgcctccagctttgttcttttggcttagggttgacttggcgatgcaggctctttttttggttccatatgaactttaaaatagttttttccaattctgtgaagaaagtcattggtagcttgatggggatggcattgaatctataaattaccttgggcagtatggccattttcatgatattgattcttcctacccatgagtatggaatgttcttccatttgtttgtatcctcttttatttccttgagcagtggtttgtagttctccttgaagaggtccttcacgtctcttgtaagttggattcctaggtattttattctctttgaagcaattgtgaatgggagttcactcatgatttagctctctgttggtctgttattggtgtataagaaagcttgtgatttttgtagattgattttgtatcctgagactttgctgaagttgcttatcagtttaaggagattttgggctgaaacaatggggttttctagatatacaatcatgtcgtctgcaaacagggacaattcgacttcctcttttcctaattgaataccctttatttccttctcctgcctaattgccctggccagaacactatgttgaataggagtggtgagagagggcatccctgtcttgtgcccgttttcaaagggaatgcttccagtttttgcccattcagtatgatattggctgtgggtttgtcatagacagctcttattattttgagatatgtcccatcaatacctaatttatggagagtttttagcatgaagggttgttgaattttgtcaaaggcctgttctgcatctattgagataatcatgtggtttttgtctttggttctgtttatatgctggattacatttattgatttgcgtatgttgaaccagccttgcatcccagggatgaagccctcttgatcatggtggataaggtttttgatgtgctgctggattcggtttgccagtattttattgaggatttttgcatcaatattcatcaaggatattggtctaaaattcgcaaatagacgcaataaaaaatgataaaggagatatcaccaccgatcccacagaaatacaaactaccatcagagaatactacaaacacctctacacaaataaactagaaaatctagaagaaatggataaattcctcgacacatacaccctcccaagactaaaccaggaagaagttgactctctgaatagaccaagaacaggctctgaaattgtggcaataatcagtagcttaccaaccaaaacgagtccaggaccagatggattcacagccgaattctaccagaggtacaaggaggaactggtaccattccttctgaaactattccagtcagtagaaaaagagggaatcctccctcagtcattttatgaggccagcatcatcctgataccaaagccgggcagagacacaaccaaaaaagagaattttagagcagaaatttttttaaaaagaaattcaaaaaaatcatttattaaaataggcaagtacttctaaaagcagggcttgaaggatgcactgatatgtactttgataatgtaagccccaaagatcaggacaggtgtctgtcttatttgctcttctatctcatttacaattccctgaatgaataatgaatgaatgtgtgtatcacaagaaaaaaatcatggctatggttgccattcgaaagaggcacagagttataacactagtcataggtagtgcagatagaagcaagatcattgcatgggggctggagggaacttaaataactagtagattacatataataacctcgattctcatccctcattctatgtcaggcttagagggtctgcataccccctggccacagtgccagtggagaagggtttctatcccgtcatgttctataatatgtatctacgaaaaatgagatcagggaacatccctgtgggtatgaaacaacaaaaactttttgaggaagtgaggaggtatcttgttggagatgggggtgaggggcacttggcatctaatgactgcataactgtattctttttaacagcttgactgagatatatttattcacataccatataggtgacccattgaaactgtgaaattcaatggcttttagtgtatccacagagttatatgttcttaagtcagatctgtggagtcaggtctcaactaagctacccagtgtgtgtgtgtgtgtatgtgtgtgaatttgtatatgtttatgtgggtgtttgtggttagggtggggaactcaagctgcactgacttccagatctgtctgtcttcaatagtgttggtaatatacttcaaaatgagcaatttcttttttcctgtgagctctctgaactatattttatctaaagatactgtctgaaatttcatattaagctatgggaaaagtcacatatgtcactgttacaggtgacgaattactatgttaaaacttctagtgaaaaggtttccaacattaaattcacattaatgatttatagtcttgtattcacactttacaagtgctttgccatggttaagtaagtctcacccattcttgtaaaagtgaaaacatatctgcttaaaagcctggcaaaatgaagcttagaaaaatcctccttttagaaaatcacataatgtagttcatgaacatgttcgagaagggagcttgaacatgttcattgtctgtttctgtgcttaaataccatagctttgtgaaatatatgtgaatgctcactagtttgtgtgtgtgtgcacgtgcacatgtgtatttatgtgtatataaattagaacaagccattatttttaattatttacattaaaattttcagagggttcaggtataaataaatctgtataagtagtataatatatagtaacagtaatgtataacatataagctgtaaattacataacataaatatacattataggtaaaagtatatatacacacagtagttaaatatgtgtattttaaaattataattgaggaagctaattcatccttaagtacatttccggaagttcctctgttggtggacatattctcaaattttctggcataaataatgtttcagtttctgattaaaaccattcttgttatccacactaaatagacttgcctggccagtatctaattttatggtggagtcttgagtcatcagttctacaaagatatttaacctgttcatgataatcacatgcaagagaagctggtcttctgtgacctgcagccagtgtgccagaaagaaggtgtcaagacaagagtcgcctagtgaaacagtgctggtgaatggggaaaaagagcaaaaattaaatggaatccaagccagtttgacacaggacaaattataaagaaaatcctagaacaccctggagagaaacaatgggcaatgattcttcaaccaaaaaggctctgaggcagggcacaatatcaatggtcacaagaggacagggactcccggccatatgccctatgcccttgtctcatcggaggcttgactgagggcagagtctgtagtgccaatgggtgaagggataacaagaggcaggtaaatcccaggagctgtttctacctccagagaaggaggaatccagcaatgctacagcatctcagtccaaattggctccctcgctgtttgacagcaacctttagggctccattctggactttatctcgagctcctttcctcaccccatttcctttaaagaatggccagaaaatctgagcatgatatccttctgttaagaaggagaagaaaaaaataatcttatattagtccatgatgtacactgaaagaaagaaaagttcagtatctttataagaaccttgtctgagggattatgttaaaaaaacaaataactgaaaacataatataatattcaaacttctcttgtttgtttcttggttgttactaggccattaaaaatcttataaaacattaattgtttaatcttggaacaaaatgtatttaaaaaggtttaaaattctgccttattcctcatgagcagtgataaagagaaatcactgggaagcaacaagtgttggcagactggttcagcatggtggctgcgaaaagaaaaacataaggtcttacttgataaacagtgcagcacaggaaatccaaggctcaaactccgttttgaccttcttgatcccaacagttagaagcaatcattctctcctgtcagctttcatatctctttacctattcttttgattagagatttttaaaagaaatcttttactctactaatctatagtcatcctaagaagggttcccgtgtataaagaacatgttttatatttacatgccacagttacattagcagttccatgaatttatggagacttaagtgcagctttgactcttcagcctcagctcccaacctttccaactcatcacccaatgtaccacaattcttatcccatcagaccctggatctggctatagtcatttcctcacctgacctggagccaggactgcacatgaaaatgaggcttccgtatcacaggttggacaaacctctctcataaaatgcttttgtatttctctacttcatgggtacacagaccacttcagggacttaaatgtaacccttaataccttttataaggtagatgttgtgttttaaataagttattttcaagtgatcctttggaacaaactttatgcctttacatttctattttccaagcatatagggggtgagaaaacatgaatattttccccatgggaaagaagtgaacgttttcaaactttataaggaaatgacttttctctttgtagttataatcaggaaaaaaataataaagcccatagcttggggtcatttttaattagaaaaactttttacctgcaaagcaaaaagtctacaaaccagatttttatgctgtgaaaattttttattatgcaatacttctttaaatgttttttaaaaaactaatattttcttatcttataaatgtatgaagattttgagtctaagagaccaaatagatttatgttaaaacttctctgggcctagatgaaattctcagatattttgtaagcaatgaaaaattaattttaaagtgtttttccccaatgtgtaatgcatatttataacctacagaacaaaaaacacaatcatattttggatctttaagacctgacatagcaaaaagataatttgctttgaggccctttgatgcatttaatttaatttattggaagcaaattaatgtgaaatgataaaattattattaaaatggaaatagaagaataggaatgactcaaatcaacagaggagagaagtggctgattaccatacttcataggataattcccaatttaatcatattaaatctaattgttggcggacagatgatgggaaataccgctcttgctttgtagtagacagaagaagacagaaaaaaattttaaaaagcaattcagaatgtcactaggataaaccaaaaagtaaactgaaaatgaagaccaaagtggatttcttaaggaaacattgcctctttacattgccaaatgaaaatttggtagatgaatattctatggttttagataatcatttgtaacttgaaagggatttatatacaacttaataaatatatattgaatgactgctattttcaagatattgtgctgctgatctgtcttctagctgataaatttagctgaatacctggagcaataatagaaccaagttttattgatcaacagcaatctctattaaaatggtaatgaacagcttctgcagtatatcttgatatattttctttttactgggtgtgatgaatgtgtaaagtagtagaacttatgatacatgtgacatgatgtaagttcatgataaatgctagaggattaatttcatatagctacatattgtcattatttcaaacttcagtgaaatgaaaacatgagtttttcactgctgtttttaaatttttgtgatttttcccctcagtggcaattccaaaataaatggaggaaactggaaattattctgaatattgtgtatgaataaccatcttattaaatagactcatttaaaacattttcaaaaatttacatctttctcaataggaaatgggtcctttaattctgctcatttctctccatttttagtgatgttattttagtctaaatttccataatctttattctgggctattatagtaatattccaacaggctttttctcttcctatttcttgggatattcctatttatttcccaaaccatagtcttaaacatcttaaagagaaatatacagaatctgaaaagacacttctcaaaagaagacgtttatgcggccaataaacatatgaaaaaaaagtcaccatcagtggtcattagagaaatgcaaatcaaaaccacagtggggtaccatctcatgccagttagaatggtgatcatcaaaatgtcaggaaacaaaagatgctggagaggatgtggagaaataggaacacttttacactgctggtgggagtgttatttagttacaccattgttggtgggagtgtaatttgtcttacaccattgtggaagacagtgtggtgattcctcaaggatctagaaccagaaataccatttgacccagcaatcccattactgggtatatacccaaaggattataaatcattctactataaagacacatgtacacatatgtttattgcagcactattcacaatagcaaagacttggaccaacccaaattcctatcaatgatagactggataaagaaaatgtggcatatataccctatggaatactatacagccataaaaaatatgagttcatgtcctttgcagggacacgggtgaagctggaaagcatcattctcagcaaactaatacaagaacagaaaaccaaacaccacatgttctcacttataagtgggagttgaacaatgagaacacatggacacagggagggggacatcacacactggggcctgttgcggggtggggggctaggaggaatagcattaggagaaatacctaatgtagatgacgagttgatgggtgcagcaaaccaccacgcagttgtatacctatgtaacaaacctacaggttctgcacatgtatcctagaacttaaagtataataaagaaatatataaaatctgattatttcaccccctcgatataatggaaagagtacattgtaagtcatacatctgaattaaatggaaaaataaaatgatatagtgctaataatcagatatacagaattgtagctttacaaagtataggagataagttactctgaagattcctttcattagaaaacagccagatggactggtaggcacctgtatcgcaactattcaggaggctgaggtgtgagaattgcttgagcccaggagttcaaagctgcagtgagatatgatcacgctggtggatagtgactgcactccagcctgggcaacatagtgaatttttttttttttaaagaacaactagattctccataaaacagactatcacactctaatacataactgagatcacaggaaatcagggagaattctaaaccctcttaactcattctctgagctcatgacagagtgggtagtaagtgaaaaactgaaaaattgcgtatttttttagagcagcttagtggacagacagtattttagaataccagaaagcacaagaaatgtgtgtgttgttatgcagaattcataaacaactcttttgactcaaggaggaaaaacataggatcataataaacaaacccttaacaggttggaaacaagaatagcctgtaacatatgaagggtcactcaaccttgttagtaattaggacaacctaactaaaatgtataaatgctatttcacataacaagactgaccaagggttgtgatgatacgcaataataggaacttacgtactttgttattgatagtataaactggtatggacatgtggggaaaaaacttgctcttgtcttacaatgttgaacattgaattactaacaactcagaaatttcacattttatgaagttcttcttagtgttgtttatattatgagatagaaactgttatctgtatagtacaccaagataagaataaggcagttcctgagtggaaacaacattatgatattctcttattgctgtcactcccttccttagacactggctacaaaaaccaatgaactaattcatctgggcataaattgcaaggttgagatagtgtgtcaccaatgctatatattattctgaaatttgtatgtgggttttcatgcaaaaccattgtctgtcacagtaaagtatcttttgtcatcactaagtaaaaaccttttcaagtaacagactcagaccacgtgcacacaatggatgggcttatattatgataggctggctatcctaataaaatattttaaaaagcataaatggtgggaagagcaatagaaataaagtatgtgaagaaggatactttaaaggtgaaaaagtataacaattagaaataacgataaattgaacaacaatgcaaaaggaaattcccaaaatgcttccaaaacaaggacagaaaagaaaaaagttaaattcagttattaaaaaattaaccccattttaaagccacttgcatttattagtgttaattacttgtgttaattttaacacaagaaaatggcaaactggtaatgccttcctactgtaatataaagttacttcaaagaggaacattttctgaatgacacaatgaatttatcaaggacatggggcttttgggaaatagacctacgactgttggttctctgattatctcactgtgggctacttctgttttcattatttatttgcgatgtgggcacattaccaaactgctttcagaattgcttaatgtgtaaattcctctgaaactttgaacaagagatttttgacaggtatgattagtaagtaggatttcaagacatttgacttcactgaaaaattttactgtcatgacccctttaacaatctttttacttctggagatgtgtttccaatttgggttattattaatgactgatgtattcttaaaggaagagaaatagaatattatagacttatttcacagtaagacaagtcattaaaaataactttgaacttcaagaagtagtagaaatgggaatttgaattttcagaccaaatagatcatgacagaaatcaaagtgtagaattacaataaagtaaagagactggatcatttcagtctattttgatttgacattataattttgtggttgggaggaaaaagaaggcaactgtatttcatcagctttgaagacttcgttgtcgtgaagaaggctggataacttccttatgttgtcactatcttgcttccatccagagactgtggagtctttctggaaccaatatggttgaaaaagcctttcctttttagtcagcagggcttagtattcacagcctctgttttaaatacaatgtaacttgctttattacaaggcatactgtgacttataaagctagaaattctgttcaggtgattacagatgaaaaaaatgatgaaaattgagaggttgccagctcacgttcttttctttctcactaaagagtctgcttctattttggtccattttaaagtttccttaactcctcgagtcacagagaaagtagtcattcttcagtgttgccagctcctgattccagatgagctaatgattccacagagctatctctttggttcttaactctgcacctttactgatagtcattgtagtttaatttttattatcaatgtttatagggcctttgcggtgtgtcaaattttaggcaccccaaaatataatagcgaacaagacattcatggtcactgccttcatggagcttctcggctagactgtgtataaattttcaatctacagagaatgtctctatgtttaataacaatagaacatttgtattgactcttaccaatacatgtaaactactctttgaaaagtacactaaatcccaaagtgtcttttggaaaaggaatgttacatttttaaaattagacctgatagtccatagttgaatgctaatatgatggtcaatgactaggaaaaatgttccaattcaaaacaatttcaaagttttcttcagtacccttgtatcatcatgacttgggaaaatcatcttaggaagtattggatgttatcttggaagttaatttatagaaacatgggtggggcattgtagatcatttagtccttaaatacatttttggctgaaaggaaatctctcattaaaagggaaagaaacagaagaagagaaggaagaagcaaggtaaggtatttgctaggatcacataactggttagtggcagaagtagaaatcatttccttggactctttagtgctttattactgccctcttgtaagtttgttgcttttccactgactgttgggtaagaaattataatcccagaacagttctttgtatattaaaaaaaaatcctttacatattccatagaaactgggcttggtttgtaaagctgaggcccaggagaagctctttttcttacccatttggtctttaatgttgcttgcgaatgcatgggggtagaactctaataacaatgatggacacgatgtccttgcacataaacatttggctcctcacagcatgagatgtctggtcagccacagaggataaaataatggcgtaaagatttactgtcagggagctgggccagtctcagcaggacagcggctccaagcagatagatggcctggtatgcgtaggtcacctgtgtttacactgatgaatgtgtgtggtttccctagtctgcatcattatattgagttgtgtggtgttggtagcacttgttactcaccctagaatgtgcctttctattgaaagacaagtagactaatagcttggcttcccagaaataaatgagacaattcacatgaaagcaattgcagttagacaaaatgacataaatattaaagattaagaataatattatttgtatctgtaatatacagaaatagtcaaaaaatacttggggctgcataatttgtggttgtagcagttgctgaatttagtcccatatagtgatttggttgcataatttaatgtttatgttgtatttgtttaatacatcactttcctgaatgaaatgattgtggtatgaagttataagaaataatgtctttggcttgttatagaaacagttattttagggattttttgtacttttgaagcagtttcaattacaagtcatttttcatgagttctgaagtaagttttaggcatttgttatgagatcatattattagcagcttagatgaaaatccaaaatgcatttatggatattttaattggaaaattaagtggatcttttataaaattaaatactctgctataatctcttagaaaaaataaatcccttttacctaataggcaagttcatgagaaatctgtaatgatatctctcaacatagcatgttaacttatagattatataattataaatttataagcctagtttatactaagtatattcaagttataagtcacaatacgtgaaatgaacataattctctgaatatgtcacattttttaaagatatctgtaatcccagcactttgggaggctgaggcaggtggatcacctgaggtcaggagttcaagaccagcccaaccaacatggcaaaaccctgtctctactaaaaatacaaaaaattagccaggtatggtggtgcacacctgtagtcccagctactcagaaggctgaggcaagacaatcacttgaactcgggagacagaggttgcagtgagtcgcgatggcaccactgcactccagccttggagacagagtgagactctgtctcaaaaaaaaaaaaaaaaaaaaagaaagaaaaatatatctttattttcaatattactgtcagtgcctgaaatcatgccttgttttgctttgtctacaaatatattctttcaaaaatcatccataatgaatatattttccattctaaggtgtacttcatttttggaaacagaaaaatgccaattatcatccatgcttgtgaatacagtaaataattgatctccctacatgttacctttttaaaataaattgaacatgaataatgagtctaatatagtacaacaggtgtttctgacaaatagtattggaaaatgtattgctatttgattttctatttatctgtgaagtccttttaaagatatccatgaaaactctctcttatgaatgtatggctaattgtaaagtagaatcctcataagaccagtattctatgatttcctcttgattaaataaaataaaatttaatgtgacaatggtttgtgtacttttctttccttgtcttctctgagcatctctctagaaataggaaaaaaaaatgggataggttttgtttgggtgatttccactgaagcatagcaaggtcatgcttttgtattgtctattatcagttataatttctcaaaaacagacagcaaacaggcagtgttcaaaaatttgtaatttactatcccgtgctaaagacaaaccacagagtaaaaccgcaacccggttaaccaccaaaacaaccttcaatcattctgactggttctgcatgtttcaacgtttatggtcttttggctgaaggccaaagttcatctcttattaccctttcttttccatctgtgaagatcattgcacacacactcgttctgcattccaaacaatttcacctggcaaaggaactaagtaaaactgtctctcatcttcattactattcatttcatctttcaaatcactgaatcgtgaaaattagaagtaacaaaaaaaagaaatcaggtgtattaaaaacaaaaatttgaaacagtatatctgtgaaaccgctcagtgttagaaattgtcactgatccatgtcaaattcagcaaacaaaactgaggcaatttactttcacattttactaaatggccacttgtaagcatacggatgagattttgtctttccccaggctggatcagtctgttggtttcccaaacagacaggggctgagtggcttaacaggtgtgccaatgtgagaaagaaacacaaaagcagctgttgttaaaggcgttaggtaggctttgccaagactttacctctcagatctcttctgtgaattgatgactaaagtatgtcaactttggaaaaatattcttgaaatattttccttgatttctgacttcaaaaggcaaattataaacaccttaatcaattaatatttactactagaatgattgcccaaaagactgaactaatcaagatagaaaacaaaagtattatggcttattatgtcaatctcctatttaaaaagcctcaacattttctcatagcctttagaagaaacaattttttgtacattgagatcccaattcaatgcctctttttgtccatatctcattgcaactttgactcatatgatatcactttgctgcaaacagattaagctactaatgaagacatgcaattatctttttgtcatctctctctctctgtagctctctctgtgtgtgtgaatacatgtatacttgctcaactaaaatgatcctcacagcctcacatattaagatctcatttattctcaatttgggcttgacttctaacaaaaactgttccttaactaatccaccaatagatggcatattcttctcctgagctttcatcctgtttatcatttacttggtattccaacctacctctatggcattgctttacagatctttaatgtggtctcgcattgatatggaaagtttgcttttgtagatttaacttatcatgtgagtcaatcaaagatttccaaatagttgatgaactttatgagagaaaaggcctgggttttctttctttgcctcccttcaggtacctggtggaggatgctatttctagtagctacttcaaaaaacaagttttctgagttgctctcttatttctttaaccacattgtctctgtcgttctctgtctctctgtttctctctttctctctctattcttttgcatggacaccaaattttgtctcttagattttgaccctcttatctttgaatactggttttgttctctaaactactagttttttgccataactgttttttctttgggattttggactgtatttcttagatctaaggtacagacctcctgcagggacttccatgaaccatatatccattgtagcaatgatcttcattgtcaaaaagagtctaattttaaaagcaaagatttgtcaaagaaaccttttagaatgcaaaatagctaggaattttaattctattaaatatcaacaataacaaaaaagtggtaactatgattattttctttttgacaaaataagttcatcattaaaaaaaccaataatgccaaatcctaaaaataaatttcagcctgtaaaacatacattcaagcatgtataaatatatgcatgtacaataaatatatttaaaataatttttaaatttctagactgttgactagtgagaaactagtgaaactatcgagagttgggaacattccgtgtaagggggtaatgaagttgagagtgataatggtacctctaacttatggctcagactgaggctagattcaccaactttgcatagcgtcctctgcatttagattttctattcaacattcttgcaatatcttgaatgaaggcatagaatggcagcacattaaatttacaaacggtaaagatcaaagaaggaataactgaaattattttgagagtgtggaattctgagctaagttatagtgctggtgtttgaacggagttttaatatgagttttgcctgttaggtgatttctgccaaaaaaaaaaaaaatacgaagtttgcattaatgaaagcagagtattcagctaaaaggaatattcatccttttcattttgaagtttgttattataccatatctggaatgttttgtttacttctgcatggacattttaaaaaaacattgaaacaggagacaatggcatgaaaaggatgatcagaaagatgaaacatttggaattgatgctttatgagggacattgaatatactggaagtatgtagtctaaagcagagaaggctaaagggagatatgatgcaaattcatgagaaatgttcatacctaatatttatgagtcaaatgctaagtataattctcatgactgatccagtgatgaggtaagtgtgtggacacagaaaactgtcacaatgcacagtgtgaaaagaataacagtagttcttacgtcagggtacaagtcgagaaaacgaatgcctctatggattacaggtggagagaaatgtgatctagggaaaaggggaaaggtggtattaggcagagattagaaggtgctgtagtttttgagctggagcctagaaccccacactctctcagcctctgagctgcagccacctcccctgcagctactggagacaccgcagccactaaggctgcaggacctcctgctactgaccgtgggtacttctggtggctgctgccagaaacccaatcccttgtttattctctgggtttcaattttacccccaaacctgatgaaataccgttggcaagggagtcttagaaattttagttttcttattctcagtgattaaagaaaagggcgcagagaagattatgggaatgttagaaggttagttagttaccatctagcacaaatgggattaagtgttagaggtctaggcaggatatatagagataaccaatttaaatggtcaaggaaggttaatatctataagtactttcaggcctgcctttggaaaggcagagtggagttctgtgttgctccagagagcaatagatgatagaagttattaggagatgaaatttaggtatttgtgaaaaataacttcctcataactagagctcatggcaaaaatgtcctgctattttaatatgttgggtgtttgagcaaaagtttaattctatttttttcagggattctctagaagagcttctcatagtaggcagtagatggtttagttggcagctaatgttccttaaaaatttacaattttatgattcccaaaccactcatctaaaaataacaaaatgtgtttaaagagtagattagttaatcacaaaacataaaaggtaactagccaaaagaattaaatatattcatcacgtcttaataactttgaggaaaatgagtacatgaggtgggaaacgaacattaaaggagtttcttatcagcccttttcaggattccaaacttttcttataaatatccatcagtgctccaattaagcctttggagtgatatgcaagaactccatagtggggagggaaaagtgcctccttccacacagatgttggcacagtgctgaaggatggcggctggccagcctgctttacaagtgagggccaggagcagcatctgcatatgagagcagattatcccattggcaaactccattaacactgccaagggcacggttatgctgttagtgactaagaagtcatccctttcacctgaacatacctctggtaatttagggtaataaagaggatgcctttcttttatatgcaagagaaataaagacttgaatggtaataagggagggcaatacatattcatttattatgtaagtaagaaaattcactggtaaataatctcataatatctaatgattggatgatatctaagcagtatgtcgatgatatctagtttatccaccattgaatcccttataaaacagaccagtcagctggtacccagtggtcttacatacagtcaaagatgggaagctcaggatccccacatgcagccaactggaagatgggatagcaaagtcagaaagacctgagttcaaatcttcactatgttggtcattaactatataaacttaagtattttatatcatcgagctaaatttcagtgtgtatacctttaagatagtaatgtgtacttcaaattgttgttacaaaattaaaagaggtaatgtgtataacagctatctcaataaatagcagatgttttaattccaatgtgcctacttcacactgttgttacaaaattaaaagagataatgcgtataacactatctcaataaatgggaggtgttattctatctttcagatgtctctaatggttagaaacgctttatattaaactgatttttttctctataatttaagcctgctaatcctcattatgacttaagggcttcttaaaacaaatgttatatcttttatcttttactgaaagtctttcacatatttgaaaataagaatcgttaacttcactcatcatttcttttatggactgaacacacccagtccctcaacctttccttgtattccgtggctcttagccacctcaccatagcaagaagtgaggcggggaatgtggaaggattgtgattaagtggttgaagtgcagagataaggatgggaaatgcagggtaaaaagcactggaacaggcccagctttgttttttggccaaaagattcagcagctctgatcggcttactgatattcacacggtgctgaggttggcatttttccagaggcattaagcatcattccactcacggttgacagtttccagaaaggtttctcccaaaaacacactctcctttgatttcttcctgaaaatcatgtatctggtactttatcattttagctcatatatccacaggcagccctgggtgaaaccacactttcactaattttaatcatctatacttaagggcttttaggttttttttttaattgggttcattaaatcatactttaatgcattgaaattcaccattttcatgtgtacggttctacgaattttggcaaaggtatgcagtcatgtaaccactgcccccaaaaggacccccatgctccgatgtaatcaatattctcccccaatccttaacccctggtcaccactgttttgctttctgtctctgtagttggaccttttctagaatgtcacataaatgaaactatatagtttgtacccatgctatttctgcttctttcatttaatatgatgctcttgagactgtaagttgtatagcatgtatcagtagttcccttttttgcagagaatttttccattgtatcataatttatgtatgtgccagagttgtttgcttatccactcactaggggatgaacattggagagtttttctttttctttctttctttctttcttttttttttttaaataaagctgcaataagcttccatgtacagatcattgtgtaggcacatgtattcattattgttgggtaacaatgttggagtaaatggctgggtaggatggtatatgttcatttttgtatgtttaattttatgagaaaataacaaacatggttataccattttgcatttctagccaaaaaatataaaagttttagctgctttgcatatttgtcagcaattggtattgtctcttttaaatacagccattttcataggtgtagtgtttttttaatgtagttttaaactgtaattcactcatggtcaatgatgccgaacatttttcatgtgtgtgtttgccatccttatctgccatccttatcttttctttggggaagacagttcagttcgttttctctccttttttttttttagacggagtcttgctctttgtcacccgggctggagtgcaatggcacgacctgggctcattgaaacctccacctcccgggttcaagcgattctcttgccttcgccacccgagtagctggaattataggcgcccgccaccacgcctggctagtttttctatttttagcagagatgaggttttaccatattggccaggctggcctccactccggacctcagttgatccgcccacctcggcctcccaaagtgttcagattgcaggcgtcagccactgcacccagcccagtttgttttgttttgttttgtttattggtttgttttctattattgagttcattatattcattatacataatttgcacaccagtccttaattatataggtttttttgcaaatattttccccacactgtggtttattttttatattttaacagggtctttcaaatagaatgttttaatttttatttatcagtgtttttcctgaccagtttgtattttttatgccatataaaatatctttgtgtaaaagatgtcacaaatattttctcctccattttctttgataatttttgtagttacatattttacatttaggtctatgattcattttaagttggttgagtctttttctgcatatgcatatgtaattgaacatttttttaaataccatattttctccttttaattgccttagtgccttcatgagaaatcaactgaccttatatttgcgagtctgtatccagacactctagtctattatttcctttgtctatatttatgtccttttgcaaacaccaaattgtcttcattgcataacattagaataactacagaaatcagagccgggtgcagtggcttatgcctggaattccagcactttggaaggctaaggcgggcggatcacctgaggtcaggagttcgagaccagcctggccaatatggtgaaatcccatctttaataaaaatacaaataatagccggctgtggtggtgcatgcctgtaaccacagctacttgggtggctgaggcaggagaatcacttaaacccgggaggcagaggttgcagtgagccaagatcagccattgcacctcagcctgggcaacaagagtgaaactccatctcaaaaaaaaaaaaaaaaaaaaagaaagaaagaaaaagaaaggaaaaaaaaagaaatcagttaatgtgagtcctccttagttgtttcactttctcattttttttttaattccattctagatcccttgcttttccatataacctttagaatagctggatcatatttgagattgcattgaatgtataattcagtttggaggataattgacaatctaacaatattgagtcttcccaaatatcggtctattatatagctccatttatttaggccttttaaatttatctcttttatgttttgcatttttaagcccacatattttgtatatattttcttcgctttaatttttgtttgtattttaaactgtactttttccctcatttgatcatgaattgttatttctaatataaagaaacataatggaatactttttgtatcctatgaccttggtatactcactagttttagcagcttttctgtaaagtgtttgggattttctatatacgccaccatgtctactgtgaataaagaaaattttatgtttgctcctttccaatctatatgccccaattttttatttattcatttatttatttatttttgtagagttattacattgattaggacctctaggtgaatgtggtaaaagcaagcctccctgctttcttcccagtcttaggggaaaaacgttcagtcttttcccagtaagtatgttacctgcaggcttttgtagatactgtttatcaggttgaagaagttcttttctattaccagtttgctagggtttttattataagtgactattgaattctgttaaatcatttttatcatgcgtaaagatgagcatatactttctcttcttagtttgttgttacaataaattccttttttttttttttttttttttttggcacagtctcactctgtcgcccaggttggtgtgcagtggcatgatctcgggtcactgcaacctccgcctccggagttcaagtgattctcgtgcctcatcttcccgagcagctaggactacaggcacgtgccaccatgccgggctaattttgtattttcagtagggatgggtttttgccatgttggccagactggtctcaatctcctgaccttaaacaatctgcccatctcagcctcccaaagtgctgggattaccggcgtgacccaccatgcccagccccatggattggtttttgaatataaaatcaacactgcattccggacaaaactccacttggtatgatacactaaatgttttatatattgctggatgtgatatgtaaggatttttgtattcatattcatgaaatatattgatctgtagttttctttaacataatttctccacaaggttttctatgtactaatggtggctcataaaatgaattggaaattctttttctttattgttagcaagattgtttagaggtagtaatatttcttccttcagtgttggaaaaaattcactattgaagtcatttgaacctcaagtttacttttttgcaagaagttaaaccaataatttatttttttaaatagatataggactatttaggctgtttcttcttcagtaaatattagtttgtatctttgcatgtgtcgacttcatccaagttgttgaatttggggagcataaattggttaatagtactctcttgttatcctttttgttttgttttgttttgtttgagatggagtcttgctctcgcccagctggagtgcagtggtcagatgttggctcactgcaacttctacctcccaggttcaagcgcttctcgtgccttagccttccgagtagctgggattacaggcacccaccacaatacccggctgatttttggatttttagtagcgacggggtttcaccatgtgggccaggctggtcttgaactcctgacctcaggtgatctgcccatcttggcctcccaaaatgttgggattacaggcgtgagccaccgcgcccggcgtcttgctatcctgacatttatcattcctttctctctctttctgtcagtaatctggataacgatttattactattattgattgttacaaagaatcagctttaagtttcacttattttctctattattttaatctgttttcaagttataatttccctgtgactatgtctttgacccttgggtaatttagaagtctgttctgtaattttttgttttgtttgtttttcatgtttggggtttttaagatacatttcggctgggtgcagtggctcatgcctgtaatcccagcactttgggaggctgaggcgggtggatcacctgaggtctggagttcaggaccagtctggccaacatggtgaaaccccatctctactaaaaatacaaaattagccaaatgtggtggcgcatgcctgtagtcccagctactcgggaggctgagacaggagaatcgcttaaacccaggaggcggaggtggcagtgagccgagactgtgccattgcactccagcctgggctatggagtgagactctgtctcattaaaaaaaaaaaaaaatacattttgtaactgatttctatttttaattttataacacttttaaaattatattgtcttaaactgacataaaaatatttatgtataatatgtaaattattacaaagtgatgcttcagtacatatactgtatattaatcagaatgggataattagcatacccatcatctcaaacctttgtcattacattatgttgggaacattcaatatcccccttttagctatttgaaactataaagtatatgattattaactataatcatcctaaagtggtatagaacactagaacttattcttctcatctagcagtaatattgtatcctttgataaatctctccctctctctccctgttccctaccctttccagcctctagtgtcttctattatactttttacttttatgaggtcggctatttttagcatccatatttgagtgagaatatgtagtgtttaaggatcctgttcctggcttatgtcacttaacatagtatctattagttctatatacgttgccacaaatgacagaatttcactgtttgtttatggctaaatagtattctgttgtgtatatacaccacattttctttatccattcttctcttattggacgcctaagttgattccgtatcttggccattgtgaatagtgctgcaatagacatagagatgcagatgtctttttgatatactcatttcatctcctttgggtaaatgccaagtagtgggattgctggatcatattatagttctatttgtaatttttgaggaacctctatactcttctccactttggctgaactagtttacattcccaccaacagtgtatatgagttctgttttctccacatcctttcaagcattggttacgttttgtctttttgataatagccatcctaactggggtcagatgctatcacattgtggttttaatttgtatttccctgaggactagtggtgttgagcatttttcatttgttgcatatacatgtcttcttttgagaaacatcagttcagatcatttgcccattttttaatcaagttgttttgctgtttagatgtttgagttttttgtgtattctagatgtgaatcccttgtcagatgtagagtttgcaaatattttatctcattctgtaggttgtctttcagtctgattgtttcttttgctgtgcagaagctttttagtttgatatgataccatttgtttatttttgcttttgttgttgtacttttgaggaactttttgttactcataaaatattttccagaccagtgtcttgaagaatttatgctctttgcctccagagatcttataatttcaggtcttatatcttggtctttgttctattttgagttgagctttgtatgtggtgagaggtgggggattagttactttctgcaggagatactcagttatcccagtaccatttattgaagagcctgtcctttcctcaattagtgttttcagtacatttgtcaaaaaatcaattggctgtagatacacagattagtttttgcattctgtattttgttccattagcctatagatgtttctatgccagtaccatgctgttttggttactatggctttgtagtatatttttaaatctggtaatatgatgcttccatatttattttgttcaggatttatttggctatttgggtcttttgtggtttcatacaaattttaggattttttttctatttctgtggagtgtcgtttgtatttttatagagaaggcattcactccacagattcttttcgatagtatggccattttaacaatgttaattcttctgatacatgagtatgatgtatctttctgttcatttgtatcctcttcagttttttcatcagtgttttgcagttttccttttaaaggttttgtacctccttggataaattcacttttaggtttcctctttttttttttgtacactattataaattggactgtcttcttgatctcttttttttagtttgttgcttgtgtatagaaatgctatggattttcgtgtgtcgattttttattctgcaattttactgaattggtttatcagctctaagagtttttcagtagaatctttaggtttttctatatataggatcatgtcatctgcagacaggaacaatttcacttcattcatttgaatgtggatgccctttaattttcatttcccaattgctctggctgggacttctagttctatattgagtgcaagtggtgagtgttagcatctttgtcttttttccagttctgagaggaaaagattttagcttttgcttctttggtgtgatgttaattgtgtgtttgtaatatgtgccttttattattttgaggtaatttccttctacacctattttattgagatttttaatataatggcatattacattgtattaaatgttttttctgaatctatcaaaatgattgtatttttgtctttaattatattgatttaatgtatgatgtttattgatttgtgtatattaaaccatcctcacattcctggcataaatgccacttgattatgttgtattatctttgtgatctgtgctggatttagcttgctagtattttcttgaagattttgcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagttatgtgtctaagaatttatccacatcctctaggttttcaactaggttttcagttggtgtatagttgttcatagtagtctctagtgatcctttgtattatgtggtatttgttatgatgcctcctttttcatttatgatttttatttgggttttctttctcactttattgctagttagcccatattgtatgatttcaatcattttaattcttttcaaattcattttttgtctcagaatatggtctatgttgttaaatatttcatgtgtacctgaaagtatatttttctgttcctgcatattctataaatatcaaataaatggatacaataatactttcctgataatatattttgaatgattcaggaaaacttaagaaacgtaagggttaattatgccactaattaaaaaattcagaaactttatgacaactttcatctctcatagccactttgactgcacagtggctttgttctcaaagccttgaaattgagttattgggatgtagtagaagcagtttgaagaacaggcagtaagcccaccttctccattagtatgttctatttactttgacatggagattttgcagtagtttgacacaaatctgaatagaaacctatttaatttcagacttctttacccactcttagaatttttcttttgatagcagataaggattaagtaatatacacaggagacagtctaagaagcatatttatttaaatataactttgttataacatcaattgcgtgtaaccaatctcatgccaaaaacaaatgcaaaaattctgttgcttaggattttactttatgtgttttaagtatatattgaaatgtacttcagaacatgtgctttttaaaatttatccaactttggtaattttggtttttgaacatcccgtagatacctaaaggactcctttggagcagcagtgctatatggatcacacttcaaaagtgtaattctggggcagcaatatgaaggtcaaaacatctccctccaactaggaactggatatttaaaagaggttaaggaaatttgatgcactgtattaaaaattgtttcaacctttttttaaactttagtgtaagtactacaacattttactaagcaaatttggagttctaatttaaccgttttttcatgttctttatcttagattctgaggacaaaaagcaatgaacacagctttttagtagctatttcctttcaaactctctggagagcaatcaaattttgtaatctgtaaaagaacatacattaatgttttgttcaaagagaattcaatctataataggccttttaaagaaatatgtataaaggcccgctgtctgtcctttttgatattttagtgtatgtatttgttcagtgtagttttgtttctttttaagaagctaatattttaggaagaaccagatactactaggccaagtacattctttttgtgtaactagaaatttcaggtcttttagttttccccaggcaacatctgctaagaacatagcattagttacatactgcttggacca

SEQ ID NO: 575 - DNA, 5158 bp, Homo sapiens
agcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttac

SEQ ID NO: 576 - DNA, 11093 bp, Homo sapiens
ataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttac

SEQ ID NO: 577 - DNA, 4451 bp, Homo sapiens
acatcatatctttagatgatgtttcacctcaattagaatcaatactgaactatccccacaattgttttgaagtgagacggttccagtagcaccccattaatatttcttcatactcttactggtatttcactttcttattacaattgctttaggaatctatcacagtgttaacaggttactacaaatgcaatggcttaaaatgatacaaacacatttttatggattgctgtgtattccctcaaaattcatatgttgaaattctaatccccagtaactcagactataacattatttggaaatagggttgttgcagagtaattcgttaagagaccacactggagtagatgggccactaattcaacatgattaatgcccttataaatagaagaaatttggacacagccatgaacacagaatactgtgtgaacatgaaggtagaggtcagagagatacagcagaagccaagaaacaatggatgttggcaaaccatgaaaagtagggtgaggggcatagaatgcattctcccacacagccctcagttggaaccagccctgccagcacttgatcttagactcccagcctctggagtggggagacacattttgctgtctcgtttgtggtgctttgttacagaatcccaagcaaactaccacacgcagcacatcacaccttccgtggccagaatgcaggactcctggcacaggttagcaggtcctttgctcagtctcatgaggctccaatctgttagttgggctacattctcatgtcatctggggcagaatctgtgttggcagaactcacttcctcgtggttgtgttactgaaggccacctggaggccacccacagttcccttccatgaggccctctccataataaataaaaatcagaaaaatgttatctccacaacatagtggtttgctttctcacaatcagcaggggaatctttctccctccatctagtaagacagagtctaatatgaggtagcttcatcatgggagggacatttcatcacctttgctgtattctgctgattagaagcaggtcacaggttctgctctcactgaagaaaagggatgacatgagggcgtgactcctcagggttacattagtgtgtggtcatctcaacaaccatccactgcacactgccctcgacttactctcatgaatcaggaagataattcccaccataaaaaaaaatgtactgtagtatggagattttgcaaaaagctaaaaatagaactaccatttgatccagcaatcccactactgggtatttaccaaaaggaaaagaaatcattatttcaaaaaggcacctgcactcatatgtttatcacagctctactcaaaagagcaaaaacacgagatcaacctaaaagtgcatcggtggattaaaaaatgtggtatatatacaccatggataatatggtttggctgtgtgtccccattcaaatcacatctctaattgtaagccccacatgtccagggagggacctggtgggaggtgattggaccatgagggtggtttcccccatgctgttctcatgatagtgagggggttctcacgagatctgatggtttaaaagtatgacacttcccctttgctctctcttcctcccgccaccttctgaagaaggtgctttcttctcctttgccttccaacatgatagtgagtttcatgaggcctccccagccatgtgaaactgtgagtcagaaaccctcttttatttgtaaattatccaatctcaggtagtacctctataacagtgtggaaatggactaatacaatggaataatactcagccataaaaagagtgaaatcatgtctttttcagcaatgtggatggaacttgaggccattatcctaagtgaaataactcagaaacataaaagcaaatagcacatattctcacttatgagtgggagctaacaatgggtacccatggatagacagagtggaataacatgctggagactccgaaaggtaggagagtgggaggagagtgagtattgaagattacctattgagtacaatggtacaaagaagtatacaactaaaaagcattcctatgtctcaagactccaagaaagaaaatggctacaatcttcttctaattttcaatttcatttttctctctttgtcattattggaaaaagcatgttattattatgttattgtgtatattactatgtattatatatatattatacctatataatacatactagatattagatgaatatataatttcttatagttattacttctccttcctttattttttaagccagctattagatttattcatcaattccacttatatctttattcaggctttctcagtacattcatatttatttagctgtcttttctctaacatcttaagctgtgtgttttattaatttatttttattatttcatttttaataaaactacaagtttgtttctgtatttacctctgttacccataaattttgataataatgttgtaattaatatttttagatattacacttcttgataaaatatttatttggtctaatgactaaaaaattctcagtagctattttcttttaaatttgattattttagattagttgcactgtggtaaaagataatgaagtctgcttctgggaattttagtgttcctagtgacctagcatataatcaatatttgagaatctttatgaatatttgaagataaagttaattttagcttatagggacaaagttaaagacatctttcacaaattgatctcattagtaatattcagacacaattctattaagctgtgctgaatggatgctaagctatttcaaaattgagattgaaataaacttcgtttcagtgaatgcttttcttacttacattcaactgtgtattgttattgccactcctgtttctgtgtgcctgacttaactttgatgtatgcttttatatgtgaccattatcaatattttgcttatgtatggcccttgttaatggtatagagttaaaagctgctttttggatagataaagcagtcttcgactttcagtaattctcttaatgcactgaaacttcaggcacatttgggtcttatgaggattttaagatttttgttcttcaatgtttcctttaaactccacattgttggttttccctagtgatctgcagagcatatatcctgtttaccaaatattttgccttttatgggaacatatttgaaaccaaatttcattaattatcaatgtcatactttaacaatattaataattacaaatgtaatgaggatttctaaattttctaatttttatcatttatcatcatgcttatgctaagtcaattttatcagtagaattttgacttatttgattatggcacaaacaaatggacaattacaaaatttgctgaaataagtagattggtaacaaggacttgtgaatgttgtttaattgcacctgcaatgcctaaagtattatgcgaacactcttgatcctactgattagctgatatgaaaaattagcttaaattgatgttaaaatgtcaagattgttgcatttgtaattcattagcataagattctaaaagggaaggtcatcagctaaagacagttctcatgtttactaaaaggcacatatctaacgggaaaatactaagaggaacatatctgatgggaaaataccaagaggcacttattttatggtaaaataaagttctagtattaagaaaccattttcttaaattaagcaacttggtgaagccctgctaatgaattacctaatcctgatatagaaaaatttttctttcttatgtgatagaatagattgtaaataaatgcagaatgctgtatttggaagataacttatccttagaacttatgagagggttattttcaagggaatgctttgtactctatgtaaagtcaacatcatcagtagagtttgattaatcatctatatcactgaacactcattctgttttgtatcatttcagggctattatttgccctttttcctactgtaatgttctcaccttgatttcaacaagtttttcacacaagatattaggtactaacagacccaaggagagtgggagatgtccttatggtgttctattaaaaatagcaaaaactgtcaaagacaaacctgagatcactgttgcaatgtaattgcttcattaaagctttataggagttgcagaaatcttacttctttagtaatacttcgaaggcattttataagttaagcatgaaaatactacagtgtcatgaaatacgatggtaataaaattagtctcttatgaaagaaattaaactttcattagttcacaaacataagcacaatttatttgaaagaaagtcatgagcaaacctaaatatatttacatttgtacataaaatatactgtatttacaattacttgatgctctaaagacagaacttaatgtgacgtatgcagctggaaattac

SEQ ID NO: 578 - DNA, 1611 bp, Homo sapiens
tcgtttcagtgaatgcttttcttacttacattcaactgtgtattgttattgccactcctgtttctgtgtgcctgacttaactttgatgtatgcttttatatgtgaccattatcaatattttgcttatgtatggcccttgttaatggtatagagttaaaagctgctttttggatagataaagcagtcttcgactttcagtaattctcttaatgcactgaaacttcaggcacatttgggtcttatgaggattttaagatttttgttcttcaatgtttcctttaaactccacattgttggttttccctagtgatctgcagagcatatatcctgtttaccaaatattttgccttttatgggaacatatttgaaaccaaatttcattaattatcaatgtcatactttaacaatattaataattacaaatgtaatgaggatttctaaattttctaatttttatcatttatcatcatgcttatgctaagtcaattttatcagtagaattttgacttatttgattatggcacaaacaaatggacaattacaaaatttgctgaaataagtagattggtaacaaggacttgtgaatgttgtttaattgcacctgcaatgcctaaagtattatgcgaacactcttgatcctactgattagctgatatgaaaaattagcttaaattgatgttaaaatgtcaagattgttgcatttgtaattcattagcataagattctaaaagggaaggtcatcagctaaagacagttctcatgtttactaaaaggcacatatctaacgggaaaatactaagaggaacatatctgatgggaaaataccaagaggcacttattttatggtaaaataaagttctagtattaagaaaccattttcttaaattaagcaacttggtgaagccctgctaatgaattacctaatcctgatatagaaaaatttttctttcttatgtgatagaatagattgtaaataaatgcagaatgctgtatttggaagataacttatccttagaacttatgagagggttattttcaagggaatgctttgtactctatgtaaagtcaacatcatcagtagagtttgattaatcatctatatcactgaacactcattctgttttgtatcatttcagggctattatttgccctttttcctactgtaatgttctcaccttgatttcaacaagtttttcacacaagatattaggtactaacagacccaaggagagtgggagatgtccttatggtgttctattaaaaatagcaaaaactgtcaaagacaaacctgagatcactgttgcaatgtaattgcttcattaaagctttataggagttgcagaaatcttacttctttagtaatacttcgaaggcattttataagttaagcatgaaaatactacagtgtcatgaaatacgatggtaataaaattagtctcttatgaaagaaattaaactttcattagttcacaaacataagcacaatttatttgaaagaaagtcatgagcaaacctaaatatatttacatttgtacataaaatatactgtatttacaattacttgatgctctaaagacagaacttaatgtgacgtatgcagctggaaattac

SEQ ID NO: 579 - DNA, 1748 bp, Homo sapiens
gtcaacatggtgatagagatgaatagagttggtaggaaataggaaacaaaggtgaaacacacatagatggacaaatgcaggtggaaggataaatccaagaacaagaataacatgggaagaaatgggaaatctcaggaagagttaaagggaaaatagcagcgagagttgtgaaagcagaagaaattattctggagggctgcttactgcttgaaatgccttttgtttccactcgttcttcacaggatttggggaagctctcaacattttaaatgtacgtagagaagtgcttctgatatcacctgctaacaaccagataaccagatcacacctggacaatttctgggagcagggggttctctgtcccactgtctatgtttgcaaagccccgtttttcactcgcttgtgaccatttgctgaaggagatcaagttgcaaggtcacatgttactggccttctattaatacaataatctttccattttttttcaacacgcagctctagcaaccaggaataggtataataattcacatttaattaaagtcaaagaaaagagagcacaagaatttgtccacaggtcaagttcctttaggtggttaccctaaagacaaattacacctgttggtccttgtgagaagagacacccattttaagcaacaagaagcctgtgccatttgggactaactgggcttggagtccacattagattacattgtttcaagttccttaggcatcattagcaccatccatagttctggagctataaagaacacatttttaataaactagtgtgaaggttttatttataatagtatataaatattagaaattaaaaactatacatttgctattataattctattagtattcagtcttcaggactaccagtattaatagatagacctttccctctctttatgtcaaaatattcctggaagaaatttaatagagaaactattttagggaggagggtgagtatatttattaattttctattgctatataacaaattaccgccaattcaattgctgtaaacaatactcctttattatctcaattggtttaggagtacaggcatggctctgttgcatcctctgctaagcgtctcaccaggctgaaatcaaattgttggccaggctgaattcccatctagagtaagggtcctcttccaaactctttcaagttgtcagaattcaggactttgcagctggagaactgcagccctcagctgctgctggacacatttctccataggcatctcatggcatactctgtttcttcttccagcctcttttaaagagcccatctggttaggccaggcccacacaagatgatctcccttttgattgactcaaagtcaattaacagaccttcactaaatatgaaaaaaatctctccatctttgcagtagtgtaagtaatcacaaacactgagtctaagcaacatgagtgacatgagtgatgcccatcatatgcagaggccccgtccacattccagggcagggtcattgtatgggtattagggggtcatcttggaatttctcctatcaccttgagtttgggattagtaattgaggcagattgcttggctttatttgtatatccaagcaaaatattattattattttaattagcatgccatgtaatatttaataaaaacgttaaacatgaaaaaactatgttttatttagggatatatgacacccttattagaaacagaaataagtatttagaaatttaaaatagcaattt

SEQ ID NO: 580 - DNA, 1590 bp, Homo sapiens
cagcactcgttaactgaaacgtaaaggaaataatggcaaattgactgtcttgaatcaagtataaaggagaatgcctgaaataattagatgtcatgaatttggaaagagaaacttcttgcagattgcttccttcagataaccttggactcaggagttttgtattgttcacttaacataagtgactatgattgagttataagttctctagggaaagcagcacactgaaatgggttatatcatgagtttagcctggatgaaagtgtttactccgaaattccaagtggcattggtgtggctattggggcagcttgctgtgctgaggagcatggacctgagcgtcagagatttggctcctggtcctgccatacccatcacggcagcaaaagtgactaccccatgggcgctgtgcagccttcttacactttgccatgttagactggcatgccgctcctattttatataaaatgtaactgaatattaacttgcccaagcataaaccaagcccagtttcaggtccagatttgtctcattccaaagtgtttagttaacactctgctaccctttgttagatgtggacaaattacattatttcccctggacttagatttcttaattcgatgacctggaaggccttctctagtagaaatggtccatgagtccttgggaaactgagaactaactctgagctattacctgccatttattctatgtggcccatcatttgctacgcactctcctacttcttcaatgcacctgttccacacccttggaactcacttgctcttataaaccctagtcatttctccatttggagcactgttgctccccttttcgaggtctgaatgtctcccctccaaaattcagatgttgccaatgcgatagtattaagaggtggggcctttaagacatgattaggccacagaagctcctcttttgtggatgagattaaggcccttataaaagaggcttcctgcagcattggattcacttgctttccaccttctgcaacctgaggatacagcattccttccctccagaagacacagcaacaaggcaccaccttggaatcagacagcatccctcatcagacaaccaaacctaccagccctttgatctcagacttccagaactgtgagacataaatttctgtcctgtagaaattgcccaggcttggccagatgcagtggctcacacctgtaatcccagcactttgggaggcagaggcaggcggatcataaggtcaggagttcaagaccagcctgaccaatatggtgaaaccctgtctctactaaaaatacaaaaattagctgggtgcagtgacatgtgcctgtagtcccagctactcgggaggctgaggcaggagaatcactcaaacccgggaggcagaggttgcagtgagccgagatcacaccactgcactccagcctgggcgacacagcaaggctccgtctcaaaaaaaaaaaaaaaaaaattgcccagactcataatctgttatagcagcacagatagacaaagacacccttcgatgattttcctgctgcaacggagctccacttcagtcaatatagaaagcagactttctaaaagtca

SEQ ID NO: 581 - DNA, 6234 bp, Homo sapiens
tggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttt

SEQ ID NO: 582 - DNA, 9538 bp, Homo sapiens
tggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttttctttcatctttaggttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgcatttacacacctcggtgaggaaactgccagcatcaggacaccccagtgaggctctccctcagcaaaagttcatctttcttcccatagttggcactattctgaattttgatcattattgtcttaatttttttactacccatgtttgtactcctaaacaatataaattagcttggtctgggttttgttgttttttttttttaactcttctttttttattacgtttcttattttatttctttaattttatttattttattaatttatttttctgagacagagtttcactcttgttgcacaggctggagtgcaatggcgcaatctcagctcactgcaacctccacctcctgggttcaagcgattctcctgcctcagcctcccaagtagctgagattacaggtgcccgccaccacgcccagctgatctttgtctttttagtagagacggggtttcaccatgttggccaggctggtcttgaactcctgacctcaggtgatccacctgcctcggcctcccacagtgctgggattacaggtgtgagccaccatgccaggccatattttttattttttattttactttttttttttttgagatggagtctcgctctgttgcccaggtagagtgcagtggcatgatctcggttcactgcagcctccacctcccgggttcaagtgattctcctgccttagcctccctagtagcggggactgcaggcctgcaccaccacacctgggtaatttttgtatttttagtagagacgaagtttcaccatgttggccaggtggtctcgaactcctggcctcaagcgatccacccaccttggcctcccgaaatgctggaattacagacatgagcctccacatctggcccatagtttgttttttctaacattgagagacatttgagttatctcacatttttcctgttacatcaatactagcatgagcattgttacatgtgtctgttggtagacctgtgcatttctgttaggtatgtatctagcagtggtagagggaatcaggtcgatgcatcttcacttttgctatgtaaaacaaaactttgccggagagattttatccccttgttcatagaaatggattagaatttcagcactctgcatcttctaatacttggtatcagacttttaaatttctgccagttgaatatgtgtgcaatagtatctctttgtcttaataattgtatttctaattacaaataagcttgagcccctttttgtgtttattggctatttcacttttgataataggtgatattagggaataatttaagtggaatgttattttagaaatccatactgaaatacttaaggatgtaatactaatttactgtaaaatatttcagcataaaaaaagtgcagacatagataacatttcactgacatcagaaaatattacctgggaatacatcaaaaagtattcaagaactctgtcaacaaaaatataaaatcttatcaagacattaaagaaagtggaggctgggtgagttggctcatgcctgtaatcccagcactttgggaggccaaggcaggcagatcacctgaggtcaggagtttgagaccaacctgcccaacatggtgaaaccctactaaaaataacaaaaactagccgggtgtggtaggtgcctgcaatcccagctactccggaggctgaggcaggagaatcgcttgaacccggtaagcaaaggttgcagtgagccaagatcgcgccattgcactacagcctgggtgacaagagcaagactccatctcaaaaaaaaaaaaaaaacgtggagacaaaaatgaatagaaatactatcttcacaatttgaaagtctcagtattctaaacatatagcctgactgaaagaaatgttctgtcccgctgggcgtgttgcctcacgcctgtaatcctagcacttttggaggccaaggcggacggatcacctgaggtcgggagttcgagaccagcctgaccaacacagagaaaccccatctctactaaaaacacaaaattaaccacgcctggtggcgcatccctgtaatcccagctagtccggaggctgaggcaggagaatcacttcaacccaagaggcagaggttgtggtgagccaagatagcgctattgcactccagcctggggaacaagagtgaaactctgtctcaaaagaaataaattttctgtccataaatttgtgtggctttccttttttgcatataaacttcttttctggactatttaacttttgtgattaaggagccaactaaagtcttactggacctaccataaattctttcccatgtgaatgaatac

SEQ ID NO: 583 - DNA, 6327 bp, Homo sapiens
aaaagaaggcaaaactatcatcattttgacatttctgaagttttcttagcaatggactcataaaatacaatatagccatttttaagggaaatttggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttt

SEQ ID NO: 584 - DNA, 9631 bp, Homo sapiens
aaaagaaggcaaaactatcatcattttgacatttctgaagttttcttagcaatggactcataaaatacaatatagccatttttaagggaaatttggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttttctttcatctttaggttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgcatttacacacctcggtgaggaaactgccagcatcaggacaccccagtgaggctctccctcagcaaaagttcatctttcttcccatagttggcactattctgaattttgatcattattgtcttaatttttttactacccatgtttgtactcctaaacaatataaattagcttggtctgggttttgttgttttttttttttaactcttctttttttattacgtttcttattttatttctttaattttatttattttattaatttatttttctgagacagagtttcactcttgttgcacaggctggagtgcaatggcgcaatctcagctcactgcaacctccacctcctgggttcaagcgattctcctgcctcagcctcccaagtagctgagattacaggtgcccgccaccacgcccagctgatctttgtctttttagtagagacggggtttcaccatgttggccaggctggtcttgaactcctgacctcaggtgatccacctgcctcggcctcccacagtgctgggattacaggtgtgagccaccatgccaggccatattttttattttttattttactttttttttttttgagatggagtctcgctctgttgcccaggtagagtgcagtggcatgatctcggttcactgcagcctccacctcccgggttcaagtgattctcctgccttagcctccctagtagcggggactgcaggcctgcaccaccacacctgggtaatttttgtatttttagtagagacgaagtttcaccatgttggccaggtggtctcgaactcctggcctcaagcgatccacccaccttggcctcccgaaatgctggaattacagacatgagcctccacatctggcccatagtttgttttttctaacattgagagacatttgagttatctcacatttttcctgttacatcaatactagcatgagcattgttacatgtgtctgttggtagacctgtgcatttctgttaggtatgtatctagcagtggtagagggaatcaggtcgatgcatcttcacttttgctatgtaaaacaaaactttgccggagagattttatccccttgttcatagaaatggattagaatttcagcactctgcatcttctaatacttggtatcagacttttaaatttctgccagttgaatatgtgtgcaatagtatctctttgtcttaataattgtatttctaattacaaataagcttgagcccctttttgtgtttattggctatttcacttttgataataggtgatattagggaataatttaagtggaatgttattttagaaatccatactgaaatacttaaggatgtaatactaatttactgtaaaatatttcagcataaaaaaagtgcagacatagataacatttcactgacatcagaaaatattacctgggaatacatcaaaaagtattcaagaactctgtcaacaaaaatataaaatcttatcaagacattaaagaaagtggaggctgggtgagttggctcatgcctgtaatcccagcactttgggaggccaaggcaggcagatcacctgaggtcaggagtttgagaccaacctgcccaacatggtgaaaccctactaaaaataacaaaaactagccgggtgtggtaggtgcctgcaatcccagctactccggaggctgaggcaggagaatcgcttgaacccggtaagcaaaggttgcagtgagccaagatcgcgccattgcactacagcctgggtgacaagagcaagactccatctcaaaaaaaaaaaaaaaacgtggagacaaaaatgaatagaaatactatcttcacaatttgaaagtctcagtattctaaacatatagcctgactgaaagaaatgttctgtcccgctgggcgtgttgcctcacgcctgtaatcctagcacttttggaggccaaggcggacggatcacctgaggtcgggagttcgagaccagcctgaccaacacagagaaaccccatctctactaaaaacacaaaattaaccacgcctggtggcgcatccctgtaatcccagctagtccggaggctgaggcaggagaatcacttcaacccaagaggcagaggttgtggtgagccaagatagcgctattgcactccagcctggggaacaagagtgaaactctgtctcaaaagaaataaattttctgtccataaatttgtgtggctttccttttttgcatataaacttcttttctggactatttaacttttgtgattaaggagccaactaaagtcttactggacctaccataaattctttcccatgtgaatgaatac

SEQ ID NO: 585 - DNA, 5728 bp, Homo sapiens
tttacagacaccaaaatcttaaggactactattaagcagatgcagtaatatgtcttaccatattattttattttctcatctgctatgcaaagaagataatagtactttttgagtagcagagatagaattttgcaaagcatgaagacattctttgaatttttgtttctatattattagatattacattattgaaaatgtcattactgaaggctgtcttattaaaaagatgtatagtaaacctcactcttgagagaaatgggattgctgataattaaaggtttcttaggttattttcagtaccttttttggataataagatcttcagtagattcaaaacatactaaaatatgaaggttcttgggatctcaagtcatgttattcactcaggaatatagtaataaagagaaaaataatattgtctttattttcattcattgagaaaatgctataatatccagtgtggaaggttaattagcccccagatccctgagcccttttaagcagaaacaaaaatgtactagtatttcacagataaaattgtatttcttcttttggcatgtagttctgattttaggggagagctttgtaaagataagtgagctagaccccatttcaaaacagcactttgtggtttttttttttttttcaaagcgagcaaaaatacttttgaagtgtggttctgaaccactctctctgtacctttgtatctcccaggaagttgaaaaataaggtagtaaacatttttttctttttgttctgtaagaaatagacaatttttgctatgccttcctcttctggtctaagggaaggtttatgccctttttcccagcctcagatttactcagtatgtcatgagctgactctgtgaggaaagatgacttataaaactgttggcttgacagagtttagaaaggaatacatgtaaaaacagaaagctttcccagagtgatatttcatttctgaaatgcagtttttggcctttcactattctagaggtgactgattaaaatatttgtttttgttcttttcatctataagcaattttagaactattccacaataaaacatgttctggctttttctttgcagataagttttgtaaaccttcattgtaaatgtgtctttagtcttctgtgaattaatattttgatagacctctactggaccaccatagtgtggtaagatggctagatctccacccaaaatacatatttcctttgccttcttagagtttgggctagctgacagagactgcatttcccaaatctccttgcatgtcagtggagcttgtgactgggttccgccagcagaaataagggtagaagtgatgagtgccatttatagtcctggtccataaaatccacctgtgctgttcttcacattctcccttccctaactgtcttttgtgtattgacactttgctgctagcattaccacaatacctattagtatattttaattaatataattaatatatagctaagagtttgttagtggttttagctagcttctccagtttgtattctcaactaaagtttattactatttcaacttaagtttttcgggggtgggtggataagtagtgttaagaggtagtgtagatgatttaaatgagatacaaagatttttaaaaatcattagtggatttagtgaattaaataaagctaatctatacttagagtttataaatttagctgccacatatgaaatatcttccaaagatctgagattcttaaacacaaggaacatttcacatatctttgttttagagaatttgacaaatgaagttagaattaagatcgtatatcaccttggatagatgagcaaattgaattatgaatttgcacaattaggaatataattttcctataatgaaacaatctgtaggtgagttaagagcaaatcagtggatttgatcttatattacctcatttaaattgttatggtatctaataggtatctctcttgtcttttcagtagcctttgaggaccagttgcctaaaattaaaaagagtatatctgtcaatatatgtgtgtgtgtgtgtgcatgtgtgtatctttaattctttaattaaggtacacttaaactgtaaaatgcacagatctcaggtatactacttaatgagctttgacaaatgtctatgtctgtgtaactaatatactaatcaaaatataggacaattccattaccctaaaaagttttttcatgcccctttccagtcaatatgccaattacctatacttttaattataaattttctgtgatcagtgtaaagttatattccaaaaggtagttagaacccaaaatgttatgcttatttacaccatcaaggaattcagtaaattctaatattaggtgatgtatttttaaatagaaaacataactttaaaaatatttataaaatgaaaattgtgaacatgcatcaaagatcttttacttaggtggtgttaacaatatttaaattgtccaatgcctaaactcagttatttgtggagtatccgttctctttcttttaatttatgttctacatcagccagtttgcgcacattaatctctcactggattctttagtaactgtttattttctgttcatttgtccacttttttctcaaccatgctccttcaacacatctcctaactacctcttccctgtcaccccaaatcagcttgatttcatactactgaatgatagaaatagcctttcatctagactattccagcatctagaaatagcctttcacctagactattccagcatcttggtattgagtaggtaataaatatatttttattgaatgtgttagtgaattttaagttgaattggataacattatggttctatggttataacttatattgcctatatttgccaggctctatgataaacattttccattaaacattcatgttaattagatattcttgcctctatttaattggtgaaaatattaaaatttatagaaagtttatgtaaattgcccagtgtcacatagctagtatgaaactggttggtcagacaccaaagtctttgtgataagtcctgcaaattgacatgcgaattttgttagaatattttaaaacttaggacaagtttaaaccatcctatttttcatctttttataatattttagacaacataatttgcaaaagctactttgtttattatatacaagatcatatgcaagaaacaaagccttctaccttaaggaatgatgccagaaaaatagctaatgtgtttttgttttttgagacagtgtctcgcttttttgcccaggctggaatgcagtggtgcagtgttggctcactgcagccttgacctcctgggctcaagtgatcctccccacctcagcctcccgagtagctgggactacagatgcgcactaccaggcctgggtaatttttgtactttttgtagaggtgggatttcaccatgctgcccaggctggccttaaactcctgagcttgcccgcttctgcctcctaaagtgctgggattaaaaatagctactgtttgcctgtaatcccagcactttgggaggctaaggtgggcagatcaccagtggtcgggagttcaagaccagactgaccaacatggagaaactctgtctctactaaaaatacaaaattagctgggcatggtggcgcatgcctgtaatcccagctaactcaggaggctgaggcaggagaatcacttgcagccgggaggcggaggttgcggtgagtcaagatcgcaccattgcactccagcctgggcaacaagtgtgtccctaactctgtctcaaaaaaaagctcctgtttattgaatcattgatatttactgacttgacactttacgtacatactttttaacttttttctagaataaaaataattctgattacactgtaatacacaaacgcattcttataaaaatgcaagctgtaatttttaaattgaggataagtccacacagcattaattcattatataaaatgattaattgagtgcatttaatgcattcagaatgttgtgcaactcccacctctttctagtttctgggttgtttccacttttagttattatgaataatgcttctgtgaacatttgtatgcaaacatttctcttgtgtgtattcctagaattggaattagtgggttttatggtaattcagtgtttctttttttttttttcgaggaactgcaatactattttccacaatggctaaaacattttacattcctaccaacaattgtccaggtttcctatgcctccacatcattgccaacacttgttattttttggttttcttcattatagccatcctactatgtgttaagtggtatttcattacggttttgatttgcatttctgtaatggccaatgatgttgaacatattttcatgtgcttttttggccctttgtagatctttagagaaagaaatatatatttaagtcttttgcctgttttttaatttcattgtctttattgttgagttgtaagaatttttatgtattttggatactaatccctcatcagatatatgatttgcaaatattttctctcattctatagttgtctttttatttgcttgttattttactttgatgcacgaaagttaagttttatgaagtccaatctgtttttttatttggttgaacaagttgtaattttaatgtatgtgtaaataaatttaaaaaataggactattatttctatatgttattctactccttgtttttttcacttaaacataggtcttggagatctttttatgttggtacataaggattgtccccattcattaattaataaattactgcatactatagattatatgttctgtaacttattttaccattcctctagggacctagggagaaggatttttgggttgttgcctattttaggaaatagcaaatagtgaatatctgtaggatagaattctaagagtatttctctgtaggatagattcctaaaagtcaagtttctcggtgaagtgtataaatctttttttttttttttttttgaggcaaggtcctgctccctcacccaggctggagcgtggtggtgatctcagctcactgcaacctctgcctcctggttcaagtgattctcatgcctcagcctcccaagtagctgggattataggcatgtgccaccacacccagctaatttttgtatttttagtagaagcagggtttcaccatgttggccaggctggtctcggactcctgacctcaagtgatccacccacctaaacctcccaaagtgctgggattataggtgtgaaccactgcgccaagccagatgtgtctatttcttttaatctgctagttttaccttcatatattttgaagctccgttattagggtcacaaacctttgtgattgttatatcttcctgatgaattgaccatttttttactatgaagtgtcccttgtagacagctcttttattcattctgacaatctctgatatttaattggaatatttagttcatttacatttaatgtaattcttatgtatggatttggatacaaatctgttcattcagaaacagtctgatttgccttttgggttgatatgatattttttagaattttattttaatttttctattgactttttatctatacttctttgctttttatttttagtggttgctctaatgataaaatatacattctcaacttcttgcaatgtacctaataatgtactgcttcagataaaatatgtttcttgtaaata

SEQ ID NO: 586 - DNA, 1872 bp, Homo sapiens
ctagaataaaaataattctgattacactgtaatacacaaacgcattcttataaaaatgcaagctgtaatttttaaattgaggataagtccacacagcattaattcattatataaaatgattaattgagtgcatttaatgcattcagaatgttgtgcaactcccacctctttctagtttctgggttgtttccacttttagttattatgaataatgcttctgtgaacatttgtatgcaaacatttctcttgtgtgtattcctagaattggaattagtgggttttatggtaattcagtgtttctttttttttttttcgaggaactgcaatactattttccacaatggctaaaacattttacattcctaccaacaattgtccaggtttcctatgcctccacatcattgccaacacttgttattttttggttttcttcattatagccatcctactatgtgttaagtggtatttcattacggttttgatttgcatttctgtaatggccaatgatgttgaacatattttcatgtgcttttttggccctttgtagatctttagagaaagaaatatatatttaagtcttttgcctgttttttaatttcattgtctttattgttgagttgtaagaatttttatgtattttggatactaatccctcatcagatatatgatttgcaaatattttctctcattctatagttgtctttttatttgcttgttattttactttgatgcacgaaagttaagttttatgaagtccaatctgtttttttatttggttgaacaagttgtaattttaatgtatgtgtaaataaatttaaaaaataggactattatttctatatgttattctactccttgtttttttcacttaaacataggtcttggagatctttttatgttggtacataaggattgtccccattcattaattaataaattactgcatactatagattatatgttctgtaacttattttaccattcctctagggacctagggagaaggatttttgggttgttgcctattttaggaaatagcaaatagtgaatatctgtaggatagaattctaagagtatttctctgtaggatagattcctaaaagtcaagtttctcggtgaagtgtataaatctttttttttttttttttttgaggcaaggtcctgctccctcacccaggctggagcgtggtggtgatctcagctcactgcaacctctgcctcctggttcaagtgattctcatgcctcagcctcccaagtagctgggattataggcatgtgccaccacacccagctaatttttgtatttttagtagaagcagggtttcaccatgttggccaggctggtctcggactcctgacctcaagtgatccacccacctaaacctcccaaagtgctgggattataggtgtgaaccactgcgccaagccagatgtgtctatttcttttaatctgctagttttaccttcatatattttgaagctccgttattagggtcacaaacctttgtgattgttatatcttcctgatgaattgaccatttttttactatgaagtgtcccttgtagacagctcttttattcattctgacaatctctgatatttaattggaatatttagttcatttacatttaatgtaattcttatgtatggatttggatacaaatctgttcattcagaaacagtctgatttgccttttgggttgatatgatattttttagaattttattttaatttttctattgactttttatctatacttctttgctttttatttttagtggttgctctaatgataaaatatacattctcaacttcttgcaatgtacctaataatgtactgcttcagataaaatatgtttcttgtaaata

SEQ ID NO: 587 - DNA, 3511 bp, Homo sapiens
tccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctaattttttttatagcctttgccttgttccgattcagtcattccagtttttctctaatttattcttccctttagctagtttccttctcccatcatagaggataccaggacttcttttgtcagccgttttttaccttcttgtctctagctccagtgaggcctgtagtttaaagctaaagcatgtaccaatttttgaaaagttcagggattgtgaaatgtgttttaggcataggtccaggatttttgacgggacaaatcttagtctctttcagttagcagtggtttctaaggaaaaagtgctatacttctttttgaatatactctttgtgacttttgccattatctcttaatttctcaatagtgcagtgaaaacaatttctataaagccacagtttcagcgcagtaatagattagtgttacataatataagacctaatgcttacctcaatatctacttatccgtacctatttgaaataaatcatgactgtttcatcttagaaaaatatttgattccatattcaggtatgtatgtatacaccagatgatgtgtatttaccactggataagtgtgtgtgctggctgatgacccagggttttggcgtagctcttctatgctcagtaaagatgatggtagaatgttctttggcaggtactgtggattagaattaattatcttgtataaatgctaggttcacttctcagggaatcttactctaagacataagatgtgcgtgtacatggaaaacaactctaaagaggcaagggttgtttttattgactaatagtccacacactattataactcgaatattagtgtactttagacagctttatttctaacacagtgctgtttctgacatattggaccattaacagggtaggaagtatttatggtggttttttggttctgttttgcttttggttagtttgtttttgtttttctctgaaagtgatccatgatctctaaccttgctagattataatgccagaagctctggaattctggcttatcggaggcaagctgtatcttcaaattagtttatcccctaagctatcaggttgattgaaattattataatattggtgaaattctttcatccttcatgatcctgtgtaaagcttatatctgctcattgatacagatggctaaaaggccagaaagacacacatttacccatgtaacaagcctgcacatcctgcacatgtaccttcgaaattaaaatgaaatgaaataaaattaaaaggaaaaaaatgccatggcaacatcaggaagttatcttttatggtctaaaaatgggcagcataaataatctaccccttgtttagcatactattgaaaaataacaataaaaatcggcaaccagtagcccttgcgtctactctgcctatgaagtagccattcatttattccttcaattttttataaacttgttttactaaaaaaaaaaaggacaaagaaagaaagtgcgaattgtgaaatggtagtgagtgatggcatttgaagtgggtcctttatgatttgatggagccaggcagaagacgtttggagaaagaagttcctgaaagtaggaagggcatgtggaaaactctgaggctgaggaaaaaaaagaaagaaagaaatataaagaaagaacttgacatttcactgtatataaacacattacaagcctaaagtacgttgaagaaaaaatagaattcaaagttagacagaagggctcaggcttactatttgcatcttacagatgagagtagtagagttggtattttattctgaaacacagaggacaagtggagatttgtaaacctgagataaacatggtttctaatccactgaacaccgaagcttatttttttctctttcttcatctgccttacttagtgcaaggtgctataacaaaatagcatagactgggtgacttcaacaacaggattttttctcacttttctgctggttcctggtcagggctctcttcctgggttgcaggtggctgacttcccactgtgtcctcaccagaaggaagagaaatggctaatctctctgcttctgatgaggaaaataattctatgatggggatctgctctcatgagctcctctaaacctgattacttttccaaagcctcccccacaaatggagccaattgggagttggggattcagcatgtgaattttctggagacacaagcgttaagttcataacaccatcacattaaactaaactcttgcttattaacgtgcattaactttcaattatataagaactccagtgaatctgccttctcaattaatgttatacaaattcttcacactatattttcatctgaccgtgctgttctgctgctgagacatgacacgctgatgctgacttgtgagcttctgctggctcatttccttcacctaagtccccacctccctagaagcttacaatgaggtctcctccttgaaatgctgtgaccagtctgtagacttaagggtatggga

SEQ ID NO: 588 - DNA, 1673 bp, Homo sapiens
cgtttttacatttattgctaaatctttgtattatatcagaatttttaaattagtgaatggaattatagattatagttttattcaatagaagtttctgtggtgatggaaatgttctgtgttaaactgtcgaatacagtagctactagactttaagaagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagttctgtcttattttattactatttttatcatagtgtcgcacacagtgtcattcacatgggcagctagtaaatacttgtagagtcaacaattgaattatttttgtttctgattattgttatcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaagcctcaggacttattctattaataaaataaacatcaccattaactgtgtttgaccaaggctatgcttaatatctagaatttaaaaagagaaagggaagcctccgtatacttcagtcctcagctctggcagctgcccatcggacaaaggaacaggacgatgatgctggcgtcggtgctggggagcggcccccgggtgggcctctgctctggcccctcctggggcccgcactctcgctctgggcccgctcctcttccgccactgccatggaccacgagaagatggtgcaggaacactccagggctgccatctctttcttcaatcagtcagctatgaacctgacagctgagaagccatctgtcatctcacgctgtccaggaccctctatcctagctgctgagtcttttccactcttctccactttaaactctttgtggacagaaccttctctttttgttgttttcatacccagtgcttagtacagtgccttatacattaatgtttgttggatgatctggtagaaatgacagaatatggaataaatgtgtcctgattctggtagaaatgacagaatatggaaaaaaaccgtatcttgattcaggtagacatgacagaatatggaataaatgtgtcttgattcaaaatggttgtatagctaacattttatttttacctagagatgttgtaaagtgttacataaagatgtatgtgaagcattaacacttccagccccatgacttaaaaaatatatatctatacatttaaaattttcctgagagtcagagagattaagtaacttggtcaagatcactagtaactgtcagagcttggaatcaaactcatatttgaattaggagaggttccttgtaactactctgccaaggagtctttctaagttatagcactaaatttttgatcacagctgaa

SEQ ID NO: 589 - DNA, 749 bp, Homo sapiens
cgtttttacatttattgctaaatctttgtattatatcagaatttttaaattagtgaatggaattatagattatagttttattcaatagaagtttctgtggtgatggaaatgttctgtgttaaactgtcgaatacagtagctactagactttaagaagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagttctgtcttattttattactatttttatcatagtgtcgcacacagtgtcattcacatgggcagctagtaaatacttgtagagtcaacaattgaattatttttgtttctgattattgttatcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaag

SEQ ID NO: 590 - DNA, 2948 bp, Homo sapiens
gttgtggcctcgaaaatgccttgttgtccctctggaatctgtcttttcagcttcatctcctcctcctcacctcctgctgtggtgcacagatacctataggcaggctccatctcctcctccccagctcctcccctagtgcacagatacctataggcaggcttcatctcctcctccccagcttctcccctagtgcacagatacctataggcaggctccatctcctcctccccagctcctcccctagtgcacagatacctataggcaagctccatctcctcctccccagctcctcccctagtgcacagatacctataggcaagctccatctcctcctccccagctcctcccctagtgcacagatacctataggcaggctccatctcttcttccccagcttcttccgtagtgcacagatacctataggcaggcttcatctcctcctccccagctcctcccctagtgcacagatacctataggcaagctccatctcctcctccccagctcctcccctagtacacagatacctataggcaggcttcatctcctcctccccagctcctcccctagtgcacagatacctataggcaggcttcatctcctcctccccagctcctcccctagtacacagatacctgtaggcagactccatctcttcttccccagcttcttccgtagtgcacagatacctataggcaggctccatctcctcctccccagctcctctcctagtgcacagatacctataggcaagctccatctcctcctccccagctcctcccctagtgcacagatacctataggcaggctccatctcctcctccccagctcctcccctagtgcacagatacctataagcaagctccatctcctcctccccagcttcttccatagtgcacagatacctataggcaggctccatctcctcctccccagctcctctcctagtgcacagatacctataggcaggcttcatctcctcctccccagctcctcccctagtgcacagatacctataggcaggcttcatctcctcctccccagctccttccctagtgcacagatacctataggcaggcttcatctcctcctccccagctcctcccctagtgcacagatacctataggcaggcttcatctccccagctcctcccctagtgcacagatacctataggcaggttccatctcctcctccccagctcctcccctagtgcacagatacctataggcaggcttcatctcctcctccccagctcctcccctagtgcacagatgtctataggcaggctccatctcctcctccccagctcctcccctagtgcacagatacctataggcaggcttcatctcctcctccccagctcctcccctagtacacagatacctataggcaggcttcatctcctcctccccagctcctcccctagtgcacagatacctataggcaggcttcatctcctcctcccgagctcctcccctagtgcacagatacctataggcaggctccatctcttcttccccagcttcttccatagtacacagatgcctataggtgggttctgacttcctttctgcttgttgtgggttgtggtgaacaactgctaaggccacaagtctgaagagtcagaagacaggacagatgatgttttggacttgaaggaggagggttagtgcaggcagaggactggggctttggaagcactggatctggagaaggagcagagcaggggccgtggtgtttggggcaagagcaaggggaaactggagggtgattccagtaagggagtttaggtgctgcactgtggaatgggggtgacatgtttgcatcccaagtgctgtgtacctccgagtggtgtgtcttagattctcatgggtggatattctttggagttggtggggttggagaagtcaggagaaaaaaggctgccttcttggagaatttgttgacagttgggcctcaggcctggaacaggctgagtgggttggtgggggcagcattctctgtagatagtttctaattccccagagaaggctgctcctcaccaccccaccagactctcaggaaggaaatgatgactcttaacagtgctgattgcttctgttacttttgcctttgtcccctggaaggcaaattgccccaccagacctaccacttcctgagaaaaatcacacaaggctggatgccttgctgtcaacagcagggcgctctgcctaggcaaatcacccaggtgaaaatgcgagctgccaaggagcatttgaaatggtcgaaatgaatgttagcagctgcttggaaaggttaagatgtcaggaaagggcagcgtggatgtctaggagcatgagtgcctgtggaaggggagagaaggtgctagcgcggcatccagttccagtccgaaggctttgccttgtgatggagatggtgcttgtgggcccatgtgagttttgggtctatttctgcattagccagcagtcccacttccttcttggtctcctgtgtgctgccctgaaccattgtgcagtgctggccacatggcagttctgccaacattgtggggcccctgagattggtcagacagaattgaaatatgtttggcgctgttatttgcttacttaataatttttaaaaaatagagacaggggtcttgctctgccatacatcctgggcacaatcatagctcactgtaacctcaaattcctgggctcaggtattccttctgtctcagccttccaagtagctgtgactacgggccagcgccactgcatatctggggctttttaaaaaaggacactgaatgtacagttaggcctcacagcctcagcctcagcagaagcaagacccagtcctgcctttttccaggcagaggttggtcctaggtaaaatttcattcccaccttctagagggatgttccttcattgccttctctgcccttcctcctctcattgtactcttg

SEQ ID NO: 591 - DNA, 1446 bp, Homo sapiens
tattttaaaggtaatcgataagggtgatttggataactgcataagactgaatccccagacagttcacaaatatgtctgtgaagtggggtcaggaaaagtaagggtggcaatatgaataagagcaagaggctttaaagcccatgttcctgtgtttgaatcgtggccctattacttgttataatagctgtgaaatgttaggtacatttaaaaaactcctatatgcttcagtttccactttatttttaaatttttttaatttttaatttttgtgggtacatgatatatatatttatggggtccatgagatgttttgatacagacatgcaatgtgtcataatcacatcatggaaagtggggtatgcatcctcttaagtatttatcctttgtgttacaaacaatccagttgtactcatttagttatttttaagggtatagctaaattattattgactatagtcaccctgttgtgctgtcaaatactaggccttatgcattcattgtgtttttgtacccgttaaccatccccacctccctccccactcctccactatccttcccagcctctggtaaccatccttctaccctctatctccatgggctcaattgctttgatttttagttcccacaaataagtgagaatatgtgatgtttgtctttctgtgcttggcttatttcactgaaaataatgatctccatgttattgcaaattactgaattttttttttttttctgagacagagtcttgatctgccatcaaggctggagtgcagtggcatgaacctggctcactgcaacctccagctcctgtgttcaaatgattcttgtgcctcagactccaaagtagctgggattataggcgtgtgtcaccagctctggctaatttttttttttcttttttttgtatttttactagagatggggttttgccatgttggccaggctggtctcaaactcctggtctcaagtgatccagccgctttggcctcccaaaatattgggattacaggtgtgagccaccgtgcctggcatgaatctcattctcttttattgctgaatagtactccattgtgtacaagtaccacattttctttatccattcatctgttgatggacacttaggttgcttctaaatcttggctaatgtgaacagagctgcagcaaacatgggagtgcagatatctgcagtgggaacctccaaactgttctccatagtggttgtactaattagtttactctttaaaacaagattaaacatagtacctaatctgcataaggctattgtaaagattaagtaatttaatatatatgaggcacttaaaagagttcttggcacacactaattgtttaataagtgttagtcagctttatgattatttctgtccggtgttctgcttggaaactctgggttccttgcattcgattttattggagtcatcccctggaact

SEQ ID NO: 592 - DNA, 14794 bp, Homo sapiens
aactcctttcaagattttatgagacagaagtaaacatcagcatctcaaacacctcaatgccataaggtggcaggggcaatgagaactttctgcctagtctatactaccacataagctccaaaaagagagagacctcatctggcttattcactactgtattcccaagcctcacaagcaggaggtactccaaaaataaaaaaaggggaggaaattaaacgtggtatgcctataaatgccatgctttctacatgacagggtcaactactactgcttaataataaaaccaatagtcagccaggcgcagtggctcacgcctgtaatcccagcactttgggaggccaaggcgggtggatcatgaggtcaggagttccagaacagcctggccaagatggtgaaaccctgtctctactaaaaatacaaaaattagccaggcacggtggtgggcgcctgtaatcccagctacttgggaggctaagacaggagaatcacttgaacctgggaggcggaggttgcagtaagccgagatcatgccgctgcactccagcctgggcgacaagagacaaactctgtcttaaaataacataacataacataacataacataacataacataacataacataacatcacaccaaaccaaaccaatagtctggccgggcaccacggctcacacctataattccgccactttggaaggtcgaggtaggcggatcacttgagaataggagtttgagaccaggctgaccaacatggtgaaaccccatttctactaaaaatacaaaaattagtcaggcacggtagtgcacgtctgtagtctcaggtacttgggaggctgaatcacctgaacacaggaggcggaggttgcagtgagctaagattgcgccactgcacgccactgtactccaacctgggcaacagagtgagactccatctcataaaaataaaaattaaaccaacagtcacatattcaacaaattattattattattttgagacacagtctcactctgtcacccaggctgaagtacagtggcacgatctctgctcactgcaacctctgcctcccgggttcaagagattctcctgcctcagccttctgagtcactgagactgtagatgagccacgcacaaatggccaatttgtgtatttgtaataaacacagggtaggccaggtgtggtggctcacgcctgtaatcccagaactttgggaggccgaggcgggcggatcacaaagtcaggagttcgagaccatcccagataacacggcgaaaccccatctctactaaaaataaaaaaattagccaggcatggtggcgggctcctgtagtcccagctacttgggaggctgaggcaggagaatggcatgaacctgggagtcggaggttgcagtgagccgagatcacgccactgcactccagcctgggcgacagagcgagactccgtctccaaaaaataaataaataaataaacaaacaaacaaacccagggtttcaccacgttggccacgctggtctcgaactcctgacctcaggtgatctgcccgcctcggcctcccaaagtgctgggattacagtcgtgagccactgcgcctggccacgacaagttaattgataacttactaagcatacaaagttgtacaaaacacttgttcctactgtcaagatgctctaaatctagaaggaagataatgcaaatatttccaaacaagtcagatcgcaaataaacacatgcaccgcatgtttcaattatttatttatttatttatttattttgagacagagtctcgctctgttgcccaggctggagtgcagtggcacgatctcggctcactgcaagctccgcctcccgggttcacgccattctcctgcctcagcctcccgagtagctgggattacaggcgcccgccaccacacccggttaatttttagtatttttagtagagacggggtttcaccgtgttagccaggatggtctcgatctcctgaccttgtgatccacccgcctcggcctcccaaagtgctgggattacaggcatgagccaccgggcccggcccgcatgtttcaattaacaacagacctatatacaatgatcaaccagtaagttaaggtaaatttactcttaaagaaagatatttttgaccaggcgtgatggctcacacctgtaatcccagcactttgggaggtcaaggtgggcagatcacttgaggtcagaggttaaaagtcttaactcctaaccacagtgaactttctgtctgcagaaaagagcattggtcaacagttcacaaaacggctaggcatgatggcgtgcacccacagtcccagctacgtgggaagctgaggtgggaggattgctggagcccaggagttcaacgccctgggcaatacagcaagacctcatctctggccaggtgcggtggctcacatctgtaatcccagcactttgggaggccacggcgggtggatcacctgaggtcaggagttcgagaccagcctggccaacatggtgaaacccccgtctctactaaaaatacaaaaattagccaggtgtggtggcacgcacctgtaatcccagctattcaggaggttgaggcaggagaatcgcttgaacccagaaggcagagactgcagtgagccaacatcacgccactacactccagcctgggcgatagagcgagactccatctcaaaaaacaaaataagaaagatatttatcaatttagtgtatcctaactgttcagtgtttgtctacagtagcatacagtaatgtcctaggcctgcacattcacacaccactgataaatgactcatcccaagcaacttcctgtcctgcaagctccattcatggtaagtgacctattcagatataccacttttatcttttacgctgtatttttactcaccttttctatgtttagatatgtttagattcacaaatacttaacattatgttacatctgccaacagtgttcagtaccgcaacatgctatacagatttgtagcctaagagtaatactctgtacgacagcctatgtgtctagtaggtataccatctaggcttgtgtaagtaaactctatatttgtacaatgataagatcaccgaaaaaatttctcaaaacacatccccatcattaagcaatgcataaacatagtttctcatcaccaaagatggtatgaatgtcaaataaacacatgaaaaaatgctcaatatcactgggcattagggaaatgcaaattaaaaccacaatgaggccaggcacaggggctcatatctataatcccagcactttgggaggctgaggtagatgaatcacttgagcccaggagttcaacaccacccagggcaacatagtgagacctcttctctactaaaaatcaaagcaaactaccaggtgtggtggtacatgcctgtggtcccagccaggaggctgaggcaggaggatcacttgagcccaggaggtcaatgttgcagtcagacaatatcgcaccactgcactccaccctgggtgacagagcaagaccctgcctcaaaaaaaaattcatacactgctagggaaagaaaatatagcagtcactttagcaaacagtttagcaattacttttaaaattaaataaacactcacaggattatatgtaccctggaaaaataaacacttgccacaaaacccagcaatctcatttctatgcattccaaccaagagaaataaaatcatatgttcacacaaaacctgtacataaatattcataccagctttatttatttatttttttgagacggagtttcactcttgatgcccaggctggagtgcaatggtgcaatcttggctcaccacaacctctgcctcccgggttcaagcgattctcctgcctcagcctcctgagtagctaggattacaggcatgcgccaccacgcctggctaattttgtatttttagtagagatggggtttctccatgttggtcaggctggtctcaaactcccaaccttaggtgatccgcctgcctcggccttccaaaatgctgggattacaggcgtgagacatcgcacccggcctccagctttatttttaatagccaaaacctgctaactcaatgtccaccactagatgaacaaactggtacatgcatacaatagactactactcaacaataagcagaaagaaactactaacatgcaatagtacagacgaccttttttttttttttttgagataagagtctcactatgtcacccaggctggagtgcagtggcgtgttcttggttcactgcaacctcctcctcctgggttcaagtgattctcctgtctcagcccccccgagtagctgggattacaggagcgcgccaccgtgcctggctaatttttgtacttttagtagacacagggtctcaccatgttggccaggctggtctcgaactcctgacctcaggtgatccacccacctcagcctcccaaagtgctgggattacaggcgtgagccactgggcccagccagagataaggtcttgctgtgttgcccagggccttgaactcctgggctccagcgatcctcccacctcagctccccaagtagctgggactatgggtgcacgccatcacacctagccattttgtgaactgctgaccaatgctcctctctgcagacagaaagttcggtgtggttaggagttaaatgggaagaaagaggaggctgggtgcagtggctcatgcctgtaatccctcccaacactttgggaggccaaggcaagagtttcacttgagcccaggagtttgacaccagcctgggcaacagagcaagatcctatctccgaaaaattaaaaataagaaaagtaattagccggacatggtggtacacacctgtagccccaggtactcagcaagctgaggtgggatgatgggatgattgcttgagcccaagaattcgaggttacacagttacagtaagctatgatcgtgccactacactccaccctgagcaacagaggaagattctgtctccaaaaaagaaaaaaaaaaaaaagatgacaacggaacgggaggtgggtgtagtcccagctactaaggaggcagaatcatctgggctcaggagttcaaggtcagcctcagcaacataaggagaccctgtctcttaggaacaaaaggggagggggagagagaaggggagggagggggggagagagaaggggagggagggagggagagaggaagggttgggagagacagagaaagaaaaagaaaggaaaaaataaaaaggagagaaaggaaggaaagaagggaagacaggaggaggcagcggggaggggaaaaaaggagaggagggatgaagagaaagaaaggaaacgacaaagaaaggccaggcatggtggctcatgcctataatcccagcactgggaggccgaggcaggtggatcacctgaggtcatgagttcgagaccagcctggccaacatggtgctaccccatctctactaaaatacaaaacctagccggctgtggtggcaggtgcctgtagtcccagctacttgggaggctgagacaggaatagcttgaacccaggaggtggaggttgcaaggagccaagattgccccactgcactctaggctcggcaacagagcgagactccatctcaaaaaaaaaaaaaaaaaaagaaatgtattagaaataaaagtacatcagattctaatgccagttatgcagccaatgatgagatactctggtaaataaccctcttggtctcaatttcttcacccgtaaatagaatgagtactaaaaaaccaccagagccagagaaatccaaactaccagggaaagggaggggcccactgagaaccaccccagcaacccgaccacagctggtcttccctggacaccatgaaccacaatgtccaaacctcttcactcctgccaacatcggccatccccctaactatgagatgctcaaggaggagcaagaggtggctgtgctgggggcaccccacaaccctgctcccccaatgtccaccgtgatccccatccacagcgagaactccgtgcccgaccatgtcgtctggtccctgttcaacacccacttcatgaactcctgctgcctgggcttcatagcattggcctactccgtgaagtctagggacaagaagatggttggcgacctgatcagggcccaggcctatgcctttaccgccaagtgcctgaacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttgactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaaattaaccaggcatgatggcacacacatgtggtcccaagctactcaggaggctgaggcagaactgcttgaactcgggaggtggaggttagagtgagcagaaattgcaccacgcactgcagcctgggtgacaaagcgagacggtgtctcaaaaaaaaaaaaagaactgcagggtgtgatgttgcatgtgcctgtggtcccagctactcaggaggctgaggtgggaggatcacttgaacccaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcaccatctccgctcactgcaagctctgcctcccgggttcacgccattctcctgcctcagcctcccaagtagctgggattacaggcgcccgccaccacgcctggctaattttttgtatttttagtagagacagggtttccccatgttaggcaggacggtctcgatctcctgacctcgtgatccacccgcctcggccttccaaagtgctgggattacaggcacgagccaccgcgcccggccagtatctcagtttttttttttgtttgttttttttttttttttggagacagagtctcgttctgtcgcccaggctggagtgcagtggcacaatcttggctcactgcaacctccacctcctgggttcaagcgattcccctgcctcagcctctcgagtagctgggactacagatgcgcaccaccatgcccagctaattttttctattttagtagagatgaggtttcacaatgttgcccaggttggtctcgatctcctgacctcgtgatccacccgcctcagcctcccaaagtgctgggattataggcgtgagccaccgcgcccagccaaggaagatattctttctcttttaataggtaaataaactaagcctgagagtggctgagtaacttgcccattcaaacatgtgaccaagcagttaagtgccaaccattcaagaaatagggatacaatcaatagtgaacaaaacaaagttcctgctttcatagagcttaaattttagttactgaagagtgaaccatggccaggcacggtagatcatgcctgtaatcccagcacgttgggaggcccaggtgggcggaccacctgaggtcaggagttcaagaccagcctgaacaacatggcgaaaaccccgtctctactaaaaatataaaaattagctgggcatggtggtgggtgcctgtaatcccaactattcaggaggctgaggcaggagaatcacttgaacacaggaggtggaggttgcagtgagccaagatcgcaccattgcactccagcctgggcaacacagcaagactccgactcaaaaaaaaaaaaaaaaaaaaaaaacagtgaaccatgattccagcttagactggagttgccagataaaatacaagatgctcagttaaatttcaactttagataaataacttttttctatgcaatttaatacacaattatactaaaaaactggtcaatgttcatcaaaaattcaaatttaactgagtgtcctgtatttctatttgccaaatctgacaaccctagcttagatataacctcaaaactctttctcaatccttttactgcgtttctctggctctaaagcagtaacttttttgactatatcaataaaaaattacttaaaaaaaaatttttggctaggcacggtggctcatccctgtaatcccagcatttctggacaccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctactcaggagtcagaggcaggaaaatcgctagaagctgggaggcagaggttgcagtgggccaagattgtaccattgcactccagcctgggcaacagaacaagattctatgtcaaaaaaaaaaagccaggtgcggtggctcacgcctgtggtcccggcactttgggaggctgaagcaggcggatcacctgaggtcaggagttcgagaccagcctggccaaaatggggaaaccccgtctctactaaaaatacaaaaattaacccggtgtgtgaccaatatctgtactcccagctactcaggagtcaggcaggagaactgcttgaacctgggaggcggaactacagtgagcagagatggcgccattgcactccagcctgggtgacaagagcaaaactccatctcaaaaaaaaaaaaaaaaaaaaaaaaaaaaacctcccagaatggtatacttgttgagctcttgtgtctgttttttagtagttcccattttagtagttcccaggctctttgctttgtttttttgagataaggtctcattttaacgcccaggctggagtgcagtggtgcaatcatggctcacctcgacatccagacttaagtgaaccacctgcctcagcctcccaagtagctgagactacagaagtgcacgaccatgactggctaaattttttgtattaatattttttgttgagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggttttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggccctttttctgtttttcagtagagacagggtttcaccatgttggccagactggtctcgaactcctgacctcaagtgatccaccctccttggcctcccaaagtgctgggattacaagcgtgagccaccgcacccagctaagtctttcaactttctatcacgctactgttatttctcattgctgttaatatatctgcctctgaaaacattgcttttctacttgctgccaatatgtacatcagaaaagaaagctagatagaatcatgtgtaaagtaaaagttctcaaagaggccataaagaactctccagaccagaggctaaagcaggaggacagtttaagcccagaagttggaggccagcctgggcaacataacaagacccccatttctaccaaaaaaaaaaaaaaaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaatttaaaaaaaaactgatcattggcaacactgttcaataaagcctctcaaggcaatggtttcaggagaccaacattctaaagttctgatacagttaataaaaataaaccacgttcacttatattgccgacaagcctcataccacaactaatgagttttacaaagacttcattatagaatgaaattttattacattcccaaaatgtagttagctattaatcatggcacgaaactgacattttcgggctggacacagtggctcacacctgtaacaccagcatgttaggaggcctaagtggggtggatcactcgaggccatgagttcaagatcaacatggcaaaactccacatctactgaaaatacaaaaaaactaggcaggcactgtggggcgcaccagtagttccaactacttgggaggctgaggtgggaggatggcttgaacccgggagacagaggttgcagtgagccgtatttgcaacactgcactccagccttagcaacagagccagatcctatcacaaaaataaataaataaataaataaataaataaataaaacaaattgacattgtaaagtcacttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaatatggtgaaaccccatctctactaaaatacaaaaattagccaggcgagatggtgcgtgcctgcagtcccagctactcaggaggctgaggcagaaaaatcgctttaacctgggaggcagaggttgcaatgagccgagatcgcaccactgcactccagcctaggtgacagagcgagactccgtctcggaaaaaaaagaaaaaaaaaaagttaaggttaacagctgtgacaagttttcataaacaacccagactcataaaaaaaataccaaaccaggccggacgcggtggctcatgcctataatcccagcactttgggaagccgaggcgggcagatcaagaggtcgggagattgagacaatcctggctaacacagtgaaaccccatctctacttaaaatgcataaaaaaaattagccgggcatggtggcgggcgcatgtagtcccagctactcgggaggctgaggcaggagaatggcatgaacctgggaggtggagcttgcagtgagctgagattgtgtcaccgcactctagcctgggcgacagagcgagatttctcaaaaaaaaaaaaaaaaaaaaaaaaaaaaaaaaactaaaccaaactggtcacggtggctcacacctgtaatcccagcactttgggaggacgaggcgggtggatcatctaaggtcaggagttcgagaccagcctggccaacatgatgaaaccccatctctactaaaaatacaaaaattagccaggcatggtggcacacagctgttatcccagctactcaggaggctgaggcaggacaatcacttgaacctaggaggcggaggttgcagtaagccgagatcacatcactgcattccagcctgggtgacagggtaagatcctgcaacacacacacacaaacaataataataatttaaaaaaccagccaggcatagtggctcacacctgtaatcccagcaccttgggaggccaaggagggcaaattgtttgaggtcaggaattcaaggccatcctgggcaacaggtaaaatctctgtccctacaaaataaaaacaaacaaaaaagctaggcgcagtggcttatgcctgtaattccagcacttcaggaggccaaggtatatggatcacctgaggtcgggagttcgagaccagcctggccaacatgataaaaccccatctctaccaataatacaaaaattagccaggtgtagtggcgcatgcctataatcccagctactcgggaggctgaggcatgagaatcatttgaacgcaagaggcagaggttgcactgagccgatatcctgccactgcaccccaccctaggcaacagagtgaaacaaaaattttgctgggcatagtggcgcatgcctgtggtcccagctactcaggaggctgagataggaggatcacttgggcctgagaactcgaggttgcaatgagccatgatggcaccactgcactcccgcctgggtgacagagctagaacctgtctcaaaaaaataaggcgaggcgcagtggctcatgctgtaatcccaaaactttgggaggccaagacaggcagatcacctaaggtcaggagttcaagacgagcctggccaacatggtgaaaccccatctctactaaaaaaaaatacaaaaatttgccaggtgtagtggtgcatgcctgtaatcccagctactcaggaggctgaggcaggagaatcactggaacctgggaagtggaggttacagtgagccgagattatgccactgctttccagactgggtgacagagtgagactctgtctcaaaataaataaataaccaaggatttaacatttatgtagatttcacaccacgtaagtacagaaccacatacattaaaaacaaagaaaagaa

SEQ ID NO: 593 - DNA, 12262 bp, Homo sapiens
aactcctttcaagattttatgagacagaagtaaacatcagcatctcaaacacctcaatgccataaggtggcaggggcaatgagaactttctgcctagtctatactaccacataagctccaaaaagagagagacctcatctggcttattcactactgtattcccaagcctcacaagcaggaggtactccaaaaataaaaaaaggggaggaaattaaacgtggtatgcctataaatgccatgctttctacatgacagggtcaactactactgcttaataataaaaccaatagtcagccaggcgcagtggctcacgcctgtaatcccagcactttgggaggccaaggcgggtggatcatgaggtcaggagttccagaacagcctggccaagatggtgaaaccctgtctctactaaaaatacaaaaattagccaggcacggtggtgggcgcctgtaatcccagctacttgggaggctaagacaggagaatcacttgaacctgggaggcggaggttgcagtaagccgagatcatgccgctgcactccagcctgggcgacaagagacaaactctgtcttaaaataacataacataacataacataacataacataacataacataacataacatcacaccaaaccaaaccaatagtctggccgggcaccacggctcacacctataattccgccactttggaaggtcgaggtaggcggatcacttgagaataggagtttgagaccaggctgaccaacatggtgaaaccccatttctactaaaaatacaaaaattagtcaggcacggtagtgcacgtctgtagtctcaggtacttgggaggctgaatcacctgaacacaggaggcggaggttgcagtgagctaagattgcgccactgcacgccactgtactccaacctgggcaacagagtgagactccatctcataaaaataaaaattaaaccaacagtcacatattcaacaaattattattattattttgagacacagtctcactctgtcacccaggctgaagtacagtggcacgatctctgctcactgcaacctctgcctcccgggttcaagagattctcctgcctcagccttctgagtcactgagactgtagatgagccacgcacaaatggccaatttgtgtatttgtaataaacacagggtaggccaggtgtggtggctcacgcctgtaatcccagaactttgggaggccgaggcgggcggatcacaaagtcaggagttcgagaccatcccagataacacggcgaaaccccatctctactaaaaataaaaaaattagccaggcatggtggcgggctcctgtagtcccagctacttgggaggctgaggcaggagaatggcatgaacctgggagtcggaggttgcagtgagccgagatcacgccactgcactccagcctgggcgacagagcgagactccgtctccaaaaaataaataaataaataaacaaacaaacaaacccagggtttcaccacgttggccacgctggtctcgaactcctgacctcaggtgatctgcccgcctcggcctcccaaagtgctgggattacagtcgtgagccactgcgcctggccacgacaagttaattgataacttactaagcatacaaagttgtacaaaacacttgttcctactgtcaagatgctctaaatctagaaggaagataatgcaaatatttccaaacaagtcagatcgcaaataaacacatgcaccgcatgtttcaattatttatttatttatttatttattttgagacagagtctcgctctgttgcccaggctggagtgcagtggcacgatctcggctcactgcaagctccgcctcccgggttcacgccattctcctgcctcagcctcccgagtagctgggattacaggcgcccgccaccacacccggttaatttttagtatttttagtagagacggggtttcaccgtgttagccaggatggtctcgatctcctgaccttgtgatccacccgcctcggcctcccaaagtgctgggattacaggcatgagccaccgggcccggcccgcatgtttcaattaacaacagacctatatacaatgatcaaccagtaagttaaggtaaatttactcttaaagaaagatatttttgaccaggcgtgatggctcacacctgtaatcccagcactttgggaggtcaaggtgggcagatcacttgaggtcagaggttaaaagtcttaactcctaaccacagtgaactttctgtctgcagaaaagagcattggtcaacagttcacaaaacggctaggcatgatggcgtgcacccacagtcccagctacgtgggaagctgaggtgggaggattgctggagcccaggagttcaacgccctgggcaatacagcaagacctcatctctggccaggtgcggtggctcacatctgtaatcccagcactttgggaggccacggcgggtggatcacctgaggtcaggagttcgagaccagcctggccaacatggtgaaacccccgtctctactaaaaatacaaaaattagccaggtgtggtggcacgcacctgtaatcccagctattcaggaggttgaggcaggagaatcgcttgaacccagaaggcagagactgcagtgagccaacatcacgccactacactccagcctgggcgatagagcgagactccatctcaaaaaacaaaataagaaagatatttatcaatttagtgtatcctaactgttcagtgtttgtctacagtagcatacagtaatgtcctaggcctgcacattcacacaccactgataaatgactcatcccaagcaacttcctgtcctgcaagctccattcatggtaagtgacctattcagatataccacttttatcttttacgctgtatttttactcaccttttctatgtttagatatgtttagattcacaaatacttaacattatgttacatctgccaacagtgttcagtaccgcaacatgctatacagatttgtagcctaagagtaatactctgtacgacagcctatgtgtctagtaggtataccatctaggcttgtgtaagtaaactctatatttgtacaatgataagatcaccgaaaaaatttctcaaaacacatccccatcattaagcaatgcataaacatagtttctcatcaccaaagatggtatgaatgtcaaataaacacatgaaaaaatgctcaatatcactgggcattagggaaatgcaaattaaaaccacaatgaggccaggcacaggggctcatatctataatcccagcactttgggaggctgaggtagatgaatcacttgagcccaggagttcaacaccacccagggcaacatagtgagacctcttctctactaaaaatcaaagcaaactaccaggtgtggtggtacatgcctgtggtcccagccaggaggctgaggcaggaggatcacttgagcccaggaggtcaatgttgcagtcagacaatatcgcaccactgcactccaccctgggtgacagagcaagaccctgcctcaaaaaaaaattcatacactgctagggaaagaaaatatagcagtcactttagcaaacagtttagcaattacttttaaaattaaataaacactcacaggattatatgtaccctggaaaaataaacacttgccacaaaacccagcaatctcatttctatgcattccaaccaagagaaataaaatcatatgttcacacaaaacctgtacataaatattcataccagctttatttatttatttttttgagacggagtttcactcttgatgcccaggctggagtgcaatggtgcaatcttggctcaccacaacctctgcctcccgggttcaagcgattctcctgcctcagcctcctgagtagctaggattacaggcatgcgccaccacgcctggctaattttgtatttttagtagagatggggtttctccatgttggtcaggctggtctcaaactcccaaccttaggtgatccgcctgcctcggccttccaaaatgctgggattacaggcgtgagacatcgcacccggcctccagctttatttttaatagccaaaacctgctaactcaatgtccaccactagatgaacaaactggtacatgcatacaatagactactactcaacaataagcagaaagaaactactaacatgcaatagtacagacgaccttttttttttttttttgagataagagtctcactatgtcacccaggctggagtgcagtggcgtgttcttggttcactgcaacctcctcctcctgggttcaagtgattctcctgtctcagcccccccgagtagctgggattacaggagcgcgccaccgtgcctggctaatttttgtacttttagtagacacagggtctcaccatgttggccaggctggtctcgaactcctgacctcaggtgatccacccacctcagcctcccaaagtgctgggattacaggcgtgagccactgggcccagccagagataaggtcttgctgtgttgcccagggccttgaactcctgggctccagcgatcctcccacctcagctccccaagtagctgggactatgggtgcacgccatcacacctagccattttgtgaactgctgaccaatgctcctctctgcagacagaaagttcggtgtggttaggagttaaatgggaagaaagaggaggctgggtgcagtggctcatgcctgtaatccctcccaacactttgggaggccaaggcaagagtttcacttgagcccaggagtttgacaccagcctgggcaacagagcaagatcctatctccgaaaaattaaaaataagaaaagtaattagccggacatggtggtacacacctgtagccccaggtactcagcaagctgaggtgggatgatgggatgattgcttgagcccaagaattcgaggttacacagttacagtaagctatgatcgtgccactacactccaccctgagcaacagaggaagattctgtctccaaaaaagaaaaaaaaaaaaaagatgacaacggaacgggaggtgggtgtagtcccagctactaaggaggcagaatcatctgggctcaggagttcaaggtcagcctcagcaacataaggagaccctgtctcttaggaacaaaaggggagggggagagagaaggggagggagggggggagagagaaggggagggagggagggagagaggaagggttgggagagacagagaaagaaaaagaaaggaaaaaataaaaaggagagaaaggaaggaaagaagggaagacaggaggaggcagcggggaggggaaaaaaggagaggagggatgaagagaaagaaaggaaacgacaaagaaaggccaggcatggtggctcatgcctataatcccagcactgggaggccgaggcaggtggatcacctgaggtcatgagttcgagaccagcctggccaacatggtgctaccccatctctactaaaatacaaaacctagccggctgtggtggcaggtgcctgtagtcccagctacttgggaggctgagacaggaatagcttgaacccaggaggtggaggttgcaaggagccaagattgccccactgcactctaggctcggcaacagagcgagactccatctcaaaaaaaaaaaaaaaaaaagaaatgtattagaaataaaagtacatcagattctaatgccagttatgcagccaatgatgagatactctggtaaataaccctcttggtctcaatttcttcacccgtaaatagaatgagtactaaaaaaccaccagagccagagaaatccaaactaccagggaaagggaggggcccactgagaaccaccccagcaacccgaccacagctggtcttccctggacaccatgaaccacaatgtccaaacctcttcactcctgccaacatcggccatccccctaactatgagatgctcaaggaggagcaagaggtggctgtgctgggggcaccccacaaccctgctcccccaatgtccaccgtgatccccatccacagcgagaactccgtgcccgaccatgtcgtctggtccctgttcaacacccacttcatgaactcctgctgcctgggcttcatagcattggcctactccgtgaagtctagggacaagaagatggttggcgacctgatcagggcccaggcctatgcctttaccgccaagtgcctgaacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttgactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaaattaaccaggcatgatggcacacacatgtggtcccaagctactcaggaggctgaggcagaactgcttgaactcgggaggtggaggttagagtgagcagaaattgcaccacgcactgcagcctgggtgacaaagcgagacggtgtctcaaaaaaaaaaaaagaactgcagggtgtgatgttgcatgtgcctgtggtcccagctactcaggaggctgaggtgggaggatcacttgaacccaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcaccatctccgctcactgcaagctctgcctcccgggttcacgccattctcctgcctcagcctcccaagtagctgggattacaggcgcccgccaccacgcctggctaattttttgtatttttagtagagacagggtttccccatgttaggcaggacggtctcgatctcctgacctcgtgatccacccgcctcggccttccaaagtgctgggattacaggcacgagccaccgcgcccggccagtatctcagtttttttttttgtttgttttttttttttttttggagacagagtctcgttctgtcgcccaggctggagtgcagtggcacaatcttggctcactgcaacctccacctcctgggttcaagcgattcccctgcctcagcctctcgagtagctgggactacagatgcgcaccaccatgcccagctaattttttctattttagtagagatgaggtttcacaatgttgcccaggttggtctcgatctcctgacctcgtgatccacccgcctcagcctcccaaagtgctgggattataggcgtgagccaccgcgcccagccaaggaagatattctttctcttttaataggtaaataaactaagcctgagagtggctgagtaacttgcccattcaaacatgtgaccaagcagttaagtgccaaccattcaagaaatagggatacaatcaatagtgaacaaaacaaagttcctgctttcatagagcttaaattttagttactgaagagtgaaccatggccaggcacggtagatcatgcctgtaatcccagcacgttgggaggcccaggtgggcggaccacctgaggtcaggagttcaagaccagcctgaacaacatggcgaaaaccccgtctctactaaaaatataaaaattagctgggcatggtggtgggtgcctgtaatcccaactattcaggaggctgaggcaggagaatcacttgaacacaggaggtggaggttgcagtgagccaagatcgcaccattgcactccagcctgggcaacacagcaagactccgactcaaaaaaaaaaaaaaaaaaaaaaaacagtgaaccatgattccagcttagactggagttgccagataaaatacaagatgctcagttaaatttcaactttagataaataacttttttctatgcaatttaatacacaattatactaaaaaactggtcaatgttcatcaaaaattcaaatttaactgagtgtcctgtatttctatttgccaaatctgacaaccctagcttagatataacctcaaaactctttctcaatccttttactgcgtttctctggctctaaagcagtaacttttttgactatatcaataaaaaattacttaaaaaaaaatttttggctaggcacggtggctcatccctgtaatcccagcatttctggacaccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctactcaggagtcagaggcaggaaaatcgctagaagctgggaggcagaggttgcagtgggccaagattgtaccattgcactccagcctgggcaacagaacaagattctatgtcaaaaaaaaaaagccaggtgcggtggctcacgcctgtggtcccggcactttgggaggctgaagcaggcggatcacctgaggtcaggagttcgagaccagcctggccaaaatggggaaaccccgtctctactaaaaatacaaaaattaacccggtgtgtgaccaatatctgtactcccagctactcaggagtcaggcaggagaactgcttgaacctgggaggcggaactacagtgagcagagatggcgccattgcactccagcctgggtgacaagagcaaaactccatctcaaaaaaaaaaaaaaaaaaaaaaaaaaaaacctcccagaatggtatacttgttgagctcttgtgtctgttttttagtagttcccattttagtagttcccaggctctttgctttgtttttttgagataaggtctcattttaacgcccaggctggagtgcagtggtgcaatcatggctcacctcgacatccagacttaagtgaaccacctgcctcagcctcccaagtagctgagactacagaagtgcacgaccatgactggctaaattttttgtattaatattttttgttgagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggttttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggccctttttctgtttttcagtagagacagggtttcaccatgttggccagactggtctcgaactcctgacctcaagtgatccaccctccttggcctcccaaagtgctgggattacaagcgtgagccaccgcacccagctaagtctttcaactttctatcacgctactgttatttctcattgctgttaatatatctgcctctgaaaacattgcttttctacttgctgccaatatgtacatcagaaaagaaagctagatagaatcatgtgtaaagtaaaagttctcaaagaggccataaagaactctccagaccagaggctaaagcaggaggacagtttaagcccagaagttggaggccagcctgggcaacataacaagacccccatttctaccaaaaaaaaaaaaaaaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaatttaaaaaaaaactgatcattggcaacactgttcaataaagcctctcaaggcaatggtttcaggagaccaacattctaaagttctgatacagttaataaaaat

SEQ ID NO: 594 - DNA, 2328 bp, Homo sapiens
atggttagacatcaaaccaatgcttttttcttattgcttcacaactaaattgctggctcactcatccctccaccccacacatctgcaaacttcatagtacacttctaccatcccactctcctttgatatcacaccctttcctaagtcctggttttgctgaaatcatttacaaatttattactagtttctttaatgttatcatttctcttttttcaaagatccctatttgacatatttattattatctattgagatccaatgcccatcaattctctcttcttttgtctagtcattgagattgcaatttacttatcttgtgattagcacactttaaagtagttttctcaaataaatacaaagggttttatgctctcttagtccttttgtatataaaatgcatttttaacactgacagatgaacatgttgtctgtgttcagattctgtagttgcagttctattctctcagtagtctatgtatattgattcattaccttccactttccagtattgtagatgagtcatccattgcacaatacatttattttactttttcaggtttaggttcagcctgtttaggggctgaacaaggttacttctttatgcttgcaacctaggaaggtcaccaggacatgagtaagcatctattttcatttaatctcactaaaatttagtgagctctttcagtttgcagatttatgtttttttttttttttcatttatgtaagctttcttccgttgtttatgacaacttttcttctatctgttcgctttttccttcagggactcctattattcatagctgtgtggataggctattttactttgcccttattattatatctctaccactttttgagttattttttcctgcttcatctcccatattaaaaactagctctcaaggactatgcccttttttaactcattttttggacatttttagttgaagttacagaaattgtattttgtgccctgcttactttttcttgagacaacaacaacaacaacaacaacggattctctcgcccatcaattctacttgcttgggaaatctctagactagacatttgtcttgattctctgagtttcatcctcagtttctgagtctccctttgtgtgtgagttaacttttctttccttcaccatggatacatgtttttgatgtaattgtcgtttgtcttttatgctatcttaagcagtggcaaatgaggggtagtagagggcaccatagtttacggaggcgaaagacctgaaaagccatagctcctttgctgaacatctgaagaaggctttttggtgacaggatttcccagaaatgagtggagtcatttattgacccccttctccacctggagtaattcagtctctagtgagcttcccttcctggcccactgagacccacaggactctgtggactgctcctggaccacaagcagcatacaggcaggtccagctcctctgcgggaaatgaaaggctctctgccctgagcagtggcctcaggggaccagaggactcagactttgctgcaagtcctgcgacaggtacttcctctctagcacaggcttcttagttctggccttgcaatgatatggggaagacttgaacctgttttctctcctatggatactagggaatctcaggagaaactgaaattgatgtgtcatgaaggtcccatccacatgcctgacctggttgctgtattagcagaggaagcagtaataggcattcattacatcatctctcccttcacctgtattttcagactgagattttcattccaaaaaaaaagagtggtgatccattttaaagtgtttttttaaaagaaaactactaatgaatgcctgaaagatattccaatagattgtctaattatgtatacatacaattaatcaccttactaactgcatatattatcaaaaggacagatggaatgaactgtttaaatgagcataatttatagtaaaatatgcagctggatctgtttgcattacaattttctctgtgggaaaatgatattcttttgaaagacactaaaaggcactaaaagatttagcaaattgttatgtgattatatttaaatatctatagtctcactgattttcccctagaattcctgattccagattctcttggaatcaaatggcttgctttgaacataatttgttaacttttacaagccaacactctagctctctgaaatattcatgccaaagtgataacattttatggaaaatcaatgcacataaaaatatgcctaacttaacttgaaggtatgggttatcctgccatagagaagaactgtgtcaggatttaaagaaggtgatta

SEQ ID NO: 595 - DNA, 16430 bp, Homo sapiens
aaaaattgtctcttgtcacagacatggatgttcttccagttattgagtaaaaggagactgctgacaccaccacaaccacatcaacaatactgacaatagcagagaacaaccacgttttatagatgcagcaagtgaggctggtgaagggtaaatagcaaaaccaaggttacatcactatggctaggaaatggcaaagctatgatttgattccaggattttccaactctctagactactgttgagttcccaattatctcttattacatatatagttgtatatctactattcatgaggtgtctatgggagattggttccaggaccctccacagataccaaaatccaaggatactaaagtcccttgtataaaatggtgtagtatttgcaaataacctatgtatatcctcctgtatactttaaatcacctctagattactgaaaacacctactacaaagcctacacatgacttcatttgtgtggattcaaagtggtacttggcatggagcaaattcaagttttgctttttggaactttgtagaatgtttttttttccaaatattttcaatccacggttggttgaatctacagacatggaacccactgatatggagagcagactgcctatgatggtgctagtcttggtggttgagtcatacaatataagacaaatccctgctcttttgaggattatactcttgtcaggaagataagaaatgtttaaacaggccaggcgccgtggctcacgcctgtaatcccagcactttgggaggccgaggtgggcggatcacccgcggtcaggagtttgagaccagcttggtcaacatggagaaacctcgtctctactaaaaatacaaaaaaactcgccaggcgtgttgatgcatgcctgtaatcccagccactagggggactgaagcaggagaattgcttgaaccagggaggcggaggttccagtgagctgagattgtgccactgcactccagcctgggtgacagagtgagactccatctcaaaaaaacaaaacaaaacaaaacaaaacaaaaaaagaaagaaaagaaatgtttaaataagcactcatcaaaatacagggcaataaacaagatgtgaaaacttacagaactctacacaggaaagtggaggagagagttaaaagaataggtagtcatttttatcagagagatgtatgttttggtccaaatcagttgttttctgtaatgtaaaacatgctattatttaccaggacatgcaaatctacttgaggagggaagacatagcatttgcatgaatgttgcagctctgtataatttcagaagatattgatgtgatcagggagggctacacagaaaaggtggggcttgagtgggaccttgaaagatgagtgagatctggatgggaagaggaaaatgttccgggccactgcaattgttcacataaaagcatggagttgagtgtgcatgaggagtgactgtaacatattgagtgaattggcctttttagaaaataggttttctggggaagtggtacaagataagactagaaacttataataaccaacagagaacacctggcaggaagagagaagctgactgaaggggaaaaagaagatacacgattcatctctcaaaattgccttgggttggttctgtttatatattaatgtttttgcctgggatctttcctcaaaaactcttattttaccattaagcaccaaaaccaaatgaatactgaaataattatctgaaaaaagaggaagtaaaagttgggaaattatttccataacagtagggtatttccttaggtgaaaaaatttgagttatatcttttattatttttaatagtttactaaaagtaaagtccttggagggtaaaaaaataaactcttatcttcagtcattcttcttatctttgaaacttatctgataagagtattttcaacttttgagttgcaggaacaaacattcttaataaaattatatggtactttctttgatatctgatttctagctctgtttattgtctttcttttggcattaatattactattactgtgcttttaaaaacaggtcattcagatttgttacttttaagtacatagaaaaccttcgaatgaaatgtttttctagacatttcttttataagaacaggaacaagtgtatatgctttttctcattttaactgactactaatatgcagtattagcaagtcaattttgggcatttcaggaaacaataaaaaaagtaagatattcttatcctgatattttcctttttttttctatttcgtggttataaatgaaaaacatttagggagttctacttataaaggtcctcttgagttatatactctttgttaataaattgatgtagaacgtgttttctctcctttcaggaacccgttatgtgtagattttgttctgctttaaagttagtttccctttttattcttcataggaagtatacaaaggcaaaatgaagtacgtagacattaaagaaatacccagtcctttaaatcactggagtcagtcaagcaaagaccttaagacacagtctcaggcctcccagattatgtaaatctctctgagggaaaaagacttatgtgcaagaagttgtgaagtgacattgcagatagaatgtcaaaatttattactattatgtagacaatattagaagaattcagagaagatgagaggccaatgagcagcacaagtcattcttgacatctattcacagaggtaatagggcaaattttacatatatgaaaagcgtgagaggtgctcttcagagctagagaaacttgagtctggactgatgcgcgtaaactacctgggacagtgggggtcatttagacatggtggacaaaagttggagtcaggttatgagcagatttgaagtctaggttgaaatgtatgggggcagacatcccctgtgataaattcagtatctaaggcatgttatatggtacaacatttatccattaaataattctttcatttattcattgaacaaatagtacttgacccctaatattcactgaacatgtagtcaagtgtggggtgtataaggctttagagaaaggagagactggaataagagaaaccaagatgctgatgtagttgtccagatacgagaaaatgataactattactagaataaagtaatgaaaacaaagaggaaggactggatttaggagactttttgaactaggattagaccaatcattttaactggttggctatcgggcataaaggaaaggaaagagtagaagacagcttcagattttcagtgggctgactgagagaatcctattgatagaaagaatggaattaagtaagtggatccaattttagtgtgaagaggacaggtatcaccttaaaatagtagggtcttgtatgcaattagagatataggactgaagcttaaattaaagatcaggattggaaatagatattcgagtcatgaacagtataaagttaaggccaatacatctaatttaataaggcaaattacttattttctatgcttgatatcacagaggcaagaaataaatatcacacatgttcacaactgctaggagagatcacagaaagatgaagagaagacttacaaggggcagaaaaatgggaggaaaatgggagcagccaagtgtcacatgtgttgaggttttcaatattaattttgatagacttcttattaacaaatactgttgattgtctactatgagctgggtactattttagtcagtacatttataagactgagtataaaagtccctggctttatggaggccacctgtcggtggggtgagtgcaagagaggttgaaatactataacattgtgtgatacaatacacaggcattttaactaaatgacatagatatgaagattcatactatgagtgtaacccccaaatagtataaaatatattttaaaatggaacatttttcctcttaggtttatgattcagtaatctcaatgataataaaatagacccataaaataaagataagttgaaatgtggaatgaacagaacctgaggtgtatgacttatgcccatcaccatcatatataatacagcttctttccaagtctatacagtgttcaagtccttgaaagagggagtcggtaaagggacagggcaggactaggcacttgagatgtgtttgttactctggggaatgaagctgctgagcaggccttttctgcattgttagaaaagtgtgtaataaacaaagggaagaagcttcagtaagctggacaacacacacgagtgataatcagaaggtctctcctttgcaaatacacatcttgcttttgcaaggatagtgttgtatctcatggaaagctgtgtaaatatcaggatcctgtttatactagttagacacatgaaacatgcttgcacatgctcacatacatacacacaaacacagtcacacagttggctcttgggtaactgtcatcctttctcgtaagtttttccatggaattgatgataattcaggtaacggttaagtatggccctacataaatgcttgcttgtttagccaggaaacatttggtatgaacagcaaggtgtgactgtgaaggggttgctgatatgtatgtgtggagtcaatgtatgtttcgtgagttaagagatgatttgttgcagggctaatgatattttgaaagacaagaataagatacaacactatccttggaaaagcaagatgtgtatttacaaaggcgagaccttctgattatcactcgtgtgtgttgtccagcttactgaagcttcttccctttgtttattacacacttttctagcaatgcagaaaaggcctactcagcagcttcattcctcagagtaaagaaagaagctgtattatatatgatggtgatgggtgtaagtcatacacctcaggttctgttcattccacatttccacaagaataagaatgcctttgctaggtggcatggaaaaggaataaagacattttgaaacttttaaacacctatatgataggtctctgatatagtcattaaaatcatcattaatttactgaatagtcatcaaactataactatttatgaggtttggagagggtttgaaagaaaactaacaaaataagcctttgcaaagtgccaaatgatagtgcagaaaataaaaatgatgggagtttagaaagggtggagaataatgatataaccaaatatgaaaaataattgacagtatcttaaccaatatggtagtgcgtgtcatgtaagataaagtgaatcctgtagagatagcagttcatgctggacgagtgattttattctcacctccttggccctagggaggtgagagattcttttgaagggaggctggatttagcggcaactttaagcacaggaccttattgagtatcaataagatacgtcctgggggaggtatcagtgtttggcttgagggaatttctcagttcaacagtagacttttcaggcgaagaagaaagaaatcaaatatcctagtacgagcagagaggcgagagctgaaaatgttggaagagacaacatatgggggatctcgtgaccaaaggcagcaaagccctgcaatgctggtgattcattcatggtcctttatatcataagaattaacacccaggctataaagttaattatattatatcacttgagcatttgggagaacataatttgacacagcacattaaaaatccctggcataatgaatatattactctaggattctagcaaggtctaacgaataaatatttaaagtttaagtacattcccatgaactcagtctagattcacttgataaactagataagcttacagttaatgaatttgttctggttgactgagttaataatgagtgcttaaaactcgcctaatgcatatttactcaaaagtcttaggatggtatgagtgatgattctatgtgcagttggaagcccaatgtaataaatatgtattcaaaagctttaaaaaccatcactacacattagaattacataatttttattttgttttctgccctctatccccacctaattgctatatggcaggactttatttttattactgcaaataaatagtgtaattatcctttaaagaaatttgtaatggtctggtggagaattaataaaaatcattataattgcactgtgtacaaatgaaatatttttaacacatagcttggcagtaactatttggaaatttaacaagtaatttttattctctatctctgcaacttctatgtttattacttttaaatttaagtctatggggaagattcttttggcttggaaatgagcaacgttttaaatattccgattcagagccaatatgaatataagtaggcaataagtttcctttgtgataatgagagatatggcaaatcaaatgttatagtcattgtctttatggaactttccaccttattgtgccccaagccaaatgctgtatggagagactgccttgatattcctgttagccttttaagttttctgttgttcaccatcactgattcctcaggcatttttgtgagtaccttatacctaaggcaattccagtgacagggatcctcaggtctataaattaggaatccttccagctgcaagtgataacatatctgggtaacaacagattaagtaagtaggtgtttgttttgcttaggtgtcaagtttacaggctggcagctattggctttgcttcagtggctcaacactgctagagctggttctgtgctgttctatagtcgctgttgcagtaccaggcaaccctttgtctttaaggcagcaggaggtgggagaagggtcaatgacaggtgtctctattacctcgatagcaacatcaacaaaaaattaccaaaggctttgctagaatcttcctgaagagatttctgcttctatgtaattgtctagaaaggtgtcacatggctacctagctgcaaatgaaggttgacatgtgagtttttagttgaggtgggaatcggagagggggttggaaatgagtgctgggttaaccagacaatagtatctgctacacctgaaaagcctgtgccttactggtgaggggcagagattcttagggccagtgggaaggaagaaggtacaaatggcagaaactgcaagaccaatggagaggttcatttctctccactccatccatactcaccagacctgtacattgaccccggggaagccatgttaacccttgaagccacttttaatatttctttctcttgattttgttgtctcatatatcatatgatagtaaaggaaaatattgaaaaagcaacctcatggtctcatttccttaaaaaaccctttaatgtttcccctcctttttattccctatcatttgcaaggattgcaatataaatataattaattaccaatttgcttttttcacttaacgtgatttcataacccttttccttctctgtctcattttgttcttaatgaatgtctgtattgtcttcactgactcctttaaaggattgacattagtgatacagcttagaagacttagccttatgtttcttatgccatgaggcatgaaagagtcattatgtcccagtagcaaaaggacagaatcatatttgttatttttcaaagctattcttttaaaattcttctgatttgagaacagtaaccacaatgacttaagaattgacttatattgtataaatcaatcaagcagctgaaaaccctgctggtttgacatgtaagtaatctttgtacttaaacatcctaaactactatttttaattttaaataatgatactgtctctcttattacttacatgtatatttgttggcgtgtacttattcccagcaaaggcaatgatgatttcttagaattaatttttctctaccagctttataacaccgaacaggtttttaaatgtaccacttagcaaattaatagaaggtcaaaccactggaatttagaaaaaaaagaaacttgattatataactccaaacaatttttaaaactgatgtatactttatacattcttagttgatatttaacatttgttatcataaggttaaataattacaagttcaatttctgacaaaagctgaaaatacaatttggtaaaaatgaaaatttaaaattaaagtgatacatcacttttaaatatatccattgaaatctacacacctcatagatatttattactgatttttaaaaaatgagaagttttgccttcgtttttgagaattttacattgtttttcttttgacttgaacttatgtaatcctttttccattatagaattttattctaatgtgatgtatttatgagaattttgacactgtgtatttttggataaatattatgtacttgagtgctgtggtcaacagaacagaatatacagctaaacttctggagttcaagtttcaccctttgccagctaagtgacattgggaaagttacttaatcattctgtgcctaagttccctcaattgtaaaagtgggagaaatattacatatcccacagagtgattgtgaggactaaatgagttcacatgtgtaaagaacttagacgaaagcctggaatgcaatatacactgtcctgttatcgttagactgagacacagcaacaactattttgtgcctcttttttatgggtttaagtgcttataaaccttgtttacataaaaaggaagatgataacgagaggatttttggtatatattgtccctcaaatttccaagttacacgcaaaaacaataccacatagtggtctatcagcaaaacttttttaaaatacaaggattaacaacttgatgggatcctcttccagttttcttgaaagtaaagaattggaattacccatctttcaaaatgtttcttgaactgaagtcatttgccatctcaatttctggaaagtgtgctaccaaaggcattgcaagatgtatctaagagctctagactctgttattcttccacttacagtctccacatttaactctattctcacaaaagggtggagaagataaaaatattagatacatttcctgctacatcttgggcaaaaaaatatttgatcagctttattataataacatttacatagaataagagtcactaatttcaaaagtacagttctgtgaatttggacaaatgtataaagttgtggatccaccaccaaagttatgatatagaacatttctgtcacttccacatggtacatcatatctttttgcagtaattgcctccccagatgcttgatgcctgattggctttctgtcaccctttcacttctggttaccttgggtaaatacctaggagggagactgctgggtcccatggttagtgtaggtttatgagaagctgcaacacgttttcgaaggtggttgtaccgcttagcaatctacattcttgtcaacacttgttattgtcagcacttttttctttttagttattttattgagcatgcagtggtaccttattgtggttttaatttggatttatctaatattgtcgtgttgagtatcttctcatgaatgtacctcccattgccatgtgcttatttgcttttagtaccattttttgctgaagtgtctattcaaattcttctgcttatttttcagttgggttccttgacttcttattattgagtttcaagagttctttatatattttagatcaattattttataatgtgcttttcatatgttttaaatatattttttaaaccttagagctgcagatcgagctcatgtaatttacaagaaatgtcttttatatttcttaattagcagagaaaccagtcaattacatcagactttttgtcagaaaaatttttttgacttctcttttcaatcttaacaatatagcgacatgggcctctgtgttgaccatttcacatctgaattccaacttaagaaagatagataaggctcagacatttgttatagtttggtatctcttggaggaaaaaaaaccctgtgtcctctttcaatgtctctaaccagtgctcctttgtttgctctcacagttttactctcaagggtgatggcttttgtgggtaaatattgggatggaagtgctggcatgttaatggaaaattgtcttctcccctagaccactttataatatttatatattcaaaatgttccaacacaagcccaaatacttcatttctaaatcatgaaatacatacctatacaaatattccaacatgggcccacatacttcatttctaaatcattaaatacatatctatacgattgggaaagataagcttttctcagataccaatattttgaattgtttgcttggtgttaaaaagtgttcctacccttgaccaatgtaccatagtaagattaggcctgagaataaggcctgaccatgagagaggaggtggacatggagaacccaggacaactcaaacactgggcatttcaggcagggcagtttggggaaggtatacatctggaagttgaagaaatggaaacttactccctaaccatgcctgcataccctttgaacaatttcatgaactcccaggggtaaccacaccacagtttgaagacggttgttctaaacttatgtggtttttgaaaaggtgaaggattgagaagcaatgggataccaaatattccaaggagataaattgtttcctactggaagagagtgagagtttcctagattgaaaagagaatgatgtctttgaggaggagtcaaatgaggttgatgacctgaatttcttcaagtctcatttatgagagattttaatgcaagagctccataattctttgtgtgtgtatgtgtatattatacatatgacatatatataatatatgtcatatgtataatatatgtgacatatataatattatatatatgtcatatgtataatatacatatatcatttatcaccattttgtaggaggtgaaagctttatttgtaagttcgtgaaatacttttattattttaaataggctatcattgtgtatgtgtgtaaatatacacacacgtgtatatatatgtatatacatcaccatttcgtagaagatggtggcttcatttgtaagttcatgaaatactttcattattattttaaatcagctatcattgtcaaactatttttaagagtatttaattaatgttccccctgtatgattttctggaggaaaatcccagtcagtatcagtgggagaccgaattatgagagtgtttaattaagagtttctttcaggcacctttcaaagaacaatttaatatctgagaaactccaccttatttgtatctctagaactgagcagtgagaaaatcttgacacaagtcacaaagattcaactagaccaaacattacaaaaatcattttcatttatttaagcctttaaaataaaatattcatttaatatgatactcagaggcaataaaatacataatttaatcgacttttcaaattcatttaaaaatagagagctatcattttagaaagctcagctatttttcttcccactagcaaattagggaaaaagactcaagtcacaagttaccgcatcatgtaagaaagccaagtcctatcttgctcacctgtcttgctcaacagggaggaaaaacctgcttgctgcagctgctggcatccaggcccttgattttgggtgtgttgaaattacaagaggagttctcagggtccctttagtgtacctgtctattttctgattgatgggaaatgtgtaggaggtacttagccgctagactgtaaatcttcctttccaccattgggagcatattctctgacactctctaagaaggaagtctgtaccccctctcctccactatctcttaaaattatttagtccattttgtatttgtctaatgatggaaaaatatgaagtacttattcaactgtaaatggaaatcttgcataaaaagatcaatgttatgaatttgaaaagcagaatccctcacccctctactggaagagctaagttgagttcctgttcccataatgcttgggtgcaccagcagaatctgaactcagaacatgcaaatgcaaaaagccctttcagccaaaacacttgaaatagactctatgaggcagtgaaaatacccaatgcaaaatggaacaaaaccactaaggaccgagtggttaagattgtgtattctgattgctgcagaatgagggaaaggaaattaaattcgatcttataattgaaagtccaacacttgatgagttattttcccctggcagccgtaaacccctgctaccgtatatcagatagtcctggcttcccttggctacacctacttacagcattgaaacaactttcctggctggtggggcccttctgacttttgggccctgggacacgttctctgtttcaaatactgtttaatactcatttcctgatcactctcggacttgattcttcttatactacttactcctgcacatctaattgactctagttaagcatttcaaccaggtttctgttacttgtgttttctatgtattttatactatctcccattgaattaattcctccactagagtcttggtgtttctctcaatacttctgtctttgcacctcctgccacctccctgaccatggtgcttactgtgggtggtccctgtcaactgactagctgtcatattagctatgtggatccactgcacacaggaaaaccttgaggaagtccctctcccagatttgaagagctctttgccaaatacacaccgtttgaaagaattatgtttttccttggaagatctagtgggtatcactggacccctgaggtagagcaatagatgtacgatatccctgctgagttaagagcctgcatccaatatggttattgaattctattttgtaataatttcctctcatttctgcttttggactgccactggagaaggcaactttttaaaaatacagaagtcagatatttgcccatgttatattacaaagttatataaatatataggttgcaaagcttttaaaataatgattaaaatgtcagtgaaagatgttcatgtcaatttttataatcataaacactgaagaaaatcgtgaccactgtaataataataattcattacatctactttaacatacagaaagtcaggttgtcatctatgggctaggaaattctgcataagaattcagttttggtgttaaagatgttttcattctcggtgttccctatgtcaggtttagtctgagaatattttgggggaatatttcaatgacaatatatctatatgagtatacatacatatataaaacatatacatatatataggaaacaatatttgtcccattaaagaattgggccaccagtcacttggtactgaaaccaatacatgaattccaatgaaattccaattttcactttaactcttttctgccaactgtcctaccaaaacaaataattaaatatagttacggtttaagaacgtaatttggaactcgtctgttttgtccacttgatgtctacttttcgtcaggttgaaatcctccatttgccttataaaacgatgactctggctccgttccattttctttgctctctggaatttctgccttgttttttccatgacatttcttgtatgccacataaactagaaaacaatacacagacagttaagtaaattttataataataaactgcaaaattactttgcatagagattataacctatgattcacatggcagatcacattttctgtagactggaggctgcttagagaaagaaatcaccattcttagttctatggctactcatggcgagagggatgactgcacttcaggaagacctagcataaatctttaggagacatttgctcagggcagccacaagcttcttcaggcattcagccctgcacgtggtactcaacaatgataagaacaatagggaggatttattctgtaccgccatatcccagttaatgtgctagttcttaataaatatacacatggtgcagtgcaacctccaggacatgggtttgatggtcctctgtagaaggacttgaactagaacaacgttcccattccctccctgccttcattcaatctttcccccggagagaagagactcggctgatgggtgatcagcattcctcttttctgtggagctgctggtctctgatagcaagcatttctcagcttatttttaatgtcagctcatcagggtaggctctgccctgcgaggcaagacctgcagtgtctatgcatgtgtgagtacatgtctgcacatgtgtgaggcagtggaggaaagggtggtttcaacaagcccatttggttgcagattcaagtcatgttttccaattaagttttatccatagttaaagtgctattctgttatctgaatatctgatttttcttctacttctcaattggtcacaaaggcaagaggaggacagaaaatactccttataggacccctcgaattctaatacctcacatataaaatggccataataatattagctacctcatagggcaattgtgaacattaaatgagataaaattaaatgcctaacatggtctgtgaagaatagtaaatgctcaataaatgttaacgttcattatgatacacagctgagagagataatgacttgcttcaaagatcttattaactcaagatcaatatttcctttagattggtccctgaacttctagtcatatattattttcaaagccactgaaccacactattgaatttaattgagcttgtggtcaatttgaagatccgccacttattataaactgttttgagctgagagtccctcagcttaaacttatgccaatgatttcatttaaccaaactatacctcttgtttatccctttttctttccctcccttctctccctgccttcctccctccctccctccctctctccctcccccatccttccttttttccctttttctttcttcccctcctctcctttttccaaaaaaaaatttagaatcctagccttaccaccaaaatatgtttccaggtattgtatacacttaacaaagattcctcccttatttttatacatactgatgtaactgggaaatttcaagaccgagttgagtgctcccttttcctcattccttcaacttaattttttattaatcaacctctttggggttagtgttcaactagtgcattacttaattgttctatcaaccagtccactttctctggcttatctagtagacatcattaagtaattatttggaaaaatcccactgtgtgccaaattgggcagatcaaacaacgttattatacagaaaacaaggtaattaggcctggactcctgcttcctggagcagtgataaatccatggaatgttttcagtggattcagagtattctgttctggaaaggaagcctctgctttgagaatgacattcaagacagtagtgcagaggagatcagcatcacagggcaagttgaagagctgatgaagctaagcagaaaagtaaagcaaaaccatatttttagtagagatggggtttcaccgtgttagccaggatggtctcgatctcctgacctcatgatctgcccgcctcggaaccccgtctctactaaaaatacaaaaacaaaattagcctgtcatggtggcgggcacctgtagtcccagctacttgggaggctgaggtgggagaatggcgtgaacccaggaggcagagcttgcagtgagcagagatcacaccactgcaatcctgcctggacgacagagtgaggggctgtctcaaaaaaaaaagaaaaaaaaagaaaagaaaagaaaaaaagaaaagagagagagagagaaaagcaaaaccaaacaaaaccaaactatatctctggacattttgtgacctaacatttacattagttttgttgcgtgccttcactttatattcctcattacaatgtcatgaggctttaaaaactagcttttttattaaaaaaaatagaatgtaaaaatagaggttaaatattatcagcccttggaaaggaaaatgtagaaagaattttcaactaggtgaaggccagtgggcggtggggcctgatgggaaacgctgggagcttcatgccacaggacaggagaagtaagaattacttaaactacacctagtactttacataaggaacatttttgcttcaaccacttcaattatatgggtatttaaaatatatatatacatgcatatacacatatgcacacacacatcttccttgtaagttagcctggtaaattttctttgtataccagttttctgataaatatcctatatttataaagcatatcaagacaatgttttgaaaaagatcaccaaatcctgagttcctgggcgaatgccagaaggcgcacaataaaatggtcccaacaggttcctctgccttccttattactgaggaaaagaaagtcattggagagaatcggcctccattacttttcactcaaaaataatctttgctagaatcttttggtaaaactacca

SEQ ID NO: 596 - DNA, 28846 bp, Homo sapiens
aaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaaggga

SEQ ID NO: 597 - DNA, 7825 bp, Homo sapiens
aatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggac

SEQ ID NO: 598 - DNA, 29518 bp, Homo sapiens
aaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaaaatgaaccatgaaggaagagacactacatggacagaaaggggaggtgggaggaggaagttggaggaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctggtcagacacaaagggctcagacccaccgcctggacccctccactggaatccccccggctctaaaaggctctcggcttctctggaacagcaagtcagtttagctcttccagtggagaggtgggaattaaaggatttggggaagatagtttgaagagccttcctttaggcgagggcctgacagtc

SEQ ID NO: 599 - DNA, 12209 bp, Homo sapiens
aatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagt

SEQ ID NO: 600 - DNA, 27631 bp, Homo sapiens
aaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtgga

SEQ ID NO: 601 - DNA, 8856 bp, Homo sapiens
cagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagt

SEQ ID NO: 602 - DNA, 13275 bp, Homo sapiens
atcctactgggtcataaaacaatttttgcatatcacaacctatgacatatcaaaatgcctattagtaatagctcatgattctttggttcaatcattcaatttattaatttataatacatttattacttaaaagttttgactgggaagaaattttcttagtcctggaattatgatacaaaaaagtttcagtgtcttttgaaggaggaggttttattgtttttgcttttttagaaactcatcctcgaaagaataatgtgaacaactaatggcaattcagacagtgtaggcagaggggatcttaaaaacctttctgttcctcacaatctttgctaaatgcgtagattaataacagttatcttagtctgaatcctttaaaaagaccagagcctgaagcaaggattagagtactgacattttctttgagaggtgcaagctcaggaaatgaagatgagagaagaaaaggggatggacaatcttgtggcaaggaaaaatgtgaggaaatgcaaaggatgtgttgttcgtgatatgcctttcttctgcataccagattatctggaaggtttgcaaagggaaaacatacttccattgccattccctgatgggagaaataataataaattatctgtcttatcccttcctgttcctgtttcccatatatctagactcatgccgagaggaactaactttcccacatggctgagcttcattagctgaccccagtggctgctcaggaagccatatctgaaggctaaaattggccttgggaattaaacactttaccaatgccaatgcgtgggtccaagggtcaagaagcagagagtcaaaggtatggttagagaaaatgtgttacaagcaaaaaacactgtggggcctgtaatcccagcactttggaagaccgaggtgggcggatcacgaggtcaggagatcgagaccattttggctaacaaggtgaaaccccgtctctactaaaaatacaaaaattagccgggcatagtggcgggcgcctgtagtcccagctgctcaggaggctgaggcaagagaatggcgtcaacccaggaggcggagcttgcagtgagccgagattgggccactgtacaccagcctgggtgacagagcgagactccgcctcaaaaaaaaaaaaaaaaaaaaaaacaacactgtggggaggcaagagtgttattacaagatacttttccaagaccaaagctgaaggatacacttaagcctagtaggaaatgtgtaggagcagttggtgtttgaggaaagtcatgagaggtaacataaagagactgagattcacatgctatttctgtgataaagaaatgttaagtaggcaggatgctttcttcgaatgaccttttaaaacaaaacaaaaacaaaaacaaaaaacctgattttgctagtgatgtcttctcaaatgcttccctagtttctgggcaaagatagatgaagcaatgatagcatcccataagtgattgctaaataaataaagaaccatttcagtgccttctgagagcagataaaaggatgctgtgtctttatacattagcaaagtattaaaatacccaataatcaactagtttgaaaatgtccaaaataagttaacataaaatatcagcttttagattttggaaaagtttattttcaagaagctttttcctgaactgggccataaactataaagaaaagtctccatgaaaatgcactctaactttgcttgcaaaataagccaagctgttagaaaccttgtaaggcaccaatttaatatctccctctgacccagttcttagaaatgttatcaagttacctattaatataacttactagtgcaaataccctgaatgtggagtacttataatattcaggttcctataaaaatagctattgcctccccaaaagtagagcaagtcttccctatcccacaacctaaatctaatttgacagacattattaattcagattaataatgccagagaatctagtgcattaaaaaagaaagccttgctaaggaaaaaaatcatttattgggcaggaaccaagaaggtaaggtcctaaaatctaaaacaccttagttccctgacttaaaaaaaaaattaaaatcacattaagcaaattggagaactctaacttctaacataatcaaatgatttgcaacacttatgagccgcattttacgcccgggtctcccaggccttgcccttaatgcaaacttacctttatacctctgaattcacctgagacaatgcagtagaaatgattctaaataatgagtaggacttttaaacatagttttacaggtaaaaatgatggcatatttcttctcagtcactgaaatggggcaaaatggaaacaacaatcaagatattctttctggaatggtcacagattgtcacttagctgcacaaaaatattagaaataaaataattgttatacgaatatatctgttcgtagtggatgtcgaagtgtactgtcaaaaagtagcaaattaaaactccatatccatgtatatggcatgcaccattcacccagttcctcatatcgaaattcttgaatcacctccatatgcagtccctcaacaaaattctccactcaaaatacatttgatctactttcttctactactctaaatattcatctgcttgcccaagtcaccatcatctctccctagacacaaggtccaccttccattcttgacccctctaatctatgtcccaaattgcagccagagtgatcctgttaaaacacaagtcacattctaactgcttaaatcctcttttggcttcccattgcccagaaaatggaactcactcctgttcaccaggccctatatccttcctcatatcttgtcactcacccccagtcactgaactcaaggcaaacctaccttcctgaaagacaccaagagtcctcctgcttcagagcctgtactctttgctgtctctcttcttttaacttcatgcaagcctctgcctaaatgtcatttcattggagtaggcttccctgaacactctattaaaaatagcagtttctattattcccaatcaccacatctactccaattttcttcagcacacttaccaatatcagaaatcagaacatatatgaatttgtgtattacctgtttttccctaaaaaatataactttcatgtgggctgagattgtgtagatcttgttgattgctttatcccagcacagtgcctcacacttagtaggtggttaatactcacctcccttctatgacatgctgctgtctttctttagaatattctgggtaagcattgacaagcagaaattatctcggtaatgcccccatgtaattctaagggaaatctgtactctaagaaattcaaggtcttacgtgcttacaaaacaaaacaaaacaaaacccagattacctatttaggaataataaaaacatcaacattattaattaaaatgtttgtgttataaattaccctatggaccgctcaaaaaaaatgtggaaatgccatgttcccagacgggcatttactcagagaataagatttatgaaaagactttaaagcttagcagtgttaggaagaatagaaagtaaaagttcaggaacaaaaaggagatatattcattaatttctccacatataatgatgtaaaaacaaaataaaacaacccaaaatacactgtttttagtaaaactatgactaatgcagaggaccccaaataatacaaaatgatttataataatattttttaaattaatagaaagtaaggatgagctaagaggtagaaagtttaaaatgggaagaaatatctcaattttttgttgtaagtaaattgtgatcggctctgcaagaatctctttattctttaccaaaaactccattactggtgtttatgtagctgggtttagttgttctcagataactatcaaacgtaaattatcttccacaaatttgagtgctactatcgccatcataaagttgtattgagggcctaatatgaacctcatgctagcttgggggaaacaaaacatattatgtgaccctgacgaccgtaacctttacgaaagtcaaaatttattaaaaaaaaaaaagggctctgataagtgctaaattaaattacggacaaattctgtcacattgctttagtttcctggactagtatcactgagttgaaacatatcattattttaatcataaatatttcactataggcttctactttaacatgtctaatataaattactgtacattgtgtaaaataatttataaactttctaagggatgagaaaatcagccttctcaaaaagatgtgtttgcattgcaaaaggcaagtaatatgctttgatcaatttgatgtgaaacataaaaagcttctttcatagaaaacagataccaggcatacaattttaattgaagagaatttttgttacttcttaatatttcaagggaacacataccaaaaggagctgtaagtcagttattttattattacctttggctattttactattacatttcaataagataatgaattttcctttggggaaaaaaaagttttcaatgcttaacaaatgagatcattctaaattaaattatctgcctgaaaagacactattttaataaatatttgattgaataaaagttattttcctccacatacacaaatgttattgcatccttgctttttgaaacaacgggctttatatcaaaattttatatctttttttaggcatacatttttttcccagagtttagtagcaatctttttctctatatatttcagtccttgaaacatattgtgcacattcagtgttataaccttgtcactcaaagagctgatacaacacaaagtgatttcaccaaaaataatggaaggatagacattatttttggttagaaacagtttttgctgtttttttttgagacagtcttgctctgttgcccaggctggagtgcagtggcacgatctcggctccctgcaacttctgcctccctggttcaagcgattctcctgcctcagcctcctcagtagctgggattacaggcgtgcaccaccaatcccagctaatttttgtatttttagtagagatgggggtttcaccatgttggtcaggctggtcttgaactcctgacctcctgatccacccaccttggcctcccaaagtgctgggatcacaggtgtgagccaccacgcccagctagaaacattttttaagaagaagaatattgtgcttgtcatgttcagtttcttgaaccgggttataggagtgtgttaagttatgaacattcaataaaacagcaatcataataataaagagtaactagtttattaaaaagttcaagaagcactgtattttgtcagtgtctggaaaaataacaccaaatgtgcctttctttgtggatactccatttaggaaaaggtacaaattggaaatgaaaaggaacgtggtatgggagtggagagaaaaagaagtatttgaaaagaagtctcagaaatcatggatagaaaataattaatgattattactatgtaagtagtgcatgtcttagaatattgcacacacaactgaggggttttagcaaaaaatacattacccagaaaggaaaatgtaaagcagaagcagtgtgctaaattgctgttgccctctcctgatctcccaattagtgagcacttagccaactctcttgaaagcaaatacctctaaggagggtgtcacttaattattcatattttattaccaattactttaatcagatggtttcttcataacatttggctgaatcagctaaatttggaaatgttatgcataccatccaagagtataaagaggcacatgtgtgattttagaaaatgggttatttgaaggaaacttgctccagatatgtttgttgaaatcattgagggttttcatgttctgcttgaaaacttaacctttaggagtggatgaccaatccaggagatgggctttcagagtcacttgatgttgcaaagttgatcatttaaaaggttactttaatacttccttaaaacaagtgtaactaattcaactctcaggaagcttaagatggcctgggggaagggaaataccttaagtaatcctaacgaaagctaagtctgtgctttatggttggaggcacatgcaggcaaaatggtgaaaccattgctctccttcaggctccatgcacttttagataaacatccaaacatcctcatattgcctcaggctattttcatagggccaactccctgggacttagaaaaatcctatcttttccattaaaatgtcaattccttcacaggatagaagaaatttaaaaattattgtgtttgttttttgtgtgtgtttctttccattgtaaaaatttgttaattttagaaaggttttagttgtttgctttagcaaaggtgttttctttaattaaaggtcactccttgaaccaaaagtttaagtcgccagtgaattatttgtggcccaaattatttatatgaataattatgtgaaaagagtagaaatgttgtcccaaacactttcatctcccaactcttttcctctgactgtcctgcattccataatgtttcattgtatcataaaaccctagcacatattttatgatttttccactgaggtaaaaaaaaatgtttaacattcaattggcaaagtgatgtttacctaccaagaatatttttgcataggggaacaaaacaaaatagctaaattgaaatcccttctttactatgaaatcattttgtgatcctgaagaaggtactcttttttctagaacttcatttccacatcagtaaaatagagacaattatatccaacatagaaggccattgtgaagaaaaaatgagatggtgcatagaaaatgacaataggtgttgtttttattttccttagtatcttttctgcttccctggcacttaataaaacctactaagtgtcttatcctaataacctatgaagattgctactatttcatttagaataattgttcatacagattataacaccttccccacacacacacgcttgcagttctgcttttcaataattacgtagttattcaatggtttgataaaatattgccttgcatagaggatattaaactcatgaaactgagaggtgacagcgtgctggcagtcctcagagccctcgcttgctctcagcacctcccctgcctgggctcccactttgtggcatttgaggagcccttcagccccccactgtactgtgggagcccctttctgggctggccaaggccggagcccactccctcagctttcagggaggtgtggagggagaggcacgagcgggaaccggggctgcgtgtggcgcttgcggggcagctggagttccgggtgggcgtgggcttggtgggccccgcacttggagcagccagccagtcctgctggccccgggcaatgggggacttagcacccgggccagtggctgcggagggtgtactgagtcccccagcagtgctggcccaccagcgctgcgctcgatttctcgctgggccttggctgccttcccgcagggcagtgctcgggacctgcagcccgccatgcctgagcctcccacccactccatgggcccctgtgcggcccgagcctccccgacgagcaccaccccctgctccagggcaccgagtcccatcgaccacccaagggctgaggaatgctagcgcagggcacaggactggcaggcagttccacctgcagccccggtgtgggatccactaggtgaagccagctgggctcctgagtctggtggggacgtggagagtctttatatttagttcagggattgtaaatgcaccaatcagcaccctgtgtttagctcaaggtttgtgagtgcaccagtcgacactctgtatctagctgctctggtgaggacgtgcagaacctttacatctagctcaaggattataaatacaccaatcagcactctgtatctagctcaaggtttgtaaacacaccaatcagcaccctgtgtttagctcagggtttgtaaatgcaccaatcgacactctgtatctagctgctctggtggggccttggagaacctgtgtgtctaaactctatctaactaatctggtggggatgtggagaacctttgtatctagctcagggattgtaaacacaccaatcagcaccctgacaaaacagcacacttggctctaccaatcagcaggatgtgggtggggccagataagagaataaaagcaggctgcccaagccagcattggcaacctgctggggtccccttccacactgtggaagctttgttctttcactctttgcaataaatcttgctactgctcactctttgggtccacgctgcttttatgagctgtaacactcacagcgaagatctgcagcttcactcctgagcccagcgagaccacgagcccaccaggaggaacgagcaactccagacgcgctaccttaagagctgtaacactcaccacgaaggtctgcagcttcactcctgagccagcgagaccacgaacccaccagaaggaagaaactccgaacagatctgaacatcagaagggagagactccagacgcgccaccttaagagctgtaacgctcaccgcgagggtccgaggcttcattcttgaagtcagtgagaccaagaacccaccaattccggacacaaaaccaaacgctccaacaattttaagtggcgactggcaaccaatggtgataggacatacgtgtgattgtttcatttctgcctatagctacaccattattctctctgggtcttagtttatggctttgtaaaaaattagatgaccactgcaattatttctagcttaataattctaaaatttatgatctataaataatctattcctacccctgatgattttcccttttttggcatttagcaggcttgataattgcttctttatttagctctctcttgtgagagattctgcttttaaggggacaaacttacctgttttgttaattattttatctccaacagttagcacagtgcctgacatgtagtagtctcttaaaaactacctgcagaactgtaatgtattggcttaacaaatgaataatacccaatgtattattatagagaagataatagaagtcaattaattttaaagtatttaaataaaattctatttgccctaaagcaatgtattttctgtataagttatgtaccctctggaattaagtgaataagtccctatgtatccaatattacactcttgccatttttatttatatatctgtcttttctactagaacttcttagctattggaaggcctatctctggcctttggtatctaacatatttttttggccacgtatactagaatactctacaattttccattgaaagaatctcaattatatacttataaatataattgtcttaattcttcaaaattaattttgcttatatccttttcatttgactcttggatctatgtcaatactgatttctaaaggtttcataaaatagagtcagcctttatggcaaacatattgttgtctaggttatagtacacagaccagctggtatttttcaatgacatgacatcttgattaaaggtgtagaagatgctatcctgtgaaaaggctttgaaaatgtgggttctgtgtctgtatatttttatatacatataccgaaacagtattttgttcccatgttctcttagaacaagatcatttgtatgtgaattttcttctacctcttccatccctaagacagcaagaccaagtgctcctctcttcctcctcagcctactcaatgagaaaacaaagataaagaccattgtgatggtacacttccacttaataaatagtaaggatattttctcttccacatgactctcttttcatttctttttttatttgtttgtttttgagacaaagtctcactctgtcacccaggctggagtgcagtggcaaaacatggctcactgcagccttgacctcccaggcttaggcaatcctcccaactcaagtctcctgagtagctgggactacaggcacatgccatcatgcctcactaatttttaaattttcttctgtagagatgaggtgtccctgtgacgagcccaggctggtctcgaactcctgaggtcaagagatcctcccctcttggccttatgattttcttcataacagtttcttttctttatcttactttattggatataatacatacaacatacaaaatatgtgttaactgacaatttatgttactggtaagacttctggtcaacagtaagctattagtagttaagctttggtgaagtcaaaaattatacatgggttttcgactgtgtagggttcagtgcccctacccactgggttcttcaagggccaactgcacaattaattcatgatatggagttagaagggtagaataaaggacttcaaagtgccttcctaagtctaaacaactatgaaataagagaaaaatttttctgtcctgaccacagaaaattgttcaagacatactttaagtgaaaaaagtaagttgtaaaactgtaggtacatagtggtagtattttttgtaaacatacaagattttaaatttattcttatttctaatatttaaagaaaaacatacaaaatgttaaagtcgttcattacctagttggaaattcactcaaataggaacatcctatttgtaattgcaaccatttgcttaagaaaataatggtaatcacttatagagtgctccattcaagcatttttaggaacattaactcatttaatactcacaacaactctacaaagtgatggtcattatcacctctttttgcagacgaagaaattgaggtaagaaaagcaactttcttgctcaaagtcacatagagctaatgattagtggagctgagcttcacagatagattctttggctcagaggccagttttctccaagctcacttcctacactatgctgccctatgctcttccctcggcagcccactccaaacattaacctgatgtttatgctaatcaacaatttgattttatatttacttactatccatgtattttacaaataatgctttgagcaccaattatgtgcaaaacacagctttatctccagtaactggtaagtccagcttttcagtttgttcccagtaatagctagccaaaaatttatcagtccttcccccgatcctgatctagtcatttcacacccatttctaacatcaccaatattggtaaaaaataagaggcatttgaaggctgctgggagagatataaaggcacctacttcaataccctccagaaggctgcaatttcccaaactcctttcaggcaactcaaaatgctcgtgtattagaataggtactgtatgcatacctacagtgaattgttagaagagactactgacaggtataggaggttgagctagatgactcctcaggttcatccagataagtgtggaaagagccagttacttactaactgccttggaaagaacagcactttccccaggaatgaagactagtaataaggtcaacaaactgcaaaaaccaaatgactcctccctttattttttaaataaaagaagtatttaaagctgtattaaggtttccaaaggaaataagaagaaaggttaacaggaaagaacaaaaacccattaattctgaagcaggtaatgaaacacacacacacacacacacacacacacacactcagacgtatcaacaaaaagccagatgatccctaggagcataataggtagcagagggtgaggctgcagtccttggtttggagaataggaagattccccataatctatccgatgcctatggccaaagcaagaagttactgctatattgtgcgatcctcagttatcaaatgggcattgtacatatttttctgtgttggtgtgtttttctgtgaataaaaattactttctaccatgtaatgttaaggctatacttcaggctgtatcttaaccagtgtcttttggtctcaggaccattttggccacaaggaaaatttaaaccttgcaggacaagaggtgctgcgtctgctgaacctgcatctttgggataagggtagtatttaaacgaaggagtcaactgtggaactcctccgggtgtggagacagaaataaaataaataggtgtgtatatcccatagtgctgatatagtttcatattttttttttttttttgagacagggtctcactgtgtcacccaggctggagtgcagtggtgtgatctcagctcactgtaacctctgcctcgcaggttcaagcaattctcctgcctccgcctccttggtagctggaagtacaggcacctgccaccatgcccgctaattttgtaattttagtagagttggagtttcaccatgttggtcaggctggtctcgaactcctgacctcaaatgatctgcccacctgggcctcccaaagtgctgggattacaggcgtgagccaccgtgtccagactagtttcagatgtttaacatcagtacatatttattattattattattattattattatactttaagttctgggatacatgtgcagaatgtgcaggtttgttacataggtatacacgtgccatggtggtttgctgtacccatcaactcgtcatctacattaggtatttctcctaatactaaccctctcctagcaccccccactccctgataggccccgacgtgtgatgttcccctccctgtgtctatgtgttctcattgtccaactctcactcatgagtgagaacatgtagtgtttggttttctattcctgggttagtttgctgagaatgatggtttccagcttcattcatgtccctgcaaagtacatgaatacatccttttttttatggatgcatagtattccatggtatatatgtgccacattttctttatccagtctatcattgatgggcatttggattggttccaagtctctgctattgtgaatagtgctgcaataaacatatgtgtgcatgtgtctttatagtagaatgatttataatcctttgggtatatacccagtaaagggattgctgggtcaaatggtattgttaaataagtgaaaaaataaataaaaaaaataaatataacatatattatacaaggagtaggagagtaaaaaggatgaatttattttacaaaaaaatgagaaacatcagacggaataataggaatagaaaattataacataaaaagcatgcctctttccacatcttatataagcctcacagaagagagaatatcatgttagaaagtttaggaaaatagattaatgaaagaagacaattttttctg

SEQ ID NO: 603 - DNA, 14960 bp, Homo sapiens
atcctactgggtcataaaacaatttttgcatatcacaacctatgacatatcaaaatgcctattagtaatagctcatgattctttggttcaatcattcaatttattaatttataatacatttattacttaaaagttttgactgggaagaaattttcttagtcctggaattatgatacaaaaaagtttcagtgtcttttgaaggaggaggttttattgtttttgcttttttagaaactcatcctcgaaagaataatgtgaacaactaatggcaattcagacagtgtaggcagaggggatcttaaaaacctttctgttcctcacaatctttgctaaatgcgtagattaataacagttatcttagtctgaatcctttaaaaagaccagagcctgaagcaaggattagagtactgacattttctttgagaggtgcaagctcaggaaatgaagatgagagaagaaaaggggatggacaatcttgtggcaaggaaaaatgtgaggaaatgcaaaggatgtgttgttcgtgatatgcctttcttctgcataccagattatctggaaggtttgcaaagggaaaacatacttccattgccattccctgatgggagaaataataataaattatctgtcttatcccttcctgttcctgtttcccatatatctagactcatgccgagaggaactaactttcccacatggctgagcttcattagctgaccccagtggctgctcaggaagccatatctgaaggctaaaattggccttgggaattaaacactttaccaatgccaatgcgtgggtccaagggtcaagaagcagagagtcaaaggtatggttagagaaaatgtgttacaagcaaaaaacactgtggggcctgtaatcccagcactttggaagaccgaggtgggcggatcacgaggtcaggagatcgagaccattttggctaacaaggtgaaaccccgtctctactaaaaatacaaaaattagccgggcatagtggcgggcgcctgtagtcccagctgctcaggaggctgaggcaagagaatggcgtcaacccaggaggcggagcttgcagtgagccgagattgggccactgtacaccagcctgggtgacagagcgagactccgcctcaaaaaaaaaaaaaaaaaaaaaaacaacactgtggggaggcaagagtgttattacaagatacttttccaagaccaaagctgaaggatacacttaagcctagtaggaaatgtgtaggagcagttggtgtttgaggaaagtcatgagaggtaacataaagagactgagattcacatgctatttctgtgataaagaaatgttaagtaggcaggatgctttcttcgaatgaccttttaaaacaaaacaaaaacaaaaacaaaaaacctgattttgctagtgatgtcttctcaaatgcttccctagtttctgggcaaagatagatgaagcaatgatagcatcccataagtgattgctaaataaataaagaaccatttcagtgccttctgagagcagataaaaggatgctgtgtctttatacattagcaaagtattaaaatacccaataatcaactagtttgaaaatgtccaaaataagttaacataaaatatcagcttttagattttggaaaagtttattttcaagaagctttttcctgaactgggccataaactataaagaaaagtctccatgaaaatgcactctaactttgcttgcaaaataagccaagctgttagaaaccttgtaaggcaccaatttaatatctccctctgacccagttcttagaaatgttatcaagttacctattaatataacttactagtgcaaataccctgaatgtggagtacttataatattcaggttcctataaaaatagctattgcctccccaaaagtagagcaagtcttccctatcccacaacctaaatctaatttgacagacattattaattcagattaataatgccagagaatctagtgcattaaaaaagaaagccttgctaaggaaaaaaatcatttattgggcaggaaccaagaaggtaaggtcctaaaatctaaaacaccttagttccctgacttaaaaaaaaaattaaaatcacattaagcaaattggagaactctaacttctaacataatcaaatgatttgcaacacttatgagccgcattttacgcccgggtctcccaggccttgcccttaatgcaaacttacctttatacctctgaattcacctgagacaatgcagtagaaatgattctaaataatgagtaggacttttaaacatagttttacaggtaaaaatgatggcatatttcttctcagtcactgaaatggggcaaaatggaaacaacaatcaagatattctttctggaatggtcacagattgtcacttagctgcacaaaaatattagaaataaaataattgttatacgaatatatctgttcgtagtggatgtcgaagtgtactgtcaaaaagtagcaaattaaaactccatatccatgtatatggcatgcaccattcacccagttcctcatatcgaaattcttgaatcacctccatatgcagtccctcaacaaaattctccactcaaaatacatttgatctactttcttctactactctaaatattcatctgcttgcccaagtcaccatcatctctccctagacacaaggtccaccttccattcttgacccctctaatctatgtcccaaattgcagccagagtgatcctgttaaaacacaagtcacattctaactgcttaaatcctcttttggcttcccattgcccagaaaatggaactcactcctgttcaccaggccctatatccttcctcatatcttgtcactcacccccagtcactgaactcaaggcaaacctaccttcctgaaagacaccaagagtcctcctgcttcagagcctgtactctttgctgtctctcttcttttaacttcatgcaagcctctgcctaaatgtcatttcattggagtaggcttccctgaacactctattaaaaatagcagtttctattattcccaatcaccacatctactccaattttcttcagcacacttaccaatatcagaaatcagaacatatatgaatttgtgtattacctgtttttccctaaaaaatataactttcatgtgggctgagattgtgtagatcttgttgattgctttatcccagcacagtgcctcacacttagtaggtggttaatactcacctcccttctatgacatgctgctgtctttctttagaatattctgggtaagcattgacaagcagaaattatctcggtaatgcccccatgtaattctaagggaaatctgtactctaagaaattcaaggtcttacgtgcttacaaaacaaaacaaaacaaaacccagattacctatttaggaataataaaaacatcaacattattaattaaaatgtttgtgttataaattaccctatggaccgctcaaaaaaaatgtggaaatgccatgttcccagacgggcatttactcagagaataagatttatgaaaagactttaaagcttagcagtgttaggaagaatagaaagtaaaagttcaggaacaaaaaggagatatattcattaatttctccacatataatgatgtaaaaacaaaataaaacaacccaaaatacactgtttttagtaaaactatgactaatgcagaggaccccaaataatacaaaatgatttataataatattttttaaattaatagaaagtaaggatgagctaagaggtagaaagtttaaaatgggaagaaatatctcaattttttgttgtaagtaaattgtgatcggctctgcaagaatctctttattctttaccaaaaactccattactggtgtttatgtagctgggtttagttgttctcagataactatcaaacgtaaattatcttccacaaatttgagtgctactatcgccatcataaagttgtattgagggcctaatatgaacctcatgctagcttgggggaaacaaaacatattatgtgaccctgacgaccgtaacctttacgaaagtcaaaatttattaaaaaaaaaaaagggctctgataagtgctaaattaaattacggacaaattctgtcacattgctttagtttcctggactagtatcactgagttgaaacatatcattattttaatcataaatatttcactataggcttctactttaacatgtctaatataaattactgtacattgtgtaaaataatttataaactttctaagggatgagaaaatcagccttctcaaaaagatgtgtttgcattgcaaaaggcaagtaatatgctttgatcaatttgatgtgaaacataaaaagcttctttcatagaaaacagataccaggcatacaattttaattgaagagaatttttgttacttcttaatatttcaagggaacacataccaaaaggagctgtaagtcagttattttattattacctttggctattttactattacatttcaataagataatgaattttcctttggggaaaaaaaagttttcaatgcttaacaaatgagatcattctaaattaaattatctgcctgaaaagacactattttaataaatatttgattgaataaaagttattttcctccacatacacaaatgttattgcatccttgctttttgaaacaacgggctttatatcaaaattttatatctttttttaggcatacatttttttcccagagtttagtagcaatctttttctctatatatttcagtccttgaaacatattgtgcacattcagtgttataaccttgtcactcaaagagctgatacaacacaaagtgatttcaccaaaaataatggaaggatagacattatttttggttagaaacagtttttgctgtttttttttgagacagtcttgctctgttgcccaggctggagtgcagtggcacgatctcggctccctgcaacttctgcctccctggttcaagcgattctcctgcctcagcctcctcagtagctgggattacaggcgtgcaccaccaatcccagctaatttttgtatttttagtagagatgggggtttcaccatgttggtcaggctggtcttgaactcctgacctcctgatccacccaccttggcctcccaaagtgctgggatcacaggtgtgagccaccacgcccagctagaaacattttttaagaagaagaatattgtgcttgtcatgttcagtttcttgaaccgggttataggagtgtgttaagttatgaacattcaataaaacagcaatcataataataaagagtaactagtttattaaaaagttcaagaagcactgtattttgtcagtgtctggaaaaataacaccaaatgtgcctttctttgtggatactccatttaggaaaaggtacaaattggaaatgaaaaggaacgtggtatgggagtggagagaaaaagaagtatttgaaaagaagtctcagaaatcatggatagaaaataattaatgattattactatgtaagtagtgcatgtcttagaatattgcacacacaactgaggggttttagcaaaaaatacattacccagaaaggaaaatgtaaagcagaagcagtgtgctaaattgctgttgccctctcctgatctcccaattagtgagcacttagccaactctcttgaaagcaaatacctctaaggagggtgtcacttaattattcatattttattaccaattactttaatcagatggtttcttcataacatttggctgaatcagctaaatttggaaatgttatgcataccatccaagagtataaagaggcacatgtgtgattttagaaaatgggttatttgaaggaaacttgctccagatatgtttgttgaaatcattgagggttttcatgttctgcttgaaaacttaacctttaggagtggatgaccaatccaggagatgggctttcagagtcacttgatgttgcaaagttgatcatttaaaaggttactttaatacttccttaaaacaagtgtaactaattcaactctcaggaagcttaagatggcctgggggaagggaaataccttaagtaatcctaacgaaagctaagtctgtgctttatggttggaggcacatgcaggcaaaatggtgaaaccattgctctccttcaggctccatgcacttttagataaacatccaaacatcctcatattgcctcaggctattttcatagggccaactccctgggacttagaaaaatcctatcttttccattaaaatgtcaattccttcacaggatagaagaaatttaaaaattattgtgtttgttttttgtgtgtgtttctttccattgtaaaaatttgttaattttagaaaggttttagttgtttgctttagcaaaggtgttttctttaattaaaggtcactccttgaaccaaaagtttaagtcgccagtgaattatttgtggcccaaattatttatatgaataattatgtgaaaagagtagaaatgttgtcccaaacactttcatctcccaactcttttcctctgactgtcctgcattccataatgtttcattgtatcataaaaccctagcacatattttatgatttttccactgaggtaaaaaaaaatgtttaacattcaattggcaaagtgatgtttacctaccaagaatatttttgcataggggaacaaaacaaaatagctaaattgaaatcccttctttactatgaaatcattttgtgatcctgaagaaggtactcttttttctagaacttcatttccacatcagtaaaatagagacaattatatccaacatagaaggccattgtgaagaaaaaatgagatggtgcatagaaaatgacaataggtgttgtttttattttccttagtatcttttctgcttccctggcacttaataaaacctactaagtgtcttatcctaataacctatgaagattgctactatttcatttagaataattgttcatacagattataacaccttccccacacacacacgcttgcagttctgcttttcaataattacgtagttattcaatggtttgataaaatattgccttgcatagaggatattaaactcatgaaactgagaggtgacagcgtgctggcagtcctcagagccctcgcttgctctcagcacctcccctgcctgggctcccactttgtggcatttgaggagcccttcagccccccactgtactgtgggagcccctttctgggctggccaaggccggagcccactccctcagctttcagggaggtgtggagggagaggcacgagcgggaaccggggctgcgtgtggcgcttgcggggcagctggagttccgggtgggcgtgggcttggtgggccccgcacttggagcagccagccagtcctgctggccccgggcaatgggggacttagcacccgggccagtggctgcggagggtgtactgagtcccccagcagtgctggcccaccagcgctgcgctcgatttctcgctgggccttggctgccttcccgcagggcagtgctcgggacctgcagcccgccatgcctgagcctcccacccactccatgggcccctgtgcggcccgagcctccccgacgagcaccaccccctgctccagggcaccgagtcccatcgaccacccaagggctgaggaatgctagcgcagggcacaggactggcaggcagttccacctgcagccccggtgtgggatccactaggtgaagccagctgggctcctgagtctggtggggacgtggagagtctttatatttagttcagggattgtaaatgcaccaatcagcaccctgtgtttagctcaaggtttgtgagtgcaccagtcgacactctgtatctagctgctctggtgaggacgtgcagaacctttacatctagctcaaggattataaatacaccaatcagcactctgtatctagctcaaggtttgtaaacacaccaatcagcaccctgtgtttagctcagggtttgtaaatgcaccaatcgacactctgtatctagctgctctggtggggccttggagaacctgtgtgtctaaactctatctaactaatctggtggggatgtggagaacctttgtatctagctcagggattgtaaacacaccaatcagcaccctgacaaaacagcacacttggctctaccaatcagcaggatgtgggtggggccagataagagaataaaagcaggctgcccaagccagcattggcaacctgctggggtccccttccacactgtggaagctttgttctttcactctttgcaataaatcttgctactgctcactctttgggtccacgctgcttttatgagctgtaacactcacagcgaagatctgcagcttcactcctgagcccagcgagaccacgagcccaccaggaggaacgagcaactccagacgcgctaccttaagagctgtaacactcaccacgaaggtctgcagcttcactcctgagccagcgagaccacgaacccaccagaaggaagaaactccgaacagatctgaacatcagaagggagagactccagacgcgccaccttaagagctgtaacgctcaccgcgagggtccgaggcttcattcttgaagtcagtgagaccaagaacccaccaattccggacacaaaaccaaacgctccaacaattttaagtggcgactggcaaccaatggtgataggacatacgtgtgattgtttcatttctgcctatagctacaccattattctctctgggtcttagtttatggctttgtaaaaaattagatgaccactgcaattatttctagcttaataattctaaaatttatgatctataaataatctattcctacccctgatgattttcccttttttggcatttagcaggcttgataattgcttctttatttagctctctcttgtgagagattctgcttttaaggggacaaacttacctgttttgttaattattttatctccaacagttagcacagtgcctgacatgtagtagtctcttaaaaactacctgcagaactgtaatgtattggcttaacaaatgaataatacccaatgtattattatagagaagataatagaagtcaattaattttaaagtatttaaataaaattctatttgccctaaagcaatgtattttctgtataagttatgtaccctctggaattaagtgaataagtccctatgtatccaatattacactcttgccatttttatttatatatctgtcttttctactagaacttcttagctattggaaggcctatctctggcctttggtatctaacatatttttttggccacgtatactagaatactctacaattttccattgaaagaatctcaattatatacttataaatataattgtcttaattcttcaaaattaattttgcttatatccttttcatttgactcttggatctatgtcaatactgatttctaaaggtttcataaaatagagtcagcctttatggcaaacatattgttgtctaggttatagtacacagaccagctggtatttttcaatgacatgacatcttgattaaaggtgtagaagatgctatcctgtgaaaaggctttgaaaatgtgggttctgtgtctgtatatttttatatacatataccgaaacagtattttgttcccatgttctcttagaacaagatcatttgtatgtgaattttcttctacctcttccatccctaagacagcaagaccaagtgctcctctcttcctcctcagcctactcaatgagaaaacaaagataaagaccattgtgatggtacacttccacttaataaatagtaaggatattttctcttccacatgactctcttttcatttctttttttatttgtttgtttttgagacaaagtctcactctgtcacccaggctggagtgcagtggcaaaacatggctcactgcagccttgacctcccaggcttaggcaatcctcccaactcaagtctcctgagtagctgggactacaggcacatgccatcatgcctcactaatttttaaattttcttctgtagagatgaggtgtccctgtgacgagcccaggctggtctcgaactcctgaggtcaagagatcctcccctcttggccttatgattttcttcataacagtttcttttctttatcttactttattggatataatacatacaacatacaaaatatgtgttaactgacaatttatgttactggtaagacttctggtcaacagtaagctattagtagttaagctttggtgaagtcaaaaattatacatgggttttcgactgtgtagggttcagtgcccctacccactgggttcttcaagggccaactgcacaattaattcatgatatggagttagaagggtagaataaaggacttcaaagtgccttcctaagtctaaacaactatgaaataagagaaaaatttttctgtcctgaccacagaaaattgttcaagacatactttaagtgaaaaaagtaagttgtaaaactgtaggtacatagtggtagtattttttgtaaacatacaagattttaaatttattcttatttctaatatttaaagaaaaacatacaaaatgttaaagtcgttcattacctagttggaaattcactcaaataggaacatcctatttgtaattgcaaccatttgcttaagaaaataatggtaatcacttatagagtgctccattcaagcatttttaggaacattaactcatttaatactcacaacaactctacaaagtgatggtcattatcacctctttttgcagacgaagaaattgaggtaagaaaagcaactttcttgctcaaagtcacatagagctaatgattagtggagctgagcttcacagatagattctttggctcagaggccagttttctccaagctcacttcctacactatgctgccctatgctcttccctcggcagcccactccaaacattaacctgatgtttatgctaatcaacaatttgattttatatttacttactatccatgtattttacaaataatgctttgagcaccaattatgtgcaaaacacagctttatctccagtaactggtaagtccagcttttcagtttgttcccagtaatagctagccaaaaatttatcagtccttcccccgatcctgatctagtcatttcacacccatttctaacatcaccaatattggtaaaaaataagaggcatttgaaggctgctgggagagatataaaggcacctacttcaataccctccagaaggctgcaatttcccaaactcctttcaggcaactcaaaatgctcgtgtattagaataggtactgtatgcatacctacagtgaattgttagaagagactactgacaggtataggaggttgagctagatgactcctcaggttcatccagataagtgtggaaagagccagttacttactaactgccttggaaagaacagcactttccccaggaatgaagactagtaataaggtcaacaaactgcaaaaaccaaatgactcctccctttattttttaaataaaagaagtatttaaagctgtattaaggtttccaaaggaaataagaagaaaggttaacaggaaagaacaaaaacccattaattctgaagcaggtaatgaaacacacacacacacacacacacacacacacactcagacgtatcaacaaaaagccagatgatccctaggagcataataggtagcagagggtgaggctgcagtccttggtttggagaataggaagattccccataatctatccgatgcctatggccaaagcaagaagttactgctatattgtgcgatcctcagttatcaaatgggcattgtacatatttttctgtgttggtgtgtttttctgtgaataaaaattactttctaccatgtaatgttaaggctatacttcaggctgtatcttaaccagtgtcttttggtctcaggaccattttggccacaaggaaaatttaaaccttgcaggacaagaggtgctgcgtctgctgaacctgcatctttgggataagggtagtatttaaacgaaggagtcaactgtggaactcctccgggtgtggagacagaaataaaataaataggtgtgtatatcccatagtgctgatatagtttcatattttttttttttttttgagacagggtctcactgtgtcacccaggctggagtgcagtggtgtgatctcagctcactgtaacctctgcctcgcaggttcaagcaattctcctgcctccgcctccttggtagctggaagtacaggcacctgccaccatgcccgctaattttgtaattttagtagagttggagtttcaccatgttggtcaggctggtctcgaactcctgacctcaaatgatctgcccacctgggcctcccaaagtgctgggattacaggcgtgagccaccgtgtccagactagtttcagatgtttaacatcagtacatatttattattattattattattattattatactttaagttctgggatacatgtgcagaatgtgcaggtttgttacataggtatacacgtgccatggtggtttgctgtacccatcaactcgtcatctacattaggtatttctcctaatactaaccctctcctagcaccccccactccctgataggccccgacgtgtgatgttcccctccctgtgtctatgtgttctcattgtccaactctcactcatgagtgagaacatgtagtgtttggttttctattcctgggttagtttgctgagaatgatggtttccagcttcattcatgtccctgcaaagtacatgaatacatccttttttttatggatgcatagtattccatggtatatatgtgccacattttctttatccagtctatcattgatgggcatttggattggttccaagtctctgctattgtgaatagtgctgcaataaacatatgtgtgcatgtgtctttatagtagaatgatttataatcctttgggtatatacccagtaaagggattgctgggtcaaatggtattgttaaataagtgaaaaaataaataaaaaaaataaatataacatatattatacaaggagtaggagagtaaaaaggatgaatttattttacaaaaaaatgagaaacatcagacggaataataggaatagaaaattataacataaaaagcatgcctctttccacatcttatataagcctcacagaagagagaatatcatgttagaaagtttaggaaaatagattaatgaaagaagacaattttttctgtgaatttgcagaaaatcattgctagatagtagccacaaggtaataatttagacagggcaaagctaaatataaaattatattttttaaaagttatgtgacaaatctttaatatctaattgaacttatacggttttatagtaataaaataagtcaaaattggcagatggctggcatcatgcaaactatattgtctgggttttgtttatttttgttcagcttggtttgctttattttttaatataatttctgagcatcagataattgtaaatcttattagtggctagaaaacaaaaacagtttgcttaaaagcaacggagtattaggtttatcaaagtaattttaaaatttttgttgtatttctctaatagcaagattgatttgaaaaaaaattcaattaatgctgctataagaactcagaaaaaaattagtatatttggtgatattaccattgcctaaaaaccaaaagtaaatttatgtttcccttccttccttccttccctcccttcctccctccctccctccctttcttccttccttctctctctttctttctttctttcattctttcttttttgttgttgttgttgttgttttttgtttttcatggagtctcgctctgtcaccaggctggagggcagtggtgcgatctcggctcactgcaacctccgcctctgaagttcaagtgattctcctgcctcagccccccgagtagatgggactacaggcacgcaccaccatgcccagctaatttttgtattttttagtagagacgggatttcaccatgttagccaagatggtctcgatctcttgacctcgtgatctgcccgcctcagcctcccaaactgctgagattacaggcatgagtcaccacgcccggcctctttctttctttctttccctctttcacaaaatcttgctctgtcacccgggctgaaatgcagtggcacaatcacaactcactgcagcctccaccactggcactcaagcaatcctcccacctcggcctcctgaatagctgagactacaggcatgtgccaccacacccagctaaattatatatgtatattttaaagagatgtggttttgccatgttgcctaggctggtcttgaactcttgggcttcagcaatccacccacttcaacctcgcagagtgctgggattacaggcatgaaccaccatgcccagactcatgtttgaccacaattcttatggcctctttaccttcttcagagtttattgttaagacaagacagagagtaactttaggctacatttttttttagagaaacagttttagatttttctgtaaacagtacaggaataagctgaagtcctacggagtaagacacttatttcacttatttactgaaaaaaagttcacaagattcttctttgtatttcttttgtgttgcagatcctgtcaataaagtgttgataactagagaaggtaataggagacaatacatctgtaacctgtcactaacatggcaaggaaacagaccctcacactattgaaaagctaaaagagaacacccacagactattatgattgtatccagaagtcctgaagaaattgtttaaaaagcatcagaatgacatgggtagagacacaagattatgaaggaaattctggagtgtgggaaaggtcttaattcattgtatctgtagtgtagcttgacatta

SEQ ID NO: 604 - DNA, 15290 bp, Homo sapiens
ctatgtcaccagttcatctatccatgtaaagataaaaccaatatctgcaaaaacccatgaatacttagtttcatcctgacataaatgaagatatatttcacaatatttacaatcattagaccttataactgagagaactgcatataaaacactaaactatatgttaggtaaaatataaataaaattcttattacaaaaccgatatattaaaatctatgtcaaaattacaatgcgtatgataaagatttggtcgtctctccttacgcgcttagttttcaagctagcaattatgtgaacatatattcaacttgcatcagtgtactgtccttgatttcttaaaaatccaaatttgtactttagccttggttgtcattttcttaaggatatctcattgctttgaatactcttcatgtgatatgtagtatgagtaaggtgggtcattaaagcaagatggcagagggagaataaaaatgaggaattactggtcctaaaattcaaagaaaaagatgttactatagaaaattttacgcaaagggcgggaaaacaacattttgttacagtttataaaagaaaccatgctatgtggttaactaaaaggcaaagtattgacctgatagtatattagactgtttcaattcaaacctacatttagacatttctgagaacatttcactcccaccacaaggactggggagagagaactcaaacctttaaaagttatgaattagaacccctactaatggatctctctattagcctcacaacttgcactcaggtcctctaagaaaataggtgacacaattgaaactattcagcctgtttgttgcctcctgaactattgagggtaacccttaaaatgttttcgtctacctggctagttcaaattaaaaacagcaaaatatcttttttaaatatttatttttcttgtcactgaacttactttttacattcagataataagaccgacaatcacatagcaataaaaataaaattaccagacacagtaacttaatattgtcttaataatatatgtgtgtgcatatatgctataaatacttatatcattaaattataaatattaaatgtaaatattcatattatatattatataaatgcatatatgtagatatatgtgaaaccataatcataagtcatctagcataataacaaaccctctagtatacaaaataccataaggtaaattatagacaccgtttatcaattatcaattaaggtttggacatatctgaaattttggtttatcatagcaattttcacatactgtattccttaagtaaaggaaatgataaaaacctaggatctcagtattccgaatgcacatctaccactgcagcttctatacttgattcccaagaagtcctgggatattaaatatgttcaaatatcaatttctctggcaagagtacatgttaaagatacaacaccaagaggaaataaatacatattaaacttatcaggccacaggaaatgacatacattccaagacgctactgtggcacttcatgataaggatttttgcctcacctaatacatttatacattcattattttaggtaacagtctcacagcaactctcattacaaaatgaatacaatacacataagacttccaacaaatagcagatgctagagttcatagaaaggcattgtattataaaaatgtatttttatccttccctaatattctctgatggaagtatttacttaattttgtcacttcagtcaattacggtatatttacaaagctggcttgtcttttattaagaaattagtgttcatatgtgtaacaatttgaacacgtaattatgatatctaattatataattagagtatgttgaaatgatcaaaatcttcattatcttattgattttaaaagagtgtgagatatttcttaagcatctcaagcatcacttacaatattgtcttccaaattgcttactttccaaagttaataagacttgaaagacaaagagaagctaatgacagaagtcacgtatcctactgggtcataaaacaatttttgcatatcacaacctatgacatatcaaaatgcctattagtaatagctcatgattctttggttcaatcattcaatttattaatttataatacatttattacttaaaagttttgactgggaagaaattttcttagtcctggaattatgatacaaaaaagtttcagtgtcttttgaaggaggaggttttattgtttttgcttttttagaaactcatcctcgaaagaataatgtgaacaactaatggcaattcagacagtgtaggcagaggggatcttaaaaacctttctgttcctcacaatctttgctaaatgcgtagattaataacagttatcttagtctgaatcctttaaaaagaccagagcctgaagcaaggattagagtactgacattttctttgagaggtgcaagctcaggaaatgaagatgagagaagaaaaggggatggacaatcttgtggcaaggaaaaatgtgaggaaatgcaaaggatgtgttgttcgtgatatgcctttcttctgcataccagattatctggaaggtttgcaaagggaaaacatacttccattgccattccctgatgggagaaataataataaattatctgtcttatcccttcctgttcctgtttcccatatatctagactcatgccgagaggaactaactttcccacatggctgagcttcattagctgaccccagtggctgctcaggaagccatatctgaaggctaaaattggccttgggaattaaacactttaccaatgccaatgcgtgggtccaagggtcaagaagcagagagtcaaaggtatggttagagaaaatgtgttacaagcaaaaaacactgtggggcctgtaatcccagcactttggaagaccgaggtgggcggatcacgaggtcaggagatcgagaccattttggctaacaaggtgaaaccccgtctctactaaaaatacaaaaattagccgggcatagtggcgggcgcctgtagtcccagctgctcaggaggctgaggcaagagaatggcgtcaacccaggaggcggagcttgcagtgagccgagattgggccactgtacaccagcctgggtgacagagcgagactccgcctcaaaaaaaaaaaaaaaaaaaaaaacaacactgtggggaggcaagagtgttattacaagatacttttccaagaccaaagctgaaggatacacttaagcctagtaggaaatgtgtaggagcagttggtgtttgaggaaagtcatgagaggtaacataaagagactgagattcacatgctatttctgtgataaagaaatgttaagtaggcaggatgctttcttcgaatgaccttttaaaacaaaacaaaaacaaaaacaaaaaacctgattttgctagtgatgtcttctcaaatgcttccctagtttctgggcaaagatagatgaagcaatgatagcatcccataagtgattgctaaataaataaagaaccatttcagtgccttctgagagcagataaaaggatgctgtgtctttatacattagcaaagtattaaaatacccaataatcaactagtttgaaaatgtccaaaataagttaacataaaatatcagcttttagattttggaaaagtttattttcaagaagctttttcctgaactgggccataaactataaagaaaagtctccatgaaaatgcactctaactttgcttgcaaaataagccaagctgttagaaaccttgtaaggcaccaatttaatatctccctctgacccagttcttagaaatgttatcaagttacctattaatataacttactagtgcaaataccctgaatgtggagtacttataatattcaggttcctataaaaatagctattgcctccccaaaagtagagcaagtcttccctatcccacaacctaaatctaatttgacagacattattaattcagattaataatgccagagaatctagtgcattaaaaaagaaagccttgctaaggaaaaaaatcatttattgggcaggaaccaagaaggtaaggtcctaaaatctaaaacaccttagttccctgacttaaaaaaaaaattaaaatcacattaagcaaattggagaactctaacttctaacataatcaaatgatttgcaacacttatgagccgcattttacgcccgggtctcccaggccttgcccttaatgcaaacttacctttatacctctgaattcacctgagacaatgcagtagaaatgattctaaataatgagtaggacttttaaacatagttttacaggtaaaaatgatggcatatttcttctcagtcactgaaatggggcaaaatggaaacaacaatcaagatattctttctggaatggtcacagattgtcacttagctgcacaaaaatattagaaataaaataattgttatacgaatatatctgttcgtagtggatgtcgaagtgtactgtcaaaaagtagcaaattaaaactccatatccatgtatatggcatgcaccattcacccagttcctcatatcgaaattcttgaatcacctccatatgcagtccctcaacaaaattctccactcaaaatacatttgatctactttcttctactactctaaatattcatctgcttgcccaagtcaccatcatctctccctagacacaaggtccaccttccattcttgacccctctaatctatgtcccaaattgcagccagagtgatcctgttaaaacacaagtcacattctaactgcttaaatcctcttttggcttcccattgcccagaaaatggaactcactcctgttcaccaggccctatatccttcctcatatcttgtcactcacccccagtcactgaactcaaggcaaacctaccttcctgaaagacaccaagagtcctcctgcttcagagcctgtactctttgctgtctctcttcttttaacttcatgcaagcctctgcctaaatgtcatttcattggagtaggcttccctgaacactctattaaaaatagcagtttctattattcccaatcaccacatctactccaattttcttcagcacacttaccaatatcagaaatcagaacatatatgaatttgtgtattacctgtttttccctaaaaaatataactttcatgtgggctgagattgtgtagatcttgttgattgctttatcccagcacagtgcctcacacttagtaggtggttaatactcacctcccttctatgacatgctgctgtctttctttagaatattctgggtaagcattgacaagcagaaattatctcggtaatgcccccatgtaattctaagggaaatctgtactctaagaaattcaaggtcttacgtgcttacaaaacaaaacaaaacaaaacccagattacctatttaggaataataaaaacatcaacattattaattaaaatgtttgtgttataaattaccctatggaccgctcaaaaaaaatgtggaaatgccatgttcccagacgggcatttactcagagaataagatttatgaaaagactttaaagcttagcagtgttaggaagaatagaaagtaaaagttcaggaacaaaaaggagatatattcattaatttctccacatataatgatgtaaaaacaaaataaaacaacccaaaatacactgtttttagtaaaactatgactaatgcagaggaccccaaataatacaaaatgatttataataatattttttaaattaatagaaagtaaggatgagctaagaggtagaaagtttaaaatgggaagaaatatctcaattttttgttgtaagtaaattgtgatcggctctgcaagaatctctttattctttaccaaaaactccattactggtgtttatgtagctgggtttagttgttctcagataactatcaaacgtaaattatcttccacaaatttgagtgctactatcgccatcataaagttgtattgagggcctaatatgaacctcatgctagcttgggggaaacaaaacatattatgtgaccctgacgaccgtaacctttacgaaagtcaaaatttattaaaaaaaaaaaagggctctgataagtgctaaattaaattacggacaaattctgtcacattgctttagtttcctggactagtatcactgagttgaaacatatcattattttaatcataaatatttcactataggcttctactttaacatgtctaatataaattactgtacattgtgtaaaataatttataaactttctaagggatgagaaaatcagccttctcaaaaagatgtgtttgcattgcaaaaggcaagtaatatgctttgatcaatttgatgtgaaacataaaaagcttctttcatagaaaacagataccaggcatacaattttaattgaagagaatttttgttacttcttaatatttcaagggaacacataccaaaaggagctgtaagtcagttattttattattacctttggctattttactattacatttcaataagataatgaattttcctttggggaaaaaaaagttttcaatgcttaacaaatgagatcattctaaattaaattatctgcctgaaaagacactattttaataaatatttgattgaataaaagttattttcctccacatacacaaatgttattgcatccttgctttttgaaacaacgggctttatatcaaaattttatatctttttttaggcatacatttttttcccagagtttagtagcaatctttttctctatatatttcagtccttgaaacatattgtgcacattcagtgttataaccttgtcactcaaagagctgatacaacacaaagtgatttcaccaaaaataatggaaggatagacattatttttggttagaaacagtttttgctgtttttttttgagacagtcttgctctgttgcccaggctggagtgcagtggcacgatctcggctccctgcaacttctgcctccctggttcaagcgattctcctgcctcagcctcctcagtagctgggattacaggcgtgcaccaccaatcccagctaatttttgtatttttagtagagatgggggtttcaccatgttggtcaggctggtcttgaactcctgacctcctgatccacccaccttggcctcccaaagtgctgggatcacaggtgtgagccaccacgcccagctagaaacattttttaagaagaagaatattgtgcttgtcatgttcagtttcttgaaccgggttataggagtgtgttaagttatgaacattcaataaaacagcaatcataataataaagagtaactagtttattaaaaagttcaagaagcactgtattttgtcagtgtctggaaaaataacaccaaatgtgcctttctttgtggatactccatttaggaaaaggtacaaattggaaatgaaaaggaacgtggtatgggagtggagagaaaaagaagtatttgaaaagaagtctcagaaatcatggatagaaaataattaatgattattactatgtaagtagtgcatgtcttagaatattgcacacacaactgaggggttttagcaaaaaatacattacccagaaaggaaaatgtaaagcagaagcagtgtgctaaattgctgttgccctctcctgatctcccaattagtgagcacttagccaactctcttgaaagcaaatacctctaaggagggtgtcacttaattattcatattttattaccaattactttaatcagatggtttcttcataacatttggctgaatcagctaaatttggaaatgttatgcataccatccaagagtataaagaggcacatgtgtgattttagaaaatgggttatttgaaggaaacttgctccagatatgtttgttgaaatcattgagggttttcatgttctgcttgaaaacttaacctttaggagtggatgaccaatccaggagatgggctttcagagtcacttgatgttgcaaagttgatcatttaaaaggttactttaatacttccttaaaacaagtgtaactaattcaactctcaggaagcttaagatggcctgggggaagggaaataccttaagtaatcctaacgaaagctaagtctgtgctttatggttggaggcacatgcaggcaaaatggtgaaaccattgctctccttcaggctccatgcacttttagataaacatccaaacatcctcatattgcctcaggctattttcatagggccaactccctgggacttagaaaaatcctatcttttccattaaaatgtcaattccttcacaggatagaagaaatttaaaaattattgtgtttgttttttgtgtgtgtttctttccattgtaaaaatttgttaattttagaaaggttttagttgtttgctttagcaaaggtgttttctttaattaaaggtcactccttgaaccaaaagtttaagtcgccagtgaattatttgtggcccaaattatttatatgaataattatgtgaaaagagtagaaatgttgtcccaaacactttcatctcccaactcttttcctctgactgtcctgcattccataatgtttcattgtatcataaaaccctagcacatattttatgatttttccactgaggtaaaaaaaaatgtttaacattcaattggcaaagtgatgtttacctaccaagaatatttttgcataggggaacaaaacaaaatagctaaattgaaatcccttctttactatgaaatcattttgtgatcctgaagaaggtactcttttttctagaacttcatttccacatcagtaaaatagagacaattatatccaacatagaaggccattgtgaagaaaaaatgagatggtgcatagaaaatgacaataggtgttgtttttattttccttagtatcttttctgcttccctggcacttaataaaacctactaagtgtcttatcctaataacctatgaagattgctactatttcatttagaataattgttcatacagattataacaccttccccacacacacacgcttgcagttctgcttttcaataattacgtagttattcaatggtttgataaaatattgccttgcatagaggatattaaactcatgaaactgagaggtgacagcgtgctggcagtcctcagagccctcgcttgctctcagcacctcccctgcctgggctcccactttgtggcatttgaggagcccttcagccccccactgtactgtgggagcccctttctgggctggccaaggccggagcccactccctcagctttcagggaggtgtggagggagaggcacgagcgggaaccggggctgcgtgtggcgcttgcggggcagctggagttccgggtgggcgtgggcttggtgggccccgcacttggagcagccagccagtcctgctggccccgggcaatgggggacttagcacccgggccagtggctgcggagggtgtactgagtcccccagcagtgctggcccaccagcgctgcgctcgatttctcgctgggccttggctgccttcccgcagggcagtgctcgggacctgcagcccgccatgcctgagcctcccacccactccatgggcccctgtgcggcccgagcctccccgacgagcaccaccccctgctccagggcaccgagtcccatcgaccacccaagggctgaggaatgctagcgcagggcacaggactggcaggcagttccacctgcagccccggtgtgggatccactaggtgaagccagctgggctcctgagtctggtggggacgtggagagtctttatatttagttcagggattgtaaatgcaccaatcagcaccctgtgtttagctcaaggtttgtgagtgcaccagtcgacactctgtatctagctgctctggtgaggacgtgcagaacctttacatctagctcaaggattataaatacaccaatcagcactctgtatctagctcaaggtttgtaaacacaccaatcagcaccctgtgtttagctcagggtttgtaaatgcaccaatcgacactctgtatctagctgctctggtggggccttggagaacctgtgtgtctaaactctatctaactaatctggtggggatgtggagaacctttgtatctagctcagggattgtaaacacaccaatcagcaccctgacaaaacagcacacttggctctaccaatcagcaggatgtgggtggggccagataagagaataaaagcaggctgcccaagccagcattggcaacctgctggggtccccttccacactgtggaagctttgttctttcactctttgcaataaatcttgctactgctcactctttgggtccacgctgcttttatgagctgtaacactcacagcgaagatctgcagcttcactcctgagcccagcgagaccacgagcccaccaggaggaacgagcaactccagacgcgctaccttaagagctgtaacactcaccacgaaggtctgcagcttcactcctgagccagcgagaccacgaacccaccagaaggaagaaactccgaacagatctgaacatcagaagggagagactccagacgcgccaccttaagagctgtaacgctcaccgcgagggtccgaggcttcattcttgaagtcagtgagaccaagaacccaccaattccggacacaaaaccaaacgctccaacaattttaagtggcgactggcaaccaatggtgataggacatacgtgtgattgtttcatttctgcctatagctacaccattattctctctgggtcttagtttatggctttgtaaaaaattagatgaccactgcaattatttctagcttaataattctaaaatttatgatctataaataatctattcctacccctgatgattttcccttttttggcatttagcaggcttgataattgcttctttatttagctctctcttgtgagagattctgcttttaaggggacaaacttacctgttttgttaattattttatctccaacagttagcacagtgcctgacatgtagtagtctcttaaaaactacctgcagaactgtaatgtattggcttaacaaatgaataatacccaatgtattattatagagaagataatagaagtcaattaattttaaagtatttaaataaaattctatttgccctaaagcaatgtattttctgtataagttatgtaccctctggaattaagtgaataagtccctatgtatccaatattacactcttgccatttttatttatatatctgtcttttctactagaacttcttagctattggaaggcctatctctggcctttggtatctaacatatttttttggccacgtatactagaatactctacaattttccattgaaagaatctcaattatatacttataaatataattgtcttaattcttcaaaattaattttgcttatatccttttcatttgactcttggatctatgtcaatactgatttctaaaggtttcataaaatagagtcagcctttatggcaaacatattgttgtctaggttatagtacacagaccagctggtatttttcaatgacatgacatcttgattaaaggtgtagaagatgctatcctgtgaaaaggctttgaaaatgtgggttctgtgtctgtatatttttatatacatataccgaaacagtattttgttcccatgttctcttagaacaagatcatttgtatgtgaattttcttctacctcttccatccctaagacagcaagaccaagtgctcctctcttcctcctcagcctactcaatgagaaaacaaagataaagaccattgtgatggtacacttccacttaataaatagtaaggatattttctcttccacatgactctcttttcatttctttttttatttgtttgtttttgagacaaagtctcactctgtcacccaggctggagtgcagtggcaaaacatggctcactgcagccttgacctcccaggcttaggcaatcctcccaactcaagtctcctgagtagctgggactacaggcacatgccatcatgcctcactaatttttaaattttcttctgtagagatgaggtgtccctgtgacgagcccaggctggtctcgaactcctgaggtcaagagatcctcccctcttggccttatgattttcttcataacagtttcttttctttatcttactttattggatataatacatacaacatacaaaatatgtgttaactgacaatttatgttactggtaagacttctggtcaacagtaagctattagtagttaagctttggtgaagtcaaaaattatacatgggttttcgactgtgtagggttcagtgcccctacccactgggttcttcaagggccaactgcacaattaattcatgatatggagttagaagggtagaataaaggacttcaaagtgccttcctaagtctaaacaactatgaaataagagaaaaatttttctgtcctgaccacagaaaattgttcaagacatactttaagtgaaaaaagtaagttgtaaaactgtaggtacatagtggtagtattttttgtaaacatacaagattttaaatttattcttatttctaatatttaaagaaaaacatacaaaatgttaaagtcgttcattacctagttggaaattcactcaaataggaacatcctatttgtaattgcaaccatttgcttaagaaaataatggtaatcacttatagagtgctccattcaagcatttttaggaacattaactcatttaatactcacaacaactctacaaagtgatggtcattatcacctctttttgcagacgaagaaattgaggtaagaaaagcaactttcttgctcaaagtcacatagagctaatgattagtggagctgagcttcacagatagattctttggctcagaggccagttttctccaagctcacttcctacactatgctgccctatgctcttccctcggcagcccactccaaacattaacctgatgtttatgctaatcaacaatttgattttatatttacttactatccatgtattttacaaataatgctttgagcaccaattatgtgcaaaacacagctttatctccagtaactggtaagtccagcttttcagtttgttcccagtaatagctagccaaaaatttatcagtccttcccccgatcctgatctagtcatttcacacccatttctaacatcaccaatattggtaaaaaataagaggcatttgaaggctgctgggagagatataaaggcacctacttcaataccctccagaaggctgcaatttcccaaactcctttcaggcaactcaaaatgctcgtgtattagaataggtactgtatgcatacctacagtgaattgttagaagagactactgacaggtataggaggttgagctagatgactcctcaggttcatccagataagtgtggaaagagccagttacttactaactgccttggaaagaacagcactttccccaggaatgaagactagtaataaggtcaacaaactgcaaaaaccaaatgactcctccctttattttttaaataaaagaagtatttaaagctgtattaaggtttccaaaggaaataagaagaaaggttaacaggaaagaacaaaaacccattaattctgaagcaggtaatgaaacacacacacacacacacacacacacacacactcagacgtatcaacaaaaagccagatgatccctaggagcataataggtagcagagggtgaggctgcagtccttggtttggagaataggaagattccccataatctatccgatgcctatggccaaagcaagaagttactgctatattgtgcgatcctcagttatcaaatgggcattgtacatatttttctgtgttggtgtgtttttctgtgaataaaaattactttctaccatgtaatgttaaggctatacttcaggctgtatcttaaccagtgtcttttggtctcaggaccattttggccacaaggaaaatttaaaccttgcaggacaagaggtgctgcgtctgctgaacctgcatctttgggataagggtagtatttaaacgaaggagtcaactgtggaactcctccgggtgtggagacagaaataaaataaataggtgtgtatatcccatagtgctgatatagtttcatattttttttttttttttgagacagggtctcactgtgtcacccaggctggagtgcagtggtgtgatctcagctcactgtaacctctgcctcgcaggttcaagcaattctcctgcctccgcctccttggtagctggaagtacaggcacctgccaccatgcccgctaattttgtaattttagtagagttggagtttcaccatgttggtcaggctggtctcgaactcctgacctcaaatgatctgcccacctgggcctcccaaagtgctgggattacaggcgtgagccaccgtgtccagactagtttcagatgtttaacatcagtacatatttattattattattattattattattatactttaagttctgggatacatgtgcagaatgtgcaggtttgttacataggtatacacgtgccatggtggtttgctgtacccatcaactcgtcatctacattaggtatttctcctaatactaaccctctcctagcaccccccactccctgataggccccgacgtgtgatgttcccctccctgtgtctatgtgttctcattgtccaactctcactcatgagtgagaacatgtagtgtttggttttctattcctgggttagtttgctgagaatgatggtttccagcttcattcatgtccctgcaaagtacatgaatacatccttttttttatggatgcatagtattccatggtatatatgtgccacattttctttatccagtctatcattgatgggcatttggattggttccaagtctctgctattgtgaatagtgctgcaataaacatatgtgtgcatgtgtctttatagtagaatgatttataatcctttgggtatatacccagtaaagggattgctgggtcaaatggtattgttaaataagtgaaaaaataaataaaaaaaataaatataacatatattatacaaggagtaggagagtaaaaaggatgaatttattttacaaaaaaatgagaaacatcagacggaataataggaatagaaaattataacataaaaagcatgcctctttccacatcttatataagcctcacagaagagagaatatcatgttagaaagtttaggaaaatagattaatgaaagaagacaattttttctg

SEQ ID NO: 605 - DNA, 14154 bp, Homo sapiens
gatgcatttatgtattttcacatatttttagatttttgcatattgatacaaagtctcaagtttttttatcaatatgtgatatttgtacatatttatggggtacatgtgatattttgttccatgcatataatatgcaaggatcaagataggatatttagggtatccatcacctcaaatatttatcattcctatgaattgggaatatttcaaatccttgcctctagctattaatattttgacatacacaatatattattgttgaccattctcacactactctgctgttgaacattagaacttatttcttctatctatggttgtaaccattaaccaacttctcttcatttcacccccactcctacccatacactcttctcagtttctggtatctctctctcatggtttggctgtgtcctcacccaaatctcatcttaaattgcaatccccataatgtatcaaggcagggatggagtgggacgttattgggtcatggggggtgggttcccccatgctgttttcttgatagtgagcgagttctcacaaggtctgatagctttataagtgtctagaatttctcctgcctccacttctctctcctcctgtcatgtgagaaggtccaaggtgctcccccttcaccctccatcatgattgtaagtttcctgaggccttcccactttacagaactgtgagtcaattaaacttatttcctttataaattacccagccttgggtatttctttatggcagtgtgaaaacaaacaaatactctctaatgctatgagaatcacctttttagctcccatatatgaatgagaacaggcagtactgtctttctgtgcctggcttatttcacctaacataatgacctccagtttcattcatgtggctccaaatgacatgatttcattattttttatggctgagtagtattccattgtgtataaataccacaccatctttatccatccatccattgataggtacttgggttggttccatatcttttctattgtgattagtactggaaaaaagatggggctgtagatatctctttgatgtagataatttcctttactctgaatagatacccaatagtgggattggtggatcctacagtagttctatttttagattttggggaaatctctatactgttttccatagttgctatactaatttacgtttccaccaacaacgtataagtgttcccttttctctgtaaccctgccagcatctatcattttttaatctttttaataatagctattctaactgggataaaatgatatctcattgtggttttgatttgcatttccctgatgattagtgatgtcgagcatttttaatatacatgttgaccacttgtatgtcttcttttgataaatgtctattcatgtcatttgactactttttgatgagattatttattttcttactgttgagttatttgagttccttctatatactgaatatttgttccttgtaaaatgaatactttgcaaatattttctctcattctgcagattgtctctttactctgttggttatttcatttgctctgcagaagtattttagattaatatagtcccagtcccatttgtctttttttctttctattgcttgtgcttttgaggtattagccctgaaatcctagcctagaccaatatcctgaagtgttttcttcaagttctcttctagcagttttattatagtttcaggtcttatgtttaggtgtttaatctatgtttggttgatttttgtatatgatgagtgataggggtccagtttcgttcttctacatatagatgtctaacttttctagcaccatttatttaagaagttattcttttcctgatatatgttcttggcacctttggagggaatcagtaggcacccttatcaaaaatcacttagctataaatatgtgaatatattttagggttctctattgtgttccattgttctatgtgtctgttttcataccaataccatgctattttgttgactatagccttgtaatatgttttgaagtcagatactctgatatctccagctttgttttttgatctgaatttcttgggctatttggtgtcttttgtggctacataggaattttaggattttttttttcatttatttgaaaaactacgttggtattttaatagtgggtacacttaaactattggttgatttacgtgtatgattgttttaacaatatttcttcttctaatccatgagcataagatatctttctatttgtgtcattttcatttgctttcatcagtgttttgtagttttcattgtggagtcttttatcatctttgtttaatttattcttaggtatttttttgtagctattttaaatgggattttcttctttctttttaaactagttcattattattgtatagaaacactactgcttttgtgtattgactttgtatcttgtaattttattaatttgtgtatacattttaagaattttctgatagagtcttttattcttttccaaatataatgtcttccacaaagagagataatttgacttattctttttccaattttgatgcctttttttctttttcttgcctgattgctctagcaaggacttccagtactaaattgaattgaatgaaattaggcatctttcaccacttgttccagttcttttttttttttttttttgagacaggatctcactctgttgcccaggctggagtgcactggctcccagattcaagcgattcttctgcctcagcctcctgaatagctgggattacaggcatctgccatcatgctcagctaatttttgtatttttgtagagaccagggtttcacaatgttggctaggctcgtcttgaactcctaacctcaggtgatccacctgcctcagcctcccaaagtgctgggattacaggtgtgagtcaccacgctcagccccagttcttagaggaaaggctttcagacttcctcacccagtatgatgttagctgtgggtttgtcatgtatagtccttattatgttgagttatgttccactatgcctagtttattgagaagatttatcatgaaaggatgctttttctacatccattgagatgatcttttttgtctttcattctttgatgtgatgtatcacatttattgatttacatatattgagctatcatggcattcctgggataacttgttcatattgtgctgtctttgtgatgtgctgttggatttgttagctggtattttgtcgaggacttttgtatctatgttcatcagggatattggcctgtagtttatttttgttgttgtgtccttttctggttttagtatcggggtaattctggccccatagaattcactggaaataattttttcctcttaattttttggtaataatttgaggttaattggtattaattcttctttatatatttgctaaaatttgagagtgaagtcatctggttatgggcttttctttctccacagactttgttactgattcaatctcattgctcactgttgatctggtcaggttttctattcttcctgattccatcctggaaggttatatgtgcccaggaatttatccatttcctctaggttttccagtttgttagcatatagttgttcataatagtctctgatgatcttttacatttctgtagtatcagttataatgtctcttttttcaattttgactttgtttatttggatctttttcttttattcttggttcatcaagctaatggtttatcaattttatcttttcaaaaatccaatttgtttcattgatcctttgtattttttagtctctcttttgtttagatttagtctgttgtttattatttctttctttcaactaatttcggatttggtttcttcttgcttttcttgtttcttgaggagcagcattagattgtttatttaaaaatctttttacttttttgatgtcagcatttattgctaaaaatttccctcttagcactgctttgactttatcacatatattttgctatgctgtgtttctatttttatttgtttcaataaactttctgattttcatctggattgcttcattgacccaatgatcattcaggagcatgatttataaattttcatgtatttgtgtagtttccaataggtcctctttgtattgatttctaattttattttattgttgtatgagaagacacgatgtcattttgatttttaaaatttgttgagacttgcgttgcagcttaacatatactctatcttggataaaatttcatatactgatgagaagaatgtatattccgtagctgttgaataaagtgttctgtaaaggtatattaagttcatttgctctaaaatttagtttaatttcaaagtgtatttgttaattttctgtctagatgatctgtctaatactgacagtaagttccctaccattattttattggagcccatctttccctttagatctaataatatccactttatatatctggatactccagtatggttacatatatatttagaactgttatgtcctctttctggatgatcccttatcattatataataatcttctttgtttctttttatagtttttattttacttaaagtatgttttatcttgtgtaaatatgacttctcctgctcaatttcggttgttgttgacgtggaatatcatttttcattcccttacttttgataaatgtatatatatacacaaatatatgtcatatatatacatatatataatatgtcatatatagtcatgtatatacatatatatgtatatgacatttgtatatgtcttttccattcctttactttgagtctatatatgtcagataacaggaaaagtgatcttttgtaggcatgatataactgtatcatgtacttttatccattcatccagtctatatcttttacgtaggaaaatttaatttatttcaattcaaggttatcattgatatatgagattttgttcctggtatattgttaattgttcactggatcatttgtatatcctttgtttcactttttctctcctattatttattattgtggtttgggattttctatagtcataacatttacgtcctttctcttcctaatttttttgtgtgtgctctaccagtgggttttatccttttgtgcatttttatgatggtggatgtcatccattcacttccaggtgtagaactggcttaagagtttattttttatatatatattacttttatatatatgtattttttattgtactttaagttctagggtacatatgtacaacgtgcaggtttgttacatatgtatacatgtgccgtgttggtgtgctgcactcattaactcatcctttacattaggtatatctcctaatgctatccctcccccctccccccaccccacaacagcccctggtgtgtgatgttccccttcctgtgtccaagtgttcacattgttcaatgcccacctatgagtgagaatatgcagtgtttatttttttgtccttgcgatagtttgctgagaatgatggtttccagcttcatccatgtccctataaaggacatgaacccatcattttttatggctgcatagtattccacggtgtatatgtgccacattttcttaatccattctgccattttcagacatttgggttggatccaagtctttgctattgtgaatagtgccgcaataaacatacatgtgcatgtgtctctgtagcagcatgatttataatcctttgggtatatacccagtaatgggatggctgagtcaaatggtatttctagggaatgggcacactgtcttctacaatggttgaactagtttacagtcccaccaatggtgtaaaagtgttcctatttctccacatcctctccagcacctgttgtttcctgactttttaatgatctccgttctcactggtgtgagatggtatctcattgtggtttgcatttctctgatggccagtgatgatgagcaatttttcatgtgtctgttggctgcataaatgtcttcttttgagaagtgtctgttcatatcctctgcccagttgttgatggggttgtttttttcttgtaaatttgtttgagttctttgtagattctggatattagccctttgtcagatgagtagattgcaaaaattttctcccattctgtaggttgcctgttcactctgatcgtagtttcttttgctatgcagaagctctttagtttaattggatcccatttgtcaagtttggcttttgttgccattgcttttggtgttttagacatgaagtccttgcccatgcctatgtccggaatggtattgcctaggttttcttctagggattttatggttttaggtctaacatttaagtctttaatccatcttgaattaatttttgtataaggtgtaaggaagggatccagtttcagctttctacctatggctagccagttttcccagcaccgtttgttgaatagggaatcctttcccaatttcttgtttttgtcaggtttgtcagagatcagatagttgtagatgtgtggtattatttctgagggctctgttctgttccattgatctatatctctattttggtaacagtaccattctcttttggttactatagccttgtagtatagtttaaagtcaggtagcgtgatgcctccagctttattctttttacttagaattgacttggcaatgcagtctcttttttggttccatacgaactttaaagtaatttttttccaattctgtgaagaaagtcattggtaccttgttggggatggcattgaatctataaattaccttaggcagtatggccattttcacgatattgattcttcctatccatgagcatggaatgttcttccatttgtttgtgtcctcttttatttcgttgaacattggtttctagttctccttgaagaggtccttcacatcccttgtaagttggattcctaggtattttattctctttgaagcagttgtgaatgggagttcactcatgatttggctctctgcctgttattggtgtataagaatgcttgtgatttttgcactttgattttgtatcctgagactttgctgaagttgcttatcagcttaaggagattttgggctgagataatggggttttctagatatacaatcatgtcatctgaaaacagggacaagttgacttcctcttttcccagttgaacgccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtagtaaatagcacttattattttgagatacatcccatcaatacctaatttattgagagtttttagcatgaagggctgttgaattttgtcaaaggccttttctgcctctattgaggtaatcatgtggtttttgtcttttgttctgtttatgtgctggattacgtttattgatttgcatgtgttgaaccagccttgcatcccaggtatgaagcccacttgatcatggtggataagcttgttgatatgctgctggattcagtttgtcagtattttattgaggatatttgcatcgatgttcatcagggatattggtctaaaattctctctgccaggctttggtatcaggatgatacctcataaaatgagttagggaggattccctctttttctattgattggaatagtttcagaaggaatggtaccacctcctccttgtacctctggtagaatttggctgtgaatctgtctggtcctggaatttttttggttggtaggctattaattattgcctcaatttcagagcctgttattggtctattcagagattcaacttcttcctggtttagtcttgggaggatgtatgtgttgaggaatttatccatttcttctagattttctagtttatttgcatagaggtgtttatattattctctgatggtagtttgtatttctgtgggatcgatggtgatatcccctttatcattttttattgcatctatttgattcttctctcttttcttctttattactcttgctagtggtctatcaattttgttgatcttttcaaaaaaaccagctcctggattccctgattttttgaagggttttctgtgttgctatctccttcagttctgctctgatcttagttatttcttgccttctgctagcttttgaatgtgtttgctcttgcttttctagttcttttaattgtgatgttagggtgtcaattttagatctttcctgctttctcttgtgagcatttagtggtataaatttccctctacacactgctttatatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattacactatggtctgagagacagtttgttataatttctgttcttttatgtttgctgagaaatgctttacttccaactatgtggtcagttttggaataagtgcggtgtggtgctgagaagaatgtatattctgttgatttggggtggagagttctgtagatgtctagtaggtccgcttggtgcagagctgagttcaattcctggatatcctcattaactttctgtcttgttgatctgtctaatgttgactgtggggtgttaaagtttcccattattattgtttgggagtctaagtctctttgtaggtccctaaggacttcctttatgaatctgggtgctcctgtattgggtgcatatatatttaggatagttagctcttcttgttgaattgatccctttaccattatgtaatggccttctttgtcgcttttgatctttgttggtttaaagtctgttttatcagagactaggattgcaacccctgcctttttttgttctccatttgcttggtagatcttcctccatccttttattttcagcctatgtgtgtctctgcacgtgtgatgggtttcctgaatacagcacactgatgggtcttgattctctatccaatttgccagtctgtgtcttttaattggagcatttagcccatttacatttaaggttaatattgttatgtgtgaatttgatcctgtcattatgatgttagctggttattttgcttgttagttgatgcagtttcttcctagcctcgatggtctttacaatttgacatgtttttgcagtggctggtaccggttgttcctttccatgtttagtgcttccttcaggagctcttgcagggcaggcctggtgatgacaaaatccctcagcatttgcttgtctgtaaaggattttatttctccttcatttatgaagcttagtttggctggatatgaaattctgggttgaaaattcttttctttaagaatgttgaatattggcccccactctcttctggcttgtggagtttctgccgagagatccactgttagtcttatgggcttccctttgtgggtaacccgacttttctctctggctgcccttaaaattttttccttcatttcaactttggtgaatctgacaattatgtgtcttggagttgctcttctcaaggagtatctttgtagccttctctgtacttcctgaatttgaatgttggcctgccttgctaggttggggaagttctcccggataatatcctgcacagtgttttccaacttggttccattctctctgtcactttcaggtacaccaatcagatgtagatttggtcttttcgcacagtcccatatttccttgaggctttgtttgtttcgttttcttcttttttctctaaacttctcttctcgcttcatttaattcatttgatattcaatcactgataccctttcttccagctgatcaaatcagctactgaagcttgtgcattcatcacatagttctcgagccatggttttcagctccatcaggtcctttaaggacttctctgcattggttattctagttagccattcgactaatcatttttcaaggtttttaacttctttgcaatgggttcaaacttcctcctttagcttggagaagtttgatcgtcagaagccttcttctctcagctcatcagtcattctccgtccagctttgttccactgctggtgaggagctgcattcctttggaggaggagaggcactctgatttttagaattttcagtttttctgctctgttttttccccatctttgtggttttatctacttttggtctttgatgatggtgacgtacagatggggttttggtgtggatgtcctttctctttgttagttttccttctaacagtcaagaccctcagctccaggtctgttggagtttgctggaggtccactgcagaccctgtttgcctgggtatcagcagtggaggctgcagaacagtgaatattgaacagcgaatgttgctacctgatcgttcctctggaagtttcgtctcagagggctacccagccacgatgaggtgtcagtcttcccctactgggggctgcctcccagttaggctactcgggggtcggggacccacttgaggagtcagtctgtccgttctcagatctcaaacactgtgctgggagaaccactactctcttcaaagctgtcacacagggacatttaagtctgcacaggtttctgttgccttttgttcagctatgccctgcccccagaggtggagtctacagaggccggcaggcctccttgagctgtggtgggctccacccagttccagcttcctggctgctttgtttacctactcaagcctcagcaatggcgggcgccccttctccagcctcgctgctgccttgcagatggatctcagactgctgtgctagcaatgagcgaggctccatgggcttgggaccctctgagccagacgtgggatataatctcctggcatgccgtttgttaagacgattggaaaagcacagtattagggtgggagtgacccaattttccaggtgcggtctgtcacagctttgcttggctagtaaagggaattccctgaccccttgcgcttcccggttgaggtgatgccttgccctgcttcagctcacgctcggtgcactgcgcccactgtcctgcccccactgtccgacaagccctagtgagatgaacccagtacctcagttggaaatgcagaaatcacccatcttctgcatcgctcacactgggagctgtagactggagctgttcctatttggccatcttggaaccacccaagagtttcttttagggtcagtcagtttttgcttgtcagggaaagactttattttgcctttatttatgaaggataactttactgtgtatagtatttttggtggatactttctttttcttttcagcactttgaatatatcatctctgtaagagatgtaagcttctacgtgttattttgttaaatagagttttttaaatattttttcctctccttctgggtcactgaaaattcatatatttagtcattttatgctaaagagtttattgcagggtcagtctagtgatgaggaattacctcagtttttgcttgtcagggaaaaactttattttgcttttatttatgaagggtaaatttttggggtgtagtatttttggtggatacttttttcagccttttgaatataacatctatgtaagggatgtaagctttacctaatattttgttaaataggttttttttattttttgttctccttctgggcctctgaaaatttacatatttagtccttttatgctgtcccatatgtcatgtaggctttgtttcaactctttttaaaaaaattgtctgactggattattttaaagacctgtctttaagttctgaaattctttcttctgctggatctagtcttttgttgaataaatgcattttttacttcattcaatgtattcttcagttccaggatattttggttattttatattatagctatctcttttgtatgtttctcatttatatcctgaattgtttttctgatttctttgtattagttatctgtattgtgttgttccttactgaccttatttaatatcattacttttaatttttctggtatttgataaatttctttttcattggaatatgtagctgcagaattattgtgtttttttggaagtgtcatatttccttcctttgtcatgtttcttgtgtccttatcttggtatctgtgcacctgatataacagttgcctcttccaattttttggatttgctttcatagggaaggacttcatactgaatgtgtatctgtgattttggttaggtagggaacattggctttgattctcagtgcatgcagtagtgtattatttgtatcatttatttgaccatacacagccaaatcagtggtatctgtgatttcctcagtgacttagggtgtgattcttagtggagactgtggcgaagctttgcttaggatggaggcatcacctgggtgagtcctcagaccccagtgtgagcagtgatggagcaaatgtagctgttcttgagcccaagagcaatgtacactggcctccatattggcaggtccaggagggccaattcttgggtctccacttggtttgctcagatgccagcagtggcagcagtgggtcaggttggtgggtgggtccttgtggccctggatagtgcgtggattatggcagttatagtggtggctcaatgctctggttcccaagccatctgcactggtgttgaacatggctgagacaggctgggcaagctggtcttctgtcccacaggtggtgtataggggtgggtacctacagtggtggcaacagcaggctggatgggcccatcttcagctgctgagaggaatgtttaggtgcaaatgctggtggatagggcaggacaatcccaagattcctggacagcatgctcaggtactaggggaagttggagaaagccaggttgggaaaacctgtcctcagatttccccatggtgcatagaggttggctgtggtcagacggagtgatcctcagaccccagcagcatgcttttgtggagatggctgcatctgcactgtggccctgctactgctaagggccagtttgctttcagtgtcggcagccataggtagctggctggggagtgtgcactttggccccaggtggcagctgccaatggagcagccacttttctatgtgcatgaaaacgcacagcagcccttctttctgggaaaatagagttgctgccagtggctcacatttagcccaggtggcagtagccagcagcagcagctctcagcaggggatgacaatgggattctaagggtgtggaaatgcagaggctgttggggcccaggacaggatgcattctggtggtggctaggttctcaaaatggcaccattttgtagctgcttagggcttgagtttccagtatgagggaccaaacctgagctcattctctctctctaaagcaatgccattgcacagtctccaggcagctttctctgtttatctccgtgcccacaagtgtcaagaaacattcccttggtaggattggaggggtccatggtgggaatgtagactgctagggatcactcacttacccttttcctgcactgttgagtctcactgggctcccagatgatactagctgagcaggctaccttgcttctctgtccttccttcttttacatgtctcctgtctcttatctgttgaatcctgatgttctctcttagaggatctattgaaagcatgactaccaactcactatttgttagatgcctctagtcagccatcttgaaatccctcttcagatggttacataatattccaccaaatccataaccttcagctttttaactacaccctatatttggataatcaggttgttagattttttaagtactgtaaataatgctacagtaaaaagttcttgtattttgccttttcctcattttgtttacatctttgtgcaaattatcaggaatgaatttactgagtcaaagatgattaacatgctataccttttgaaatatattgacaaatttttttctgatgttttcaacagtgttcactgccaccagctataaata

SEQ ID NO: 606 - DNA, 46655 bp, Homo sapiens
tagaccatcaaatatactgaggaaaatagcaccggagtccaactaaagagaccaaaattatagcaagcatcaaaaagaaaaccatgatcacaaaggacttgaatagacaattctccaaacaagataaacatttgaccagtgagtacatgaaaagatgcccaacatcgctagagaaatgtgagccaaaaccataatgagatatcacctcacacccattaggagagctcctattaaaaataaaaacaagaaaagagcaaatgttggtgaggatgtggagaaactgaaatccttgtgcattgttggtgagaatgtaaaatggtaccgctaatgtagaaaacactatggaagttcctcaaaaaattacaaatagaatgacgctgggtgtggtggctcacacctgtaatcccaacactttgagaggctgaggcaggaggatcgcttgaagccaggagttcgagaccagtctaggcaacatagcaagaacccatctctacaaaaaataaaaagtcaggcatggtagcatcacatctgtagtcccagctactcaggagactgaggaaggaggatcacttgagcccaggagttcaaggctgcagtgagttatgatcataccactgcactccagcctgagtgacagtgtgaaactctgtttctaaaaaataaacataaaaaatagaattatcggccgggcctggtggctcatgcctgtaatcccagcactttgggaggctgaggtgggcggatcacaaggtcaagagatcgagaccatctgggccaacacggtgaaaccccatctgtactaaaaatacaaaaattagctgggtgtggtggtgcgcacctgtagtcccagctactcgggaggctgaggcaggagaattgcttgaacccaggaggcagaggttgcagtgagccaatattgcaccactgcactccagcctggtgacaagagtgagactccgtcttaaaaaaagaaaaaaaaaaaagaattaccatatgatccagaaatttctttttttttttttgagacagagtttcactcttgttgctcaggctggagtggagtggcacgatcttagctcctctgccttccggtttcaaagcgattctcctgcctcagcctcctgagtagctgggattacaagcacttgccatcacacccggctaatttttgtatgtttagtagtgatggggtttcaccatgttggccaggctggtctcgaactcctggccccaggtatccacccgcctcggcctcctaaagtggtgggattagaggcgtgagccaatgcacccagactagaaatttcacttctgagtatatccccaaaagaactgaaagcaaggtctcgggggtatttgtccatctgtgttcacagcagcactatccacaatggctaaaacatggaagtaacacaaatgtccaccaagggatgaatggagaagaaaaaaagatacaacagaatattcttcagccttaaaaagtaaattctgacccatggatgaaccttgaggatgaacacagttaaaagatgtcagcactagtggcacttggggactccagcccagctcctgtcacaagcaactggccaccaggtctggacccacatcctttgctcttggcctactgaggtcattcagttttgctcatctcccacaacctggaaacccaagggggcaggctgtgcagttcatcctggaagaataatagaagagcagctgtcgtgcatggaaagatcgtgcaatgggtcaagtatttaattaattattttttgagacagggccttgatctgtcacgcaggctggagtgcagtggcgcaatcatggctcattgcagtcttgaacttctgggctgaagcgatcctttcacctcagcctcccgggtaactgggactataggcacgtaccactctacctggctaattttttgatttttggtagagacggggtctccctaagttgcccaggcttgtcttgaactcctgggctcaagcgatcctcctgcctcagcctcccaaagtgctgggattacaggtgtgagctactgcgcctgatctgttaatttattttttgagacagggccttgatctgtcacccaggctggagtgcggtggcacgatcacggctcattgcagtcttgaacttctgggctgaagcgatcctttcacctctgcctcccgggtagctgggactacaggcacgcaccactatacctggctaatttttttatttttggtagagacgggggtctccctaagttgcccaggctggtcttgaactcctgggctcaagcgatcctcccaccttggcctcccagtgttgggattacaggcgtgaaccaccatgccagtctgggtcaagtattttatattcattacttgagtttcataacaaccctataaagtaggcatcactgtccattttaaaacaagtaaacagaggcctaggaaaggtaaccacccaaggtcgtatacaccaaggaagaggcaatgctggcattcagacccaggccagtaaacccaaagccccatgcccttgacccaccacaacaatctgggattctgaggggcttgagtcaggtgacaccccagatctaagcatctgaaggtccctaactgtggagcctttcatgagaacaagccactggagggtaagcacacgtcgctcttctcaagggagggtgtactaaaggagcctcatctcactccccctgtgccatggaggccacaccaggtgagcacccttgggagggagacgcatagcctgactggggtgctaatgggtccccggcactgggttctccacatgaacagttgtgtgaatccaggaggctcagatcacgtgccacagcgccacctactggcctgtgaacaacaacagcatcctgttgtaaagtcggcaaacaatcatttaaaaattttcaggccaggcgcggtggctcacgcctgtaatcccagcactttgggaggctgaggtgggcagatcataaggtcaggagatcgagaccatcctggccaacatggtgaaaccccgtatctactaaaaatacaaaaaattagctgggcgtggtggcgtgtgcctgtaatcccagctactcgggaggctgaggtgggagaatcccttgaaccagggagtcagaggttgcagtgagccgagatcacgccactacactccagcctggcgacaaagcaagactctatctcaaaaagaaaaaaaaaatcaaacatttaaaatccttaaatctttttttctttttgagacagagtttcactcttgttgcccaggctggagtgcaatggcatgatctcggctcactgcaacctccacctcccgagttcaagcgattgtcctgcctcagcctccctcgaagctgggattataggcatgcgctatcacgcctaattttgtatttttagtagagacaaggtttctccatgttggtcaggctggtctcaaattcccaacctcaggtgatccacctgcctcggcattccaaagtgctgggattacaggtgtgagccaccgcacctggcctaaaatccttaaatcttaaaagacattttaaagattttgccctccactttttgcccattcatttaatcacctgttaaacaccaaacaccacgtgaggtgttggagtttgggagaattcgagtctttctcagagggacttacagaacgagcagggcagataaccaaataaagacacatcagaaacgggtgtgtgagaaccccaaaggggccattctcttggggaaggaaaggctccactgtgggatgatggtggtcttgggctgagcttttgaaacacaggaggggccaggcgccgtggctcacgcctgtaatcccagcactttgggaggctgaggtgggtggatcacctgaggtcaggagttcgagaccagcctgaccaatgaccaccatagtgaaacctcgtctctactaaaaatacaaaattagccaggcacggtggcgcatgcctgttatcccagctactcaggaggctgaggcagaattgcttgaacctgggaggcggaggttgtggtgagccgagatcttgccactgcactccagcagcctaagcaagaagaacgaaactccgtctcaatcaatcaatcaaatgaaagacaggaggtctctgtcaggacaacttgggggagtgggggttcatgtgatcctcaattcgcgactttccacaagcacaggggagggctgccaggatgcattttagtgagcaaatatgggagtgggaaacctcagtgtgactggaaagcaggattcgaggtgagatccagctgtggatggggagcacgcactcggctgcaggacccacatcacacgcagtgcaggccgcagccctggggcagcgtggcctgccacaccctggagaccctggctggccaggctatggactgagagcttggtctcacgacaaaggggagtcccttgagggtttcaaggcagtgagtaaagtgacctcccgttttaaaaagacaaccctgcagagggaggggggatgacatgagaagcaggaaaatcagtaagagattgttctcgaagtcagggctgacaaccctctctgccacagcagcagtggtggggacagtgaggtccgaacagaggagaggcactgaggagacagccctgtgaggctgggtaatgagcgggaggtggagggagaggtgagtggggagaccaggtgagtcccaggtttctggcgtggttgactattcctggaactggaatagaaggggctgatttagaagacaagatgaagagattgttgtaaacatgttaacctatgagattctcaaaagtacaaatacttaaaaaaaaaaaaaaaaactactcaaaaattacctggggccaggcacagtggctcatgcctgtaatcccagcactttgggaggctgaggtgtgtggaccacttgaggtcaggagttggagacaagcgtggacaacatggtgaagccccatctgtactaaaaatacaaaaattagccaggtgtggtggcgtgcacctgtaatcccagctacttgggaggctgaagcaggacaatcacttgaacctgggaggcgaaggttgcagtgaactgagattatgccactacactccaccctaggtgacagagtgagactctgtctcaattaaaaaaaaaattgtgaagtgaaaaaaaaaacaggatgaagaatagcagtatgcttccatttctgtttttaaaaagggggcttggctgggtatggtggctcacacctataatcccagcactttgggaggacaaggtgggtgtatcacctgaggtcaggagtttgagaccagcctgagcgacatggcaaaacctgtctctacaaaaaaatacaaaaattagccaggcatggtggcacatgcctacagtcccagctactcgggaggcggaggtgggagggtggcttgagcccaagaggtcgaggctgcagtgagccacggtcatgccactgcactccaccctgggcaaaagagtgagaccctgtctcaaaaaaaaaaaattcattatgaatttgcttgcaatatgcatacaaatctgaaatgacatataaaagtaatactaatattattggtgacagttggtgagaacagatgagatggtgccaaatactttttaaatgtatcacctattcaaaaaaactcatataacttagttaaaaatggtcaaatctcttcaatgcagcctacctcagttcccaaggcccaatcagatacagctctccaaacctgccagtgctggtgaacgcgctgctgggagcactggcaccccacagtgggggaggggaggggaggggaggggagggggccctctcacctctatggggatgtagagcatgaatcctggctctcctgtgtgcgtcatgctcatcacccggatcccatttgcatagcccacgctcatctcctgcagggacaaaggcagcagtcagcctgggcactcacattgcttgtcaagggagggacgcctggggaaacctttcattagtgctgcaccctctgtttactgttgagggagacagacgtcaaggcaagaatttcatcccaaaagtggttaacttccaggtcctgaggcaccgagaatggagcactgcctatgtgacatctctgcttgctactgttaccatctcaggagttttagccaagctgatggtagagagtggaggaaagtccttgacaagcacaaaatattcctctttgccaggtccttatgttagtcgagggtagcaggcacaatgaggacaaggcgagtgtcttctctgggggaatcggcagacaaaccctggccacctgccatacaaaagatgatgcccgatgcccacagacataattaatctgctatcctggggtcaaagatgggcttctgattctcagaacatgttacatagcagctcagttccctaacagcggccactgacgcaatcactgttcctataaaggaaagtggaaagtcctggacagcaccgaagtgaaccgcttccacaggaggctgacaggatgcagcactcgccaggtgttgagcgtatgggtcactcctccaagcagcagagcaaacgctgggaggggtccactgatggctaacagtggaaagttttctgttgctttcactttgcctcggagaagaaggaaaactgtgaaacaatttgtaggtggatcccactttgggtgaacttcaaagagtctccatcagtaaccgcctggaagttgctcgttacaggtggccaagatgtctgtccgtttggccctctctaatcagcagcttcctggggaggattccgttgtcattgctttcattcggttacagtttgtttcactcagctgtggttgccacttataggaaagaaaattatgtaggaagttcagagattcacctacgccatttcttccctgaagatgccacagacacagaagttactctgtgtacagaaaagaggccacactgcatggagagaagggacctaacttcgaaaggcatttttgtgtgtcataatcctgtaacttcaaattttaatccagtgctacagaaaccaaaaagcataaagactttacatttagagaagctaaatccacttcaaagatatcctaatgcttattaaataaagcaagcttggagtgtaaaaaataaacaaataaggccgggcgcagtggctcacacctgtaatcccagcactttgggaggctgaggtgggtggttcacctgaggtcaggagttcaagaccagcctggcaaacatggtgaaaccctgtctctactaaaaatacaaaaagttagctgggcatggtggcgggcgcttgtaatcccagctactcgggaggctgaaacaggagaatcgcctgaacccgggaagtggaggttgcagtgagccgagatcgcaccattgcacgccagcctgtgcaacaagagtgaaactctgtctcaaaataaataaataaataaataaataaataaatatacttagtcacttctttgctaatgaagggcagcacatttttttttttttttttttgagacagtcttgctctgttgccagcctggagtgcaatggcgcaatctcggctcactgcaacatctgcctcccaggttcaagtcattctcctgcctcagcctcccgagtagctgggaccacaggcatgcgccaccacacccggctaatttttgtatttttatatttatttataaatataagatgtaatcccaaagtgctgggattataggcgtgagccactgcacctggccagcacactcttttatttgagacagagtctcactctgtcacccaggtggagtgcagtggcgtgttctcggctcactgcgacctctgcctccagagttcaagcgattcctgtgcctcagcctcccaagtagctgggattataggtgcgtgagaccatacccagctaatttttgtatttttaacagagacagggtctcaccatgttggccaggctggtctcaaactcctgactttgggtgatccacctgcctcggcctcccaaagtgctaggattacaggcatgtgccacctcacccagccaagacactctttgtggatgttaacaccatagtaagaatatgtaactgccaccgctatgaaagacacattctctgcccatttaagaaacagaactttatcagcactcaccttgcaaaagaggcttgggaagtggtctggagtcataggggcataggacaactcagacagcacatccacagctcgagggccaatcagattgagggctaaatggaaaagaacaagagatgtccagctctccttctgaacagctgagccaatgggaaaggtctactgcagacttgctcagctatagccaggcctgggtgcagagaccaggaatatgtccctttgcttagacactccaaggatggatgctaagcaccccgattctggcgaatacacctctgccaacagggcctgctgaacgcagcagggctggccataaccaccccacacaattcccgttctcctccttttcccagcaaggctatgtgatggaagaagccccaaccccaaatcagtacccggtggagatctgcccaaccaaaaagtatacagactttaaattcagagaagctaaatccacttcaaacatatcctaatgcttactagataaggaaagcattattctggacaccagtgtttgtgacatcagcttgtgctaattacatgtcatccatcctaagagaagcgagaacatgacttttgttcagtaacattctgtagtatcccaatccaggagcaggacgtatatcatatttgctactacaaggaattgagaatgagagcctgggagagcaaacgctggtggggccaaggggcaagatcagttaggtgggaaggtgggaggggttaagccaagactgctgaggttgagaaaatcagggaaccaagtcatccttaaaaattaggtactcacgggggctgggcgtggtggctcatgcctgtaatcccagcactttgggaggccgaagcaggtggatcatgaggtcaagagttcaagaccagcctggccaacatggtgaaaccccatctctactaaaaatacagaaattagcccagcgtggtggcggccgcctgtaatcccagctacttggtaggctgaagcagaagaatcgcttgaacccgggaggtggaggtgcaatggcatgatcttggctcattgcaacctctgcctcccagattcaagcaattctcctgcttcagcctcatgagtagctgggactacaggcatgcaccaccatgtccagctaatttttttatttttagtagagatggggtttcaccatgttggccaggctggtctcgaactcctgacctcatgatccgcccgcctcagcctcccaaagtgctgggattacaggtgtaagccactgtgtccagccctcaattttctttgctttttttttttgagatggagtctcactcgcctaggctggagtgcagtggtgcgatctgggctcactgcaacctctgcctcccgggtccaagtgattctcctgccttagcctcccaagtagctgggattacaggcgtgtgccatcacgcccagctaatttttgtatttctagtagagacggggtttcaccatatagtccaggttggtctcgaactcctgacctagtagtgatcctcccacctcggcctccaaaagtgctgggattacaggcgtcagccaccgcatcccctagagatcaattttctatgaccagagagcctcttttatgctaactctaatgttcatttttgagagtcaaatgtaaagaaggcaaacgtggacacatctgcatctgctggccttttcgacgtggcagagcccgaacccccgtacctgtgtacttccaggtgacgtcctccaggagcaggttgctgtctttcggcatgtgtttcttaagccaggcccaacagtggacctgctggtcggttggagagatcatgaagaaactgaaaagtgagaccccaaaataatcaaaaccaggtagcagcaaaaggatcaggaagcaatcaaatcttatttggtttcaaagcaatgaggcaaatactaggaaatgatttcttagctttcacagaaggccagtagcaccattctaggatacaccacctaacaacaaaacaaaattctggcttcctgttaatgccaagaaattatacagatttactaacgttaagacatcggctgggcacagtggctcacgcctgtaatcccagcactttggaggccaaggtgggcagattgcttgagctcaggtgttcaagatcagcctgggcaatgtgacaaaaccctatctctacaaaatatacaaaaactggctgggtgtggtggcgtgtacctgtggtcccagctacctggaaagctgaggtgggaggatcacttgagcccaggaggtcgaggctgcagggatccatgattgcatcactgcactccagcctgggtaacaaagtgagaccctgtctcagaaaaaaaaaaaaaaaaaaaaaaaaagacaaggcatcttctcccagtagggtacataatctggtgggcttttttttcttttcctcctggtgatttcttttgtttaggactgctaataaactggctttgatttcatgtaatgattcttagtccctgggatttatggttcgtggagaagcgcctgagagcctctgctacagtacccctaaggaatcaacatgttggaggaagcagagcgggacggcagctcatctcacctgcgcttgttcagtcgtgctatgctgcagtcattttcataccctccaccctcgttgagcatgccagtatgcacaatgtggcccacaggcacatccaggtcattggagaagaggtactgtagaacttctaatgcctgatccccagtggtctgcagggttagggaatgaaacagagagagtgagagtgagagcacctggctgcgccacatggccccaccagcaatgaacctcattgagaaaattcaatcagccaattcccatgtgacaacacttgcagacctactccactgcaagaagctccagggaatgctagctattgattcttatgataaacaggcctctctagcaaattaaaaacccgaaacaaggagctaaaatttcagaaaaatgtcacaatacagatgaaacactaaaatataccagaattcttaagaaatcagtgttttgtttttgtttttgttttttttttgagatggagtctcactctgttgcccaggctgagtgcagtggcgcaatctcagctcactgcaacctccacctcatgagttcatgcgattctcctgcctcccgagtagctgggattacaagtgcccgccaccatgcctggttaattttttgtatttttggtagagatggtttcgccatgttggccaggctggtcttgaactcctgatctcaggtgatctacccgtctcggcctcccaaactgctgggattacaggcatgagccaccactcctggccttaatttttgtatttttagtagaaacggggttttaccatcttggccaggctggtctggaactcctgacttcaggtgatccacgccccccttggcctcccaaagtgctgggaatacaggcatgacccactgcacccagtcaggaatcagttttgaagatgaaaaacaaaaggcattcaataaatatgcaaagtttcctaatctattactttggttcccaaatacttactgttatctcaaactctgtgaaagaggacatgtcaatgacacacacagcttccttacagcacttgacttcagactccacgatgtcaaaccaatctggcttatagaaagtcttgctctgctccaatgccaggaggtctacggaatggaaaaatcacaaggccctgtagagtttagtgtagtccacgtggttctttttcttctgtgaacacattctagcctatgcatttgaaaatacgttttattaattcccaggacaaaaaaaaaaaggagcaaaaatgagaatgtgacttcttacccttgtcagggggaacaaagtactttggcctctcaaatccatgtttctccatccacctggctccctgtgcatccagccggtcgtagagaggagaggtgcgtaactgcctaccggtctggaagtcccagtggggaaccttcagatcatacatcaaagctagaaaagacacgagtagtctatcaaagcccaagacacagattctagacctgagtagccaatatccactagactctggagttgtttctattcaaaagagctttccaggctaacgtagtttgtttttttttttttttaagacggagttttgctcttgttgtccaggctggagtgcagtggcacaatcttggcttactgcaacctccgcctcctgggtttaagcgattctcctgcctcagcttcccgagtagctgggattacaggcacgtgccaccgtgccacactgatttttgtatttttagtagagacagggtttctccatgttggtcaggctggtctcaaactcctgacctcaggtgatctgcccgccccggcctcccgaagtgctgggattacaggcgtgagccactctgctcggcccaatttccaggctaatgtagtctaattttcaaaattacccagtgtatcaggcatgctccagaaggaaagacaatcctgccaagctgctatcgtccctccctggagctacgtgtcacggcatgactcggcctgtattcacattcagcattccacattagtaggtagaaatgatggcagaaaggtcagggtcctaaaccttactaagcttcatagcagagaacaaggttactaagtgggacacaggtggtaacaaaatgtgaaaaaatggcattcgattcttcattgtgcctgtgttaggatctcagacctgttacagacatttcctccctgataattaactcacttctgaagtgaaagggtacatattgtagcttgattaggtggctctgaaatctgagaagttacattgtattgtaccaatgacattattcacacaacaaagctagggtcagaattcatttctcttaggctgggtgtggtggctcacgtctgtaaacccagcactttgagaggtcaaggtgggcggatcacgaggtcaggagttcgagatcagcctgaccaatgtggtgaaaccctgtctctactaaaaatacataaattagccaggcatggtggcaggcacctgtaatcccagctacacgggaggctgaggcaggagaattgcttgaacccaggaggcagaggttgcagtgagccgaaatcacgccacggcactccagcctgggcaatagagcaagactatctcggaaaaaaaaaaaaatttcatttcccttaatgtctaatcttcaacagcaataagtaaaaaaagccagaagagtgggatctgtggtcccttgcaaagagaagacctgatctcacaccgtcccaaacaaaaggcacatcaaggcttggggaggttgggagacaggagaaggaagccaggtggggttctctgcatggtgacaatctctccatctcctggtactttaggttctatcttccccttccccattttcttttctattttttttttttattttttgttgagatggaatccctctctatcacccaggctagagcgcagtggtgcgatcttggctcactgcaacctccgtctcccgggttcaagtgattgtcctgcctcagcctgccaaggagctgggatcacaggcacataccaccacgtggctaaatttttgtatttttagtagagacagggtttcgccatgttggtcaggccagacctcctgacctcaagtgatccgcctgcctcagcctcccaacatgctgggattacaggcttgagccactgcgcctggcgccttccccattttctatgtgcctgccacttctatttcatgagaattggctaccaaaagtgtcatatcaccaagcagaagctcaagctcaattatgatttgtacaggttccaaagtaactatgggtggggaaatttaggcttataatagttcaactttaaaacaaaaaactttgatttttttattttatttttttgagacagggtctcagtcccactgcccaggctggagtacacagtggcaccatcatggctcactgcagcctcaacttccccagctcaggtgattcgcctacctcagcctcccaagtagctgggacttcaggtgtgtgccactaaggcatggctaattttttggttttggttttagtagagacagggtttcgctacgttgcctaggctggtctcaaactcctgacctcaagtgacctacctccctcagcgtcccaaagtgctgggattacagacatgagccagcacacccagccaagttcaacattttaaccaaaatatttgctaaaattaaagaaccttagcagttaaacatattgctgttaggtccttcatctccatggatgtacatcctcttcccaggccaaaagtgagcactcaggcattaaaggccatccagagtcctcaccaacaatgttgttcaactaccaaactaacagtttacttgtaaccaagaatggtggtcagagccaacacagaaacttagtcctgagcataagtatgcccaaaatatttagataccatttggcaaagtctgagaacagctcctcagtacaggaaaatgaaattacaacttgaacccacgtggtttggttcaattcctgatacaaaagctttctaagggcttcctagaaaataaatcagagatcaaggtagaataacaaattaagatgaagtggccagtccttcaaagttgaagcagggcgagaacacgggagtgagagcaggaatgtatgttttgtatttatatgggaagtggctcccaatcttgctgctgtagggtggattaatggtgaaagtcactcacggaagcctgaagctctgagaataacttggcaaattctctgacttggaaagaaaaaactaagtggggagtgagaaagcattttctcaaaaactaagtgggagtgagaaagcattcacttcgacacagggtctctcaaggcagactgcagaaagcacgcacttcgacatacggtctctcaaggcagaccgggaagaaggcattgcttagaatatttatgaagctgctatgtaccaactgtaactcctattctactttcttgttcccagaaggaaaaaaggtccgatgcactaaagaaaatgttacatatatatcatgaggagcataaagccccttaactcaggcctgaaacagtcaaatcaaatgtccaactcaaagcacttgttaaagaactgaggaaaactttgctccttctgaatgacaacacgggccaccgagaagatacctgcaactaggagcaactgcgataaagcttcacttacgcatgacttccatgacccggtggcgcagaaaggtgcggctgctctggagggctccaaaacgtttcaggtccaattcccaaacgttttctgagggataaccatgtaccatccattcggcaaggtacctatatagacagagggcacttgttggggctcaggtgtgagatttgagaaaattaatattctacaaatcgagaactaacagaatcaaaagatcctaaattgccatagaccagctgaatagttttgggcactttccttaacttttctggaagcaacgaacatgggtctgtgtactgctctcaaaagactactatgaggattttaccccagatgataagattccctaggaggcatttaacatagaagccagccagacacattggctgatgcctgtaatcccagaactttgggaggctgaggcaggggattgcttgaagtcaggagtttgagaccagcctggacaacaaagtaagaccccgtctctaccaaaaaaagaaaagtttcaaagtgagccaggtggctcacacctgtaatcccagcactttgggaggctgaggcatacggatcacctgaggtcaggagttcgaaacaagcctgaccaatgtggagaaaccctgtctctattaaaaatacaaaattagccagtgtggtggcacacgcctgtaatcccagctactacggaggctgaggaaggagaactgcttgaacctgggaggcagaggttgcagtaagcctagatcacgccattgcactccagccagggcaacaagagcgaaactccatctcaaaaaacaaaaacaaacaaacaacaacaaaaaaaaaaattagccggcgtggtggcacatgcctgtaatcccagctactcgggaggctgaggcaggagaatcacttgaacccgggaggcagaggttgcggtgagccgagattgtgccattgcactccagcctgggcaacaagagcaaaacttcgtttcaaaaaaaaaaaaaaaaaaagagctgggtatggtggcacatgcctgtagttagttctaactcttctggagtctgatgcgggatgatcccttgagcccaggaacttgcggctgcagtgagctatgatggtgccactgcactccagcctgggtgagagtaagatcttgtttcaaaaaaagttataagcctcatctatgaagaaataagactaaaacacatataaatatactctaaatatccaatgggtttttttctctcacctcaagattatacagttatgtgaccccatctcctttgctccaaacatttttgtaactcctcttctgtaattgtttttagagccattctacaaatcactcaagagaactggtctcataaatttaaaataagcttttcatcgtggctaccatcttacccatttgtaagtattcagttcagtggcagtgggtacattcacactgcggtgtaaccttcactaccatccatcctagaactcttttcctcttgcatttgtggaactctgtgctcattcaagaatagctcccctcccccgcctctggcaaacaccattgtactttctgtctctatgatctgacaactctagcaacttcatataagtggaaccacacagtatttgtccttttgtgactggcttatttaatgttcattagtgtcttattttattttattattattatttttattgagatagagtctcgctctgtcgcccaggctggagtgcagtggcgcaatctcggctcactgcaacctctgcctcccgggttcacgccattctcctgtctcaacctcccaagtagctgggaccacaggcgcccgccacaacggccggctaattttgttcttgtatttttagtagagacgcggtttcactgtgttagccagagtggtctcgatctcgtgaccttgtgatccgcccacctaggcctcccaaagtgctgggattacaagcgtgagccaccgcgcccggcctagtgtctaatttttaaacaaaaacttgtggccgggcacggtggctcatgcctgtaatcctagcactttgggaggccaaggtgggtggatcacttgaagtcaggagttcaagaccagcctggctaacatggtgaaaccctgtctctactaaaaatagaaaaattagccaggtgtgctggcacacgcctctaatcccagctactcgggaggctgaggtaggagaacagcctgaacccaggaggtggaggttacagtgagctgagatcatgtcactgcattccagcctgggtgacagagcaagactgtctaaaaaaacaaacaaaacgtgtattacctagttcaaatacctacctcaatcaacacacttggctaccaaactcaaatacacactcaaatgaccaatatttgttacaattgaaaaaatataaaagaatatcccacaggatctgtggctaactccaaaagatgagttgcaaaaacattttgcctgatgacatttctggaacatggggagcctctcatacttagaaggggacaactccaaaattacatgtatcttcttattagtcttaacatactagattaaatataccacacgccatgttaataacaagtaattctagaagggaagagacccagcaagttgacttatgttcacagctgactttgagtgagaaagacttactttccggctcctccaccaaatgaaaggccagcagagttcattcctgccaggacaaagtagccctacactgcaggagactcgcccatgatgcacctcatgtctgatgcgaaggtctctgggcagttcaccaacttcatgatctccagagtctctaattctggcatcctcctcagaagggaactcaacagaggctctgagcaatgacaacaaaaccaaatagagttctcacctttaaggaattaaaccactttcaacccctctacttttttacactctcccctttcagaaaacctcttgaattttttttttttttttttgagatggagtctcactctgttgccccggctggagtgcggtggcacgatctcaactctctgcaaactctgcctcccaggttcaagcgatcctctcgcctcagcctgccaattagctcagattacaggcgtgcaccaccacgccagctaattttttgtatttttagtagagatggggtttcaccatgatggccacactagtttcgaactcttgacctcaagtgatctgcctgccttggcctcccaaagtgctaggattataggtgtgaaccactgcgcccggctggaagagatttttttaaagacaagccaactgggccatttattacaaagcagaaaccttggtagaattacaggatatagctgcaaaatacttggtataaagactgaggaaaaaagatattggttagaaaggaaagcagcagagaacagcaagtaaaacgtatctacagataataatcttgaagggaccagtgtgagtggacaagctcttaaatggcggccacagagattttaataaaaggtgatgttctgagctgggcatggtggcttgcgtctgtaaccccagcactttgggaggccaaggtgggcggatcacctgaggtcaggagttcaagagcattatggccaaaatggtgaagcctcgcctctactaaaaatacaaaaattagccagtcatgatggtggaagcctgtaatcccagctactcgggaagctgaggcagaaaaatcacttgaatctgagaggtggaggttgaagtgagcagagatcgtgacactgcactccagcctgggcaatagagtgaaactccatctcaggaaaaaaaaaaaaaaggcaatgttctgcattggaatagctgcaaaagacagaccctgctttaaaggaaatctaccatcagggcataatccagtggacagcagaaaaagatgaaaccagaccagagctggataatgggtacatgggggctcatcacactactctcgccaggtttgtttagtagacacatagtctccagtctcgccatgttgcccaggctggtcttcacttcctgggctccagtgatcctcccatcttggcctcccaaaatgatggaattacaggtgtaagccactgtgcccagcttctatccagttttaaaagtttgaaattttccataagaatttattaaaaaacgaaagcccatcaagggtcagagggaaattcttcattagagactctttcacctttttaaacttggaactaggtaactacattattattattattattctttttgagatggagtctcgctctgtcacccaggctggagtgcagtggtgcgatctcagcccactgcagcctctgcctcccgggttccagcaattctcctgcctcagcctcccaggtagctggcattacaggtgcgcgccaccacatccagctaatttttatatttttagtagagacgggtttttgccatgttggccaggctggtcttgaactcctgaccacaggcgatccgcccgccttggcttcccaaagtgctgggattacaggccttaaaggccaggtgcagtggctcatgcctgtaatcccagcactttgggaggccgaggcaggtggatcgcttgaggtcaggagttcaagaccagcctggccaaatagtgaaaccccatctctactaaaaacacaaaaattggctctgcgttgtggtgggcgcctgtaattccagctacctgggaggctgaggcaggagaattgcttgaatccaggaggtggaggatgcagtgagctaagatcgcaccactgcactccagcctgggcaacagagcaagactccatctcaaaatgaatgaatggatacataaataaacaaataaaattattttaaaatttaataaaatactacactaacaaaacaattctgaaaaacaaaacaaaacaattctgttttctaaagaactcctcaattttatatgaagtcctactgaaagaagtctcctcctaaaacctaaaatctgagcaataattttaggtgaataaagaataagcaggggccgggcgtggtggctcatgtctgtaatcccagcactttaggaggccgaggcgggcagatctcctgaggtcaggagttcgagaccagcctgaccaacatggagaaaccctgtctctactaaaaatacaaaattagccaggcgtggtggcgcatgtctgtaatcccagctactcaggaggctgaggcaggagaatcacttgaacccaggaggcagaggttgcggtgagccgagatcgcaccattgcactcgagcctgggcaacaagagtgaaactccatctcagaaaaaaaaaaacacacaaaaaaagaagcagagctgggcacagtggctcacacctttactcccagcactttgggagaccaaggcaggcagatcacttgaggccaggatttcaagaccagcctggccaacgtggtaaaaccctgtctctactaaaaatacataaactagctggacatgttggtgcacgactgtaatcccagctactcaggaggctgaggcatgagaatcacttgaacctaggaggtggaggttggagtgagccgagattgtgccactgcactccagtctgggcgacagagcaagactcttatctcaaaaaaaaaaaaaaaaaaaggccagacgcagtggctcatgcttgtaatcccagcactttgggaggctgagggaggtggatcacctgaggtcaggagttcaagaccagcctgatcaacatggtgaaaccctgtctctactaaaaatacaaaaattagtcaggagtggtggcaggcgcttgtaatcccacctaccacctactctggaggctgaggcaggagaatcacttgaaccggggagtcagaggttgcagtgagccgagatcacaccactgcactccagcctgggcaacagagcgagacttcatctcaaaaaaaaaaaaaaaaaaaaagcagctgggtatcatggctcatgcccgtaatcacagcactttgggaagctgaggcaggaggactgactgagcccaagagttcgagaccagcctgggcaacacagtgagaccccatctcaacaaaaaatttaaacattagctaggcatggtggcaagcacctgtagtcccagctacttgggaggctgatgttgcaggatcacttgagctcacgaatttgaggctacagtgagctatgatcatgccactgcactccagcctaggtgacagggcaagacgccatcttacacacacacaaaatgatagagatgactaaacacacacacacaaagggctaggcaaagtggctcacgtctgtaatcttagcactttgggagtccaaggtggaagggatcacttgagcctcggagttcgagatcaacctgggcaacatagcgagaccatgtctctatcaaaaacaaaaaaaaaaagctatgagaccaggagttcggggctgcagtgagctataattgtgcaactgcactccagtctgagcacagagcaaggctccgtctcaagaaataaaagaaaaaagtaaaactaagaataaaattaaaaaagaataaggcaaatgtccattaactaagattttagtcccctgaatctgctacctagtaactccatcctcagaccaggcaaactcaccctctgtaaccactgttgtacctcatggcgatgttataaacattaaacaaggaactattcttcaaaagactttgaaaaatataacatcttaaacaaatataaggcactactgttataatgcagttcacataccaaagtgatcccagtcccctgtagattctgaatctccagctggttcttgccctcagtgaaaattggttttgggttcttctcaaagcccccagacaggatgccaccctgccagttccgaatataaattcttccatcagcatccacaatagctgaggtggagaaatgacatggagtggggagtggaagaaaaaacaagggtttagaggcaagtcagctttctaaatggacagaacaaccaaacaaaaacacccattaatggctttattaatgaaagaacattcaatgaacgcaggcattcattagctttaaaataccttttgaggtcacgggggaagatcctcccatttagcctttcagtggagactgtttctctgattatcccttacctagaagctttgactagtccccaccacgtaactcccactgtgccaagcgaaagtttaacggaaagggggattgcagagcccattctaggcatgaagaccgtcaaaaggatgtgagaaccctctcctatagtgcttggaaccacgaacccacctaagtctatcgtttacctatgacatttctactatccatagtattcaagttaaaaagtcaacaagacagtccaaatattctcaatgacctctgtttaagactaaaattagcttgcaaaacaaaaaacaaaaacaaaaaaatgtattaatggaaattttggccatcctttcataaagagttaataaagaaaagtcagaattgggtccacctccctgtaacatgctctagaaatgaaagactctttcagacacagtctgtccttagcagaaagttttccttttcagaggacaggacactggcaaagaaacaagattttttaaaaaagtgcaagtcctcacttggtgtgctgctctgcagaggggtctccaaggggcgagtcaggaggtagaagtgttcgcaggcatgtagcgggatactaaccggctcctcgttggacagacccagctcgtatgcccactacaaatggacaggttgatttgtgggtgggaaggggaacagaaataaaaatgagcaagttcagcctcttgagattaattccaagtggcttatgtgtgctcttgctacagtgtcaggtgtgggaagtcagcctgctttagttcaattatttggatggggagcaatactacattttttaagacataaaaattactttgagatcaaaggaagagatatttaccagctagtcaaaggagctcatgggaaccaaaggaggtccttttgataaaacgcctgggctcagctacaaaccccaaatagcaatcactaaatgaacttcacgtggcaaaagtatttcttagttcacttcgggatcatagcatggaaggcaagagccaatctgctttaaaagaagcagtgtcccggaaattagtgtccacattcctgacacaataaaatagcctaatatgttatttgctaggttgtagaatgaaatgtaacaccaagacccagcgccaaggattcacgtcaatgcctgaccatttgctggccttcctgaccaggatagcacccatcaacccagtgtggaggaaggacaaggtcacacaggcttctatttgcagactaagtgtaggtttctgatttagaataccctacaagaaacagcatagttactgatatctgtgtaatgaatcacaatactaaccttacttctctacaccaaaaaaatcttggagacatacgttaaataagaaaatcagtgttggtgctgacctacctggccagcacagttgacaaaatactggcattcaatctgtcctttatcggtctccactccagtaacttgaccttttttgcccattacttgaagaacagatgtccggtcatagatctgaacacctgttccaaggtaaagaaagagttggtgcttcatctgatgttccagaatgaaggcatgtgcagcaggttctccacccagaagaaacactgacaaagtcaagtcaatgctttaatttatttttttattttatttttgagacggagtcttgctttgtcgccaagggtggagggtagtggtgtgatcttggctcgctctctgcctcctgggttcaagcaattctcctgcctcagcctctcaagtagctgggattacaggcatgcaccaccatgtcctgctaatttttgtatttttaatagagatggggttttaccatgctggtcagcctggtcttgaactcctggcctcaggtgatccgcctgccttggcctcccaaagtgctgggattacaggcatgagacaccacgcccggctcaatgctttcatttaaaaaaaaacacaaaaccctagaatcacatcctgagactatgtaaatgggccttgttcgagattgaaaatagcaagtcagtttaaaaacagactttggaacacaataattaaattcctggaatcataaactatggagcaaagaggagaggatgtaaatagtgcgccttaagtgctaacctgctcataccatggatatgataccctggacactagttaagtcttcccctcattcaatgcaactgggcttatgatttcaggtgtggattaaacttccaaggtgtgttttcaccttgagcttctcaagtcctgtgggggaaaatattaccttaagtccaaagggcattaattggcagggcacagtggctcacgcctgtaatcccagcacttagggaggccgaggcaggtggatcatctgaggtcaggagttcaagaccagcctggccaatacggcgaaaccccgtctctactaaaaatacacaaaaaaattacctgggtgtagtggcgcacgcctgtagtcccacctactcgggaggctgaagcaggaggatcacatgaacccaggaggcgaacgttgcagtgagccaagattgtgccactgcactccagcctgggcgaaaagagtgaagctccgtctccaaaaaacgggcattaattagcactaaaagcagttctttagaactttaaaaatgtggccctgagggaaaacactcattaacagataaataaaattataagtgttcaaaatggaggctgagtaccccaaagaggataatctttccaaacttgagttggtgtcacttcctactgtgagacacttccttaggtaatgtcttccctgctaacctatcttaagaaaatgcaaaaacctgctcaccattttgggaggcagcacttgccagggcaagagccacgtcagcggaagacaccactgcatcctcaggaacatgcatggcccccaccaggtcgtgcacgttgaggagatggtgaagctcggccactttcttgggggagatgatctcagaagggatacctataacactgccacagaacacaagggacaatgacattcacaggctctttggcagaggccagtgtggtaaagtcaggacacgcttctagactcttacgtacttcagccctgcgttgatgcgcttcagggagatcagtcggtcctgagtttgggccagaaagattgagcctgtccttgtgtaacctgtaagaaaaatgagcccaaatgagacagatcagaccaaatgtaggacgggagagtggaaaatccactagattataagttagaaggcctgtgatgaatcctgggactgccactcaatatccttgggcaggtaaatcagcttctctgagcttctttgcaaaattttaagaacttcagatgcactaaggctccatgccctgaccaaacattctcagctcacagttttgtgaagttgtgaggatcaaatgagattctaggccaggtgtagtggctcatgcttgtaatcgcagcactttgggaggctgaggggggcggatcatctgaggtcagtagtttgagaccagcctggccagcatggtgaaaccctgtctctactaaaaatacaaaattagccaggcacggtggtgtgcacatgtaattccagctaccggggaggctgaggcaggagaattgcttgaacccaggaggtggaggttgcagtgggtcaaaattgcaccactgcactctagcctgggcaacagagtgagacttcgtctttaaaaaaaagaaaaaaaaagaaaaagacagttttgggcagggattcgaccatccctattcttcccaccttttaggcagtttcaccctttctcctcctagtcttgggggagtgtaatccttagcaaaggccactcacaataacatcagctaccaagggtcggattctcccttcttcttccccagtatagccaaacagtgggcatgcgacctaagcttatccaatcagaccctcctggaacagtcagtcttgagcacgtaggtgaatggctagaggtcaccatctcaagggcagcatcagccaggccaggctgctcctgttctggctgagggactgcctgcggtgcagtccccacatcctggcttccaggctgcctccagctggcagcctcctgccaactccacaggcccaagctcctcccaacaagctccaagttggccagagtcaattcctgttgtctgtaatcaacacacctgatatagaaccataattacacttgggccaatgacaattctcctaaaatacaatgactcttaattcttatgaagaaagagttgaagcaatttggtatcttattttcaaaagaagtacagtaaggataatttacatattttcttaatttcttagtagagacggggtttcaccatgttagccaggatggtctcgatctcctgacctcgtgatccgcctgcctcggcctcccaaagtgctgggattacaggcatgaaccaccatgtttaaaaccggccaacccaagttttaattaccaaagcagtaggcacacctggcagaggaccaaatacagaaatgaatataacaatctcagggacaggcaaagcaataaatggaagacacttgcttacctgttcggatccctgtttcttgctctaactgatggtagagtttgtttgagtagtctgccatcttctgctcaatggtcaagtgcctggcagtgctcaggatgccagcacagaacctggtagagccagcagccagcctgcaggatggatgcaaaatgctattaggtagattgacgtcatctgtgaatacgaggtcagggtttctcatttaatactgtttctaataccaaaagatggaaacaagctgggcacagtggctcacacttataatcccagcacttgaggaggccaaggtaggaggattgaggactgcttgaggacaggggtttatgaccagcctggtcaacacagggagaacccatctctaccaacaacaacaacaaaattagccaggcatggtagcacatgcctgcagacccagctacttgggaggctaaggccagaggagcccttgagttcaaaaggtagaggctgcagtgagctgtgatcacatctctgcactccagcttgggcaacagggtgagaaaaatgttcaatgacatgggatagatttaaaattttgtatagtttaggccaggcacagtggctcatgcctgtaatcccagcactttgacgggctgaggtaggaggttcacttgaggccaggagttcaagactggcctgggcaacatagccagaccatgtctctaccaaaaaaaaaataaataaaaataaataaataaataaaaataaaggctgagtgcggtggcttacgcctgtaatcccaccactttgggaggctgagatgggcggatcacaaggtcaggagatcaaaaccatcttggctaacacagtgaaaccccgtctctacaaaaaatacaaaaaattagtcgggcatcatggcgggcacctgtactcccagctactcgggaggctgaggaaggagaatggcgtgaacccgggaggcagagcttgcagtgagtcaacactgtgccactgcgttccggcctgggtgacagagcgagactccacctcaaaaaaaagtaaaaaaaataaagataaaagttagccaggctacttgggaagctgaggcaggaagatcccttgatcccaaaagtttgcggctgcagtgagctaccattgtgccactgcacttcagactaagcaatagagcaagaccccatctctaaaataaaataaaattttggaattcatctatacaatggaatattatgcagctataaaaaagaatgaaaaggtctttatgtaccaatatggaacaatcataatgaaaaagtaaggtgaagaacagtgtgtaaggtatgctcccacttatataaaaaagggaaaaaatataataaatgaatacccatacacatatacacaaacctaccaacacataattgcttatagaagtagagaatataactagaacttaacttccctccagagaggaaagctttttgttagaagtgaagattgagggctgggtgcagtggctcacatctataatcccagcactttgggaggctgaggcaggcagatcacttgaggtcaggcgttcgagaccagcctggccaacatggcgaaaccccatctctactaaaaacacaaaaatcagctgggcatggtggcaggcgtctgtaatcccagctattcagaaggctgaggcaggaggatcgcctgaacccaggaggcagaggttgcaggagttgaggctgcaccactgcacttcagcctcggtgacagaacaagactccatcttaaaaaaaaaaaaaaaaaaaagaaaaggaaagaacattgaggagtctttttcctgtatactcttttacatatatatatgtgtatgtgtgtgtgtgtgtgtgtgtgtgtgtgtgtgtgtggtgtgtgtatatatgtgtatgtgtatatatatacatgtgtgtatatatatatgtgtatatatatatatatgtttgtgtatatatatatgtgtgtgtgtatatatatatatatatatatttttttttttttttttagacgcagtttcactcgtcacccaggctggagtgcaatggcacaatctcggcttactgcaacctctgcctcctgggttcaagctattctcctgcctcagtctcccgagtagcagggattacaggtgtgtgccaccatgcccagctaatttttgtgtttttttttttgttttttgtttttttagagacggagttttgctcatcactcagattggagtgcaatggcacaatctcggctcaccgcaacctccacctcccaggttcaagcaattctcttgcctcaacctcccaagtagctaggattacaggtgtacaccaccatgcctggctaaatttgtatttttagcagagatggggttttgccatgttggccaggctggtttcgaattcctgaccttagatgatccacccgcctcagcctcccaaagtgctgggattacaggcataagccactgcacccagcttcttttacatattttcaattttgaatcatataaatacattgcctattcaaaagtacataaactttacattgaaaaaaatgttctctaatttgtggtagcaacagaatataaaggctacagtaatgctagggcccaaagacccagttttgcaagggacccatatgtgaagaaagcaggtgggggggttctaaggtcattttccccaaattatttatcactcagtaaataaactaacatctgtgtcagcatgcctgtcacttgagtttactgtatttactctaataattatattttccacataagattgtcagctccctaaagagatttttctatcatctttgtaactgtgtggagctccaccccaggtgggagttccattaactggctggtggtcagcacctatagctctggtgacgtctctgctgggatagcactccttgagcagctttgacagtggctctcgcccttggaggtacatcagagtcccccgggaagcttttaaaaatactgatgcctggcctcacccctagagattctcgtttgttctggggagagatctgggcactggtaattgttaaaagctccccagctgattctaatgtgcagacagatttaagacccattgatctatgagaacaatagtgaagatagagaagaggaataattatagataaagggcagtataaaaccatttcacaagccacggataaggcataagaataacttttattttttgagacagtctcactctgttgcccaggctggagggcagtggcacaaacttggctcactacaatctccgcctcccaggttcaagcaattctcctgcctcagcctcctgagtagctacaattacaggctcataccaccacacccagctaatttttgcatttttagtagagacggggtttcgccatgttgggcaggctggtcttgaactcctgacctcaggtgatccacccaccttggcctcccaaagtcgtgggataacaggcatgagccactgcacttggccgagccataattttttttttttttgagactgagtcttggtctgttgcccaggctggggtgcaatggcgcgatcttggctcactgcatcctccgcctcctggattcaagcgattttcctacctcagcctcccgagtagctgagattaacagatgcgcataaccactcccggttaatttctgtatttttagtagagacggcgtttcaccatgttggccaagctggtctcaaactcctgatctctggtgatccactcgccttggcctcccaaagtgctgggattacaggcgtgagcgatcgtgcctggctggcataattatttttaagtgtgaggtttaaatagtctgccttatatcaattctaaggtattatataatcttgaagcaacaaattaaaccacaaatgaacctccctaggttctcccacttagaaacatttacactgagattagtttatcactttttgtggaaatacctgataattaaatttaaaaggatttcaaaaaataggagaacgactttgacatcaaggaagcattatgaggccaagtgcagtggcccacacctgtaaccccagcactttgggaggttgaggtggtccgatcacttgagcccaggagtttgaggccagcctggacaacaaggtgaaatcacgtctctaccaaaaaaacaaaaaattagccaggcatggtagtgcatgcctgtagtcccagctactcaggaggctgtggtgggaggatcacttgagcccaggaggcagaggttgtagtgagctgagattgaaccactgcactccagcctgagtgacagcgtgagaccctgtctcaaaaacattaacaaaaacaaaacccacttttgctcttaaaagtatccactgcaggccaggcacggtggctcatgcctgtaatcccagcactttgggaggctgaggcgggtggatcagctgaggtcaggagttcaagacctgcctggccaacatggtgaaaccccatctatactaaaaatacaagaattagccaggtgtggtggcatgcaactattaatcccagctacttgggagcctggggcaggagaatcactggaatccgggaggcacaggttgcagtgagctgagatcacgtcaccgcactccagcctgggtgacaaagcaagactctgtctcaaaaaaaaaaaactatccactgcataaaatagaaatccatgagtctaaactggggtgtgtgtgtgtgtgtgtgtgtgtgtatacagatatataactgagtaaataaatgggggagaaggaaatctcttcctgacagtaatatgccaactataataaatgtagaagtataatcaaaaaatcaccatttgtcaaccatcatggtggtggctgactcaggcaacagttgtcaacggatgctaagcccggtaggtggaggtctgatatgaacaggatattggcataatctcagaatccatctctcctcaaagggcactggccagttacaaggggagaaaacagggtctctgtgctagagatgcttggaggacaccaatgtaactgggtgaccagggttatcaccaccagaagtgagacaggacagccatacacctcctgatgtggtgcactgctgagagtccagcctaatttctgtggtcttactgccaaaaatgtatgacctggttatgatgatggatgcacaactctgtacaaacagatttcagcacttaacaaggatgagtggcatggtatgcaaattgtatctcaatacagtgatggttataaaagtctctaacccaagtctgatcataagacaacagcctaggccaggtgtggtggctcatgcctgtaatcccagtactttgggaggccaaggtgggtggatcacctgaggtcaggagtccaagaccagcctggctaacacggtgaaatcctgtctctactaaaaaaacagaaattagctgggcatggtggtgggtgcctgtaatcccagctacttgggaggctgaggcaggagaattgcttgaacccaggaggcggaggttgcagtgagcggaaattgcaccactgcactccagcctgggtgacagagagagactccatttcaaaaaaaaaaaaaaaaaaagaaagaaaagaaaacatcctaggcaacacagggagatcccatctctacagaaaaatacaacaatcagccagatgtgatggtgcatgtcagtagtcccagctacttgggaggctatggcagaaggactgcttgaatccacgaggtcaaggctacagtcagctgtgatagtgtgactgcactccagcttgggtgacacagcaagaccccatcttaaaaaaaaaaaaaaagagaagaagaaaacattagctaaacacaggctgagaattatcagagtgaaaggcctgtattcttttttttttttttttttgagacagtcttgctgtgtcacccaggctagcgtgcagtggcatgatctccactcactgccacctccgcctcacagattcaagcgattctcctgcctcagcctgccgagtagctgggattacaggtgcacaccaccacgcccagctaatttttgtatgtttagcagagacaggttttcaccatgttggccaggctggtatcgaactcctgacctgaggtgatctgcccacctcagcctcccagagtgctgggattacaggtgtgagccaccatgcccggccaatattgttgtatgaatctaacattacttgtatagtggtataatattaattaatgatggattataagaatccattctgtaatctctgtaactattacaaattaatataaagggacttagcttacaagccaatagagcagaaaatacttgacctaaaagaaggtgagcacagagaaactaagcctatagagcatatttctcttggagaatgagaacaatattaagaacctagcaattaagcaaacacaagcagttgtctgctttgcttaaatgcagtccacattatttacaaacacaaatttttgtcaaagtctaaaatgttgctgggtacagtgggtcatgcctgtagtcccagcactttgggaggccaaggtgggaggactgcttgaggccaggaattcaagctcagcctgggtaagaaagcgagatcctgtctaccaaaacaccaccaccaaaaaaaaaaaaaaaaaaaaaaaaaaaaaaaggaaaacgacgaaatttgccaactctctaaaaaccagagaacatgagcattattagtcatccttaaacaaaattcaggagattccaccttgcttcttctcatgctacttagcaacatttagattagctactggtggggcagtatctctgaaaggagagggaatctgatacgattagtgcagcacagccatgagccaaatgcagtctgatccttacctgccctgctccaaaaggacaatatccttccaccccattttggattggtgatgggccacagaagtgcccgtgattccacctccacagacgaccacctgtgcctgggtgggcagggccatggaacgcgcctcggcagctgatgcgctgtttcttgcagaggaccagttctgccatcctgggctggctctttgtcttccaacaatcgacagcaaccagtagaacatcatgtctctcaccaactagatctcaggaactcaaactagacagagaaaccaaacatatttcatgccattcaactcagtgcatgggattaatgagaaagggatttgacaaagaacgatagccattcattcagcaaatatttgagggtggccgggcgcggtgcctcacacctgtaatcccagcactctgggaggccgaggcgggcggatcacgaggtcaggagatcgagaccatcctggctaacacagtgaaaccccgtctctactaaaaacacaaaaaattaggctgggcgcagtggctcacatctataatcccagcactttgggaggccgcggcgagtggataacgaggtcaggtgttcgagaccagcctgaccaacatggtgaaaccctgtctctactaaaaatacaaaaattagctgggcatggtggcgggtgcctgtaatcccagctactcaggaggctgaggcaggagaattgcttgaacccgggaggcggaggttgcagtgagcagagatcgcgccaccgcactccagcctgggcgacagagcgagactccgtctcaaaaaacaaaaacaaaaacaaaaaaagaaatatttgagggcattctgagtttcagatattctgctagcagtgaacaagaatggggaagtccctgtctttatgaaatttacatttgagagtttgcgtgtgtgaatgaggagagcaccaatcaatatacaagtaaacatacaaataaaacagtaaataaagctaatgtgatagagtaactaggggcatatttaaaacaggatggtcagaaacagcctccaaggaagtgacatttggaaacagacctgaaggataaggaacgagctatacatttggcagacactgagacgagcatgtgcaaaagccctgaggtaagacagaccaagaacaaaaaggaggccggcatgtacacgacacggggagtgtggggagatgatctaagacaatgctggagaggcaggcggaagccagttacacacagcccttgggtgccatcagcaggagttggaattttattcaaagtacaaaggaaaatcactcatgcgggagtatcactagcaggggaatgaaatgatctgggatgtttttcttttctttgttttttttggcggtgaggggtggggggatgttttccaaaggtcagtctggctccatggtggagagcggatggtagaattataaaaacagagtcgacttcctaggctcaagtgatcctcccaccttggtctcccaaagtgctgagattacaggcatgaaccactgcccttggacaaggcagggttttaacaaacttaatctatcagcaaaacagatgactgttcaagtttcaagaaactgaagaagaaagcacctactggctgtccatgcagtcatgtgtacaggaggatgaggactttgagacgagaggcggtagacaagggggcctcagggcagctcactgctagtcatctccttaccgcctccactgccagccacaggacccacagatgctccacagtcagcccaaattgtccaaggccaaggtatctatgtccatccatcagaattgcaaccaatgcaagcacagactatgtccagacagacatcccatccaactggagacaaattgtcttggccaccttgtggttgccaccatgcctctcatccctggtccctgttaagcaccatctcaaaacagaagcttctctacccggctagtctttacataatctcatctctacgtgaccaatttatttcccgtggcccaagctctctttgctttcctctccttcaagctcctctactgcaccctctagaatacctttcccaaaggtaaacacccacccctttgctgacatcctctctaccctctgtcccaatggcaacacagctctcctggggaactgctgctgccaaatggccagccccatcccattgacctcactgtcaacctcctggcttctgacccgtgaccactcggttatacttgaaaactgtcctgctccttggtggcttaggctagcacatgttaagccacaggtagacctctgtctgtattcaggttcagagcccagctattcctctctcaaccttcaacttcacctcctttcttccctcattctaagcagataacctggctcatctcattccctgaaacccttcctatagacccacttacatctgcaaccatctcttccttcttttatccactggaaagttaatctcccccaagggccctggatcccacttcctcctctcttctcttgaccctagctccatcaactgctgtctctctttcctgtacctgcaatgtttccctccgtttttgctccttttcctcagcaatttttttttttttgagacggagtctcgctctgtcgcccagttgggagtgcagcggtgtgatctcggctcactgcaacctctacattccaggttcaagcaattctcctgcctcggcctcctgaacagctggcactataagtacgcgccaccacgcccagctactttttgtatttttagtagagatagggtttcgccatgttaattaggctggttttgaactcctcacctcgggtgatccactggccttggcctcccaaagtgctgggattacaggtgtaagccaccacacccaccttaatgactttctgatgccctcaggaaaaaggcaaaactcttttcatatcaagtgcaagatccttcacagtctggttcttatctgtggtctcatttctcctttcctcacactctgaccaagccagactgaacaacctgtaattcgtcaaacatatcaggtgaggtgtgaatgttctattcggctccaggttctgtgcatgctgttccctcctggcaggttcctgccacccctcccgcaaatacaggtaatctcctcaggtcacagcctctttgacatcttatttatttattttttttgagatggagtctcgctctgtcgcccacgctggagtgcagtggtgcgatctcagctcactgcaagctctgcctcctggattgatgccattctcctgcctcagcctcctgagtagctgggactacaggcacccgccaccatgcctggctaatttttttttttaatttttaggagagacggggtttcaccatgttagccaggatggtctcaatctcccgacctcgtgatccgcctgccttggcctcccaaagtgctgggattacaggtatgagccaccgtgcccagccctgtctttgacatcttatctgacaatctccccctccttctccaacacttggttaggtggcttttctatgttctcctataacacactacacttctcccagcacagaacttaccacactgcacaatggtctgtttgccaatcagagaagcaacatgccagcatggcagggaatccaggctttgggggcggacagttctgggtttgaaaatatccccacctctcactagctgtatgactatcagcaagttactaaatctctaggctttgaactcctcatctgtaacacgggctagaaacacctacctcacatggttgctgcaaagactaaatcagacaaggcaggaagaacatggtacaagcacctaagaagcactcagtaagtggtagttattttttattattttttgagacgaggtctgtcatgcaggctggagtacagcggcatgatcatggctcactgcagtctcaaccacccagactcaagcgatcctcccacctcagcctccagagtagctgggaccacagatgtgtaccatcacactcagctaattttaaaattatgaatatttgtagaggtgaggtctcactacgttgcccaggatggtctcgagctcctgacctcaagtgatctgcccacattggcctcccaaagtgctggaattacaggctaagccaccacacccggcctattatttccctattataatggaactaagagcagaaaccttataaattgctcaattttcccagcgttcagcataggtacctaggaaatatatgttgatgcatgaatgagaacagagaacaaagaagatggggggaaaaaatcaaaggtaggacccccagatttgaggagatatctaaatacctgagagaattatttttatttttatttattgtgaaacagagtctcactctgtcgcccaggctgaagtgcagaggcgtgatctcagctcactgcaacctctgccttccaggttcaagtgtttctcccgcctcagcctcccgagtagctgggattacaggcgcacgccactgtgcccgactaattttttgtatttttagtagagatggagtttcaccatgttggccaggctggtctcgaactcctgacctcaggtgatccacccaccttggcctcccaaagtgctgggattacaggcatgagccactgtgaccggccaataatttttaaagctaatatttttataagtagttacaatgcaccagatactgcctatgtatataactaatttaatcctcacaaccttatgaggtagatactagcatttctattctacacttgaggaaacaggcacagataagtggaagtgactcacccaaggtcctaccaaactgttgagtagcagaaccctgccaatttggcattagtggccggctatttaatcatgactccacgctacctttcaaataaaagcagatggtaaggaaaggacagctgtgaggactgaaccattaagcacattcccctaacagagaaagggaattgcaaaggtggcagaacaaacacagtaacagatgagttttaaggaggaattaaaaaaaaactttaggccgggcgccatgtctcacgcctgtaatctcagcactttgggaggccgaggcgggtagatcatttgaggtcggaaattggagaccagcctggcaaacatggtgaaactccgtctctaccaaagatacaaaaaattagctgggtgtggtggcacgcacctgtggtcccaggtactcatggtgcggccaccattgcatcttgggcctcactaaccagttcccgtttgttggattcaatactgtctcaccacacaggccaatcttgtgttttattaattttttaaatttttttttttttttttgtagagatgggctcactatgttgcccaggctggtcctgaactcctgaggtaggaggatcgcttgagcctgggagacagaggttgcagtgagccgagattatgctactgcactcctgcctgggtgacacagtgagactctgtcttaaacaaaacaaaacaaaaaaaggccaggcgcaggggctcacacctgtaatcctagcactttgggaggccaaggtgggtggatcatttgaggtcaggagtttgagaccagcctgatcagcatggtgaaaccccgtctctactaaaaacagaaaaattagccaggtgtcgtggcttgcacctgtagtcccagctactcaggaggctgagacaggaaaattgcttcaaccagggagatggaggctgcagtgcgcagagtcgcgccactgcctgggtgacacagtgagactccatctcaaaaaagcccagggtgcttggcgccaaaaaagggatctctgaccttgtgttcattatgaccttcaaaagagtgaagtggtgagggcatgagggcagaggaaaagaagggcttaagacaacgaaggaaaagaaggcaccagagtctagtgcctttgccgccaaacctaagcctataaggttggcagcaaaaccaaagcacaaactgatagcaaaggaggtaaagccaggggagaagaaactgaagacgtcaaagacagaaatgaagcacatcatctggtttaaaacaaatgatagagtttttacagttctggaaaatgaccgtataatattctctgctaagaagaataacttctgctaaacaaccataagactgcagctggctctactcagatctgcttattccaacaagaccaaggtgctagttctaacttcgagtagtccctctgtatggctgcagcgttgcgcacagtggactgccggtcacaaggaagactggatgagcgtgggttcacacatttcccacacttgcctcagcaaaagaaccacctgggacacttgtttaaaaatgacagattcccacggtccacctcggcagattctgatcctgccacgccagggagctgtatttttcaacaagtacaccaggtgatcacgcaagtttaagaaattagcacaagttggccgggcgcagtggctcacgcctgtaatcccagcactttgggaggctgaggcgggcgaatcacgaggtcaggagttccagaccagcctggccaacatagtgaaaccccgtctctactaaaaacacaaaaattagccgggcgtggtggcgcacacctgtattcccagctacttgggaggctgaggcaggagaattgcttgaacccaggaggcagaggttgcagtgagccgagatcgcgccactgcactcccgcctgggcgacagagtgagactccgtctcggaaaaaagaaaaaaaaagaaaaaagaaaaaagaaattaacacaagtccctgccactggaaacgcatatccgttgggctggctcctcctccaccaccagcccccatcccggtacatcacgtttacatgcatgcggaaaatgggcttggagattcttgattcaaatccgaggtatcacacatcggcccccaaaggtcaaacattaagaaggaagcttactgccctgtcccagacttttctaggtgacttcttcctccggactctgcagcagtcttactagttctgaaagcacaagcggaccgcacgtctcaacgcgggaaaacagttccatctgcagggatggaggaccgggctagacaagctggagttggctctgcgccgcaggggtgtgcaagcccaagactggggagcccgaggtcaccccggccgccctggcatcggggctgaggtgcaggctcctggaggagcggtgcgcaggcccaggggtagccgaggacacaagccaaggcacgagcggacaaccttacggggacgagtactaccgcccggacgcgacttcgcgagaggccaggcggaacccactggaagcgtgagctagcggggaccacccccgggcgaaaccaaaggagaaagaggggaacccaggggtcccggggcgcttaggcccgcgcggacggggaggccagagttgccccgaagctatctccttacctcaccggcccccacgggctccgcgctcagctacagcccggcgggagcaatgcggcagccacaacagttgccggcggtcgccgcgggccggaaagcggggttcggggatgggaagggggcggggcgaagcgagcaaaaagttccggggaagccgagaccgcgaccttccgcgctttacggcccccgggcacgggtaccgccggcgcgtgacctcagccgcgcccgagcgcgccgtgacgccctcgcggagccccgcccctgccacgtgggcttgtttgggtctcgcgaggcaccgcccccgcggcctctttgccaccctcagaggcgagctgtggaagccttgactcttagggccgttttagaacccgggcctcggaccggcggggtttctgcacgtggaaccggaacatctgagatgatcgcaggccctgtggagtgtggggagcgcgggggttctttcttccctcgaggcccgtgccagggcttactccaaagccagtgggtccccagtcctaagccaagcagtcccgggggaaaacgcttctcatcgccgtgggagcgcggatcttggaagtggctctgggctttcttgggcgaggctctcacagagtagatcggaaatccattctgctggcccgccccacctcggaggacggactaacggacctgagttcccggccctatcttactcttctcagcttctcagcttggctcagctcagaggaagaggaatcactgaagtctcagagaagtctccactcatcccttcctcaccgtcacatcagccttttctttccttctagaagtcatcactgactcaaggatataagtttgatgactgtcttttccactggtgtgacacgatctctgtcgacagaaccttagtcttatgcatagctttattctcagcacccagaacagtgcctggcacctcttccactgaatattatatgcataagggtctcatgctgcagccaccattgcatcttgggccacactatccagttcccgtttgttggattcaatactgtctcaccacacaaaccaatcttgtgttttattaattaaaaaaaattttttttttttttgtagagataggctcactgtgttgcccaggctgggcctgaactcctggcttcaagtgatccttccatctcagcctcccaaagtcctgggattacaggcgtgagccactgtgcctgccccaatcttgtgttttattgctggccacctgtagccaggcactgtgcaggatgatgggatccagcagtgtacaagaaagaggcggtttctgctcttagggagtggcagtcaagttccagggacccctctgtcacaaggccaggccacagcctacatagtttataccccatttactggccagtcaaatcacacaaagacagcccagatgaggtctgccagacagtggactgaaactatgccataggctcctgtgctagataaatacttccatattttagctaggattgaatgcttggggacacctacctgtctaaaaaaagagaaaacggctgaccaatttgagacattctcggggaaggctttcctgatgcccagatgtggcaatttcatgaaaaatatcacaggttttcctcatgaaccatttggttcaagccatttccaggcacatgaatttgggagaaacctggttgtctgcaggagatggtggatgaaatcaagtgaaatacttaatgtgttgatttcattctgtttacgtgcagtaaatagcaaacaaatggtatagatctgtccctgatttccttctccatcaccatgatcggcctccactccaaaatgctaagtcaggctgggtgcggtggctcatgcctataatgccagcactttgggaggccaaggcagttggatcacgtgaggtcagaagttcgagaccagcctgatcaatatggtgaaaccccatctctactaaaaaatacaaaaattagctgggcgtggtgacacatgcctgtaatcccagctacttgggaggctgggacaggagaattgcttaaacccaggaggcggaggttgcagtgagctaagattgtgtcactgcactctagcctaggtgacagagcgagactgtctcaaaaaaaaaaaaaaaaaaaaaggaaggaagtcctaaggcccctttcattgtcaaagatgggtcttgtccttagtaggttctcataaccactgatgcactattttttctagggggttgagtgtttttattttattattattttttagatggaggctcactctgttgcccaggctggagtgcaatggcgtggtctcggttcactgcaacctctgcctcccaggttcaggcgattctcctacctcagcctccccagtagctgggactgtacaggcgtgcgccaccacgctgggctaatttttgtatttttattagagacagggtttcactatgttggccaggctggtcccaaactcctgacctcatgatccgcccacctaggcctcccaaagtgctggaattacaggtgtgagccaccgcgtccagcctatttttattttttgagattagctctcactctgtcacccaggctggagcacagtggtgcaatcacggctcactgcagtcttaacttcctgggctctagcgattctcccacctcagcctcccgaatagctgagacctcaggcgtgttccaccgtccccagctaacttttgtattttttggtagaggtggggtttcactatgttgctgaggctggcattaaactcctgacctcaagagatccacctgccttggcctcccaatgtgctgggattagaggcatgagccaccacgtcctgccctaaacagacgttttaattacgcttgtcaagtcctcttgtgaaatattcatctgcagtgacttggtaaatgtgtttgctaccacacaggataaacagtgtacagacaaacatttgacatacctatgttaccacagtgtaagaatgaatttggatctgaggtcgctaagatgcaggcgtttatcttacctccctccagcaccggcatggctgtggggaaggcctccctcctccctctgaagttcttgtcgccatcagtagactggacatctgcctacaaccgacttcacagaaaggacctgacacctggcatgcttctcgtgtgcttgagagcctgtgtttgtgtggaaagcagggatgttctcattcacaccatgggaagagaagaatgttgcgagtaacaatcagtactttttttttttttttttttttttgtgagacagagtcttgctttgtcacccaggctggagtacggtggcgcgatcttggctcactgcaagctctgcctcccgggttcacgccattctcctgcatcagcctcccgagcagctgggactacaggcgcatgccaccatgcccagctaatttttgtatttttagtagagacagggtttcaccatgttggccaggatggtctcgatctcttgatccactgcgcccagccaggaacttcttttttttttttgagacggagtctcactgtgtcgccaggctagactgctgtagtgcgatctcggctcactgcaacctccaactccctggttcaagggattctcctgcctctgcctcctgagtagctgggattacaggcgtgtgccaccacacccagctaaattttgtatttttaatagagatggggtttcactatgttggccaggatggtctcgatctcctgaccttgtgatccgctcgcctcggcctcccagagtgttgggattacaggcatgagccactacacccggcctggaacttctctctctttttttttttttgagacggagtctcgctcagtcacccaggctggagtgcagtggcaccatctcggctcgctgcaagctccgtctcctgggttcatgccattctcctgcctcagcctcccgagtagctgggactacaggcgcccaccactatgcccggctaatttttttgtatttttagtagagatggggtttcaccgtgttagccaggatggtctcgatctcctgacctcgtgatctgcctgcctcagcctcccaaagtgctgggattacaggcgtgggccgcggcacccggcccaggaacttctcttatatctagaagccaccggatgttaactaagagtcctgggaagaaatggtagtcatttaaagcttttttaagagggaagacttgcactgggtcttaatgaaaatacataggacaaaatttttccttctgtatcagctcacgtaatctttctggcaatctcatgaagtaaattttagcagatagagtagacacagatgtaacatgacttttccaagatcacacacctaggaggaaggaccagaaatggagctcttcccatgttgaatatctgaatctaatgatctttgcactatgccataggacaggtggccaggaaagcatctgagactgggtgatgtaagggctggatacagagacagaaaaaagcaggcagtgtaacaggaaggaacgcagctagctatggtagatgggatgttgttttcaattcctcattccctattgccatgtgaccttgcagtgcacgaaatggggggagtaggattcctgtcccactgatgttggttggcttcagtcaaacattattattattattttgagatggagtcttgctctgtcgctaggctggagtgcagtggcacgatctcggctcactgcaacctctgcctcctgggttcaagcaattcttctgcctcagcctcccgattagctggtactacaggagcacgccaccacacccagctaatttttgtatatataaattttttttagttgagacagggtttcaccatgttggccaggatggcctcaatctcttgaccttgtgatccgcccgccttggcctcccaacgtgctgggattacaggcgtgagccattgcacctggccaaccaaacttattttttaaggtgggtagaagccatagtgtacagatctggagattggccttaagaggtgttgagcatgtcatcagcccttgtcacaagtttatgccctgagtagctgttggatcatggaaagtgaaaggcacttgaaacagacctgaactcagcctgaagccaagcctgctgaccctcagcctgaaacaaagctgtccaagcctgctgaccctcagtttgaaacaaagctgtccaagcctactgactctcagtttgaaacacagctgtccagctagaccatagtcacctacagtctcatgagcatggcactgaatgctttgttgtaaggcactgagttttgggctggtttactaggtagccttttttgcagc

SEQ ID NO: 607 - DNA, 9064 bp, Homo sapiens
aaaaagaaatacctgctcagtaaaaatttcctgtgtgaagattgtcttcatcctgctcaaggagcttggcttaattacaatctaaaattaccaaaagaattccaacagcatgtaaaaatatatgaaacacaatttattctagggaacttatctaaaatggctatgatacacataaatgttcaaatgttcaagtactctactctgttttagaagtgctttcccaaacccaacattaaagtgttaatactcaaaaacagaaccaatataaaaagcacttaataaatactattattggcattttcagtcggttgggggaaacagattatttactacatggagctaggatagctgcccctctgtgaggccaagagaaatatgtgtgtgtgtgtatgtgtgtgtctgtgtctgtatatacgcacatatacacacacaaatatatgtatatatgtatatgtacagatagacacacatacactttttgcacatatcacaccatacaccaaaagaaactccaagtagattaaaatgttcaaatgtaaaacatgaaaccaccaaaaaaaactagaagaaaatataagtgaccacttatataaacccaagaaaggaaaacatttctaagcataagagcaaaatagaaaacacaaaaagaacatttacagccaggtgcagtggttcacgcctgtaatcccagcactttgggaggccgaggagggcagatcacaaggtcaggagatcgacaccatcctggctaacacagtgaaaccccatctctactaaaaatacaaaaattagccgggcgtggcggtatgtgcctgtagtcccagctgctggggaggctgaggcaggagaatggcatgaacctgggagacggagcttgcagtgagccgagatcgcaccactgcactctagcctgggcgacagagcaagactccatctcaaaaaaaaaaaacaaaaaaaaaacatttaatatactacataaaaataataatgataataatttccacatggcgaagttaaatggcaaaaaatactggaaaaagtcaattataacatattgaactctccacttttaaagatactataagatatgtcactgatttaatattacagtagcttttcaagaaaaaagtaggagttggaacactaccactttcatattacatgtcaactgtaaaatgaatcccaatttcaatactgggtaaaatatacgtcttgaaatatatgaagtaagatgtataaggcataatgacatatctttccttttgaatcagtgaaagaaaaaaataaatcaaagtccctacaggaaaattaggatactgatcagcttttcacaaaagaaataaacaagccaaaacacataaattttaaatactaagtttcactagtaatcaaagaaattcaaactaagtgataccactgttcatcaaccaaatttgcaaagattaaaaaaaaatagtaatgctcagtcatgttgaaagtttagaaaaacagtagttcttactaacggtaagagttaaactgatacaatctttcgaaaagataatctgacagtactcatgaaacaccttaacatagtcatacacttttccttagcaattaccttctagaaatttatcctaagaaaataatccaacaggtgtatgaagagatacatgtgggtgcctatgtgtgtatttacataaacaaggacattcctctaagcattatacagaaactagaaaatctacatgggaaataataagggacctattaagaagatcaaacaatggactataagacaatgcagtcattaaaaattatactgtattataatatttattgatatgagtaaatgctcatcatatattaatttttttaaatcatcaaatatgtacgtcactttaaagaaagaacagacatcagaatattaatagtagtatactaggtatctctgaatcatggaattataagatatctttcccttttctgtgctttccaaggtttttgcatgagtatctattattttagtaaatacaggtttcaaaatgcatttttctaagcgctcttgataaaacttctattaaacaattaaaattacttaaatgaaaacaatctatttacactacaacaaaatgtccagcttagaaacacctttttttttttagaaagaagttaaaagaaaattaccttcatccccaaagtggaacagaccaagtcaatgatagcactaagctggttgctgtgaaagtacatagccaccaataataacatctccccaaaagaagcagagacgcctgaagtactgtcaaaacaaaataggaaatatgaattttccaaagagagaagaagaaaagctttctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagc

SEQ ID NO: 608 - DNA, 9383 bp, Homo sapiens
aaaaagaaatacctgctcagtaaaaatttcctgtgtgaagattgtcttcatcctgctcaaggagcttggcttaattacaatctaaaattaccaaaagaattccaacagcatgtaaaaatatatgaaacacaatttattctagggaacttatctaaaatggctatgatacacataaatgttcaaatgttcaagtactctactctgttttagaagtgctttcccaaacccaacattaaagtgttaatactcaaaaacagaaccaatataaaaagcacttaataaatactattattggcattttcagtcggttgggggaaacagattatttactacatggagctaggatagctgcccctctgtgaggccaagagaaatatgtgtgtgtgtgtatgtgtgtgtctgtgtctgtatatacgcacatatacacacacaaatatatgtatatatgtatatgtacagatagacacacatacactttttgcacatatcacaccatacaccaaaagaaactccaagtagattaaaatgttcaaatgtaaaacatgaaaccaccaaaaaaaactagaagaaaatataagtgaccacttatataaacccaagaaaggaaaacatttctaagcataagagcaaaatagaaaacacaaaaagaacatttacagccaggtgcagtggttcacgcctgtaatcccagcactttgggaggccgaggagggcagatcacaaggtcaggagatcgacaccatcctggctaacacagtgaaaccccatctctactaaaaatacaaaaattagccgggcgtggcggtatgtgcctgtagtcccagctgctggggaggctgaggcaggagaatggcatgaacctgggagacggagcttgcagtgagccgagatcgcaccactgcactctagcctgggcgacagagcaagactccatctcaaaaaaaaaaaacaaaaaaaaaacatttaatatactacataaaaataataatgataataatttccacatggcgaagttaaatggcaaaaaatactggaaaaagtcaattataacatattgaactctccacttttaaagatactataagatatgtcactgatttaatattacagtagcttttcaagaaaaaagtaggagttggaacactaccactttcatattacatgtcaactgtaaaatgaatcccaatttcaatactgggtaaaatatacgtcttgaaatatatgaagtaagatgtataaggcataatgacatatctttccttttgaatcagtgaaagaaaaaaataaatcaaagtccctacaggaaaattaggatactgatcagcttttcacaaaagaaataaacaagccaaaacacataaattttaaatactaagtttcactagtaatcaaagaaattcaaactaagtgataccactgttcatcaaccaaatttgcaaagattaaaaaaaaatagtaatgctcagtcatgttgaaagtttagaaaaacagtagttcttactaacggtaagagttaaactgatacaatctttcgaaaagataatctgacagtactcatgaaacaccttaacatagtcatacacttttccttagcaattaccttctagaaatttatcctaagaaaataatccaacaggtgtatgaagagatacatgtgggtgcctatgtgtgtatttacataaacaaggacattcctctaagcattatacagaaactagaaaatctacatgggaaataataagggacctattaagaagatcaaacaatggactataagacaatgcagtcattaaaaattatactgtattataatatttattgatatgagtaaatgctcatcatatattaatttttttaaatcatcaaatatgtacgtcactttaaagaaagaacagacatcagaatattaatagtagtatactaggtatctctgaatcatggaattataagatatctttcccttttctgtgctttccaaggtttttgcatgagtatctattattttagtaaatacaggtttcaaaatgcatttttctaagcgctcttgataaaacttctattaaacaattaaaattacttaaatgaaaacaatctatttacactacaacaaaatgtccagcttagaaacacctttttttttttagaaagaagttaaaagaaaattaccttcatccccaaagtggaacagaccaagtcaatgatagcactaagctggttgctgtgaaagtacatagccaccaataataacatctccccaaaagaagcagagacgcctgaagtactgtcaaaacaaaataggaaatatgaattttccaaagagagaagaagaaaagctttctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagcttttgtagaaaactcttatctaatgctatacaattttattgagtaaataaaagtaaaccttgagaaaatggagcaacttatatagttaggtacctgacaagtgtagaaaaggccagtagcatacaaaaggaaagtgaaacaaagcgaaccccagctggcgtagcaggaggacggctcgtcatcaactgcagtaattgctcagcttcttcttcagttggtctaaaaaggaatacatcattaggctttacatttttagttgggatgaagaagaaaaagtgaatttttaaccttttagttacaaattttaaactttataatg

SEQ ID NO: 609 - DNA, 6727 bp, Homo sapiens
ctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagc

SEQ ID NO: 610 - DNA, 5404 bp, Homo sapiens
tcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagc

SEQ ID NO: 611 - DNA, 56836 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttttaacatctgctatagtcctgatgctgaagaatcatggagtcaaaggtttcagcctctttccaagggggagagcacatggacaattaccatctcatgcaggcatttggttttatggactcacatgcttgttacaaaaccagacacagctttagggcttgttattaccttcccccaacccatccttggtagaagacagtcaacaaatgatatctaagctgccaacacatattggaaaatgtttgaaacttgagatctgtggtttattatgaaacacgcagtgccctggagtttgaatttcttcccggttggtcttagtaccctgtctacagattgaggggaaagggcaggaaggggagtaagtgtagttaagagcatagccttggccaggtgcggtgtctcacgcctgtaatcccagcacattgggaggccgaggttggtggatcgcttgaggtcacgagttcaagaccagcctggtcaacatggtgaaacccccatctctactaaaaatacaaaagttagccaggtgtggtggtgggtgcctataatcccagctactcaggaggttgaggcaggagagtcacttgaacccgggaggcagaggtttcagtgagccgagattgtgccactgcattccagcctgggtgacagagtgagactgtctcaaaaaaaaaaaaaaaaaaaaaagagtcaaacagatctgactactacatctgtgatctgtgctaggtcctttcagtggttgaaccttaatggttgtgactctctgtttgctcatatgtaaaatgtggatgatcatagaacctttatcacagatttgtgaagactgcatagcacactccatgaaaagttctccttagcacagcatcaggcacagggaagctcaacgccttgaaggtgctgtttttatttctaggtccctaagatcttcctcgtcctccttatggctcccccctttattctccatatttgttccttccttgaaagtcaagggtgcaggaagaagatgatatcctggaggccaagcccacacaattaggacatgtagtggacatttacctgttcttagatccactgctgctcttcctctgcttgtctatcacaaggggctgacacctgcacactaattctgtcttgagggagactgtgtaggggaacatggccatttgagttcattaggaaagggttttgaggtcaggacatgggtatttggtgtacatgggagtttggtggcctctattgtaggaggctttggaaatgtgtattgttgggaggtcctgagggaggaagtttgggatgaacatggagattctaggctgtggaggaagatgtaacatggctattggaggattctgggaccttaccttggtaccttggtaatgaggacatcttcagctttatttttatgtatttacttttttttgagatggagtctcactctgtcacccaggctcgagtgcagtggcgtgatctcaaaatactaaaaattagctggttgtgttggtgggcacctgtaatcccagctacttgggaagctgaggcaggagaatcgcttgaacctgggaggcagtggttgcagtgagctgagatcatgtggctgcacctcagcctgggtgacagagtgagactctgtctcaaaaaaaaaaaaatgttcatgcctcagctgctcagccagtagtcattcttttctcagtagctgttttctcctcagctttgtggagtctttccctcagcctgtgcagctctgtattcagccaatgatttgaggccactgtaagcagctctttccctttggagctctttttgtaagcaaaagctcagtttcttacgtaagaaaacccaattccccttgaggaagagaaagagctggagtcctttaaaattaactgcctgtttttctgtggctagggagccttatctctccctttgccaggcattgtgaagactctgtttctctagctgtgcagctgcaaggtcactagacagataatctcaagtcgtaaaatatgccgttccttgaaaagtaagaaatgatgtaatgcatgtctcaactggataagtgtctttgtttctcgattctgttttatgcttccccctgcacagatctcctcctgcaccagaagtgcttaaaaggtaactggactctttgtttggggctcagtcattttggatgttgatctgactgggccggtgcacctaaataataataagaaatcctcctcaacccctcagtctctctgattcctaaattatctcactgcaaaggcaagataattgcttgagcccaggagtctgagaccaacctgggcgacatagtgagatcctgtctctacaaaagattaaaaaaattagccgggcattgtggcgcatgcctgtggtcccagctactcgggaggctgaggtggaaggattgcttgagcccaagaggtcctggctatggtgagctatgatcacaccactgccttccagcctgagtgacagagcaagaccttgtctcaaaaaaaaaaaaaaaaaaattgggctgggcatgatggctcaggcctgtaatcccagcactttgggaggctgaggtgggtggatcacctaaggtcaggagttcaagaccagcctgaccaatgtggtgaaaccctgtctctactgaaaaatacaaaaattagccaggtgtggttgtgtgcacctgtagtcccagctactcgggaggctgagacaggggcctaggattaaataaggagttttggcaaaactaggctggaactccaaaacctgctacgtaagtactcacgagggttgctagttattagtattattactttgttgttatttttaggagtggagcaggttgtatttgtatcttacatcaccggctctggtcagatttcaattaatgtcacagataggatttaaacatttcttttattatttttaagattttaggccaggcacggtggctcccagcactttgggaggctgaggggggtggatcaccagaggtcaggggttcgagaccagcctggccaacatagtgaaactccgtctctactaaaaatacaaaaaaaattagctgggcatggtggcacgtgcctgtaaccccagctattcgggaggctgaggccaggagtttgagactagcctgggcaaatagtgagaacttgtctctaccaaaacaaaacaaaacaaccaacaacattaggccaggcgtggtggctcacacctgtaatcccagtactttggggggccgaggcaggcagtggattgcctgaggtcaggagtttgagaccagcctgggcaacatagtgaaaccccgtctctactaaaagtacaaaaattagctgggcatggtggtggggcaccaggaatctcaggacttgggaggctgaggcaggagaatcgcttgaacctgggaggtggaggttgcagtgagccatgatctggccattgcactcctgcctgggtgacgaaagtgaaattccatctcaaaaaaaaaaaagttagctggatgctggatgtggtggcatgtgcctatagtcagccactcagaagactgaggtgggaggatcacttgagtctaggagttcaaggctgcagggagccgtgatcataccactgcactccagcctgggcaacacagcagactctgtctcaataaaaaaaaaaaaaaaaagcgcagaagaatattagtttatggagagtattatttaatctttagaaattttctgtacaaaacaaacaatggaaaataagaaatgcattactctataataaaatatagccttttctctctcacatatatatgaatggataaaaacagtcataacttcctacacatttaatcctctatactagcttccatacccatttaccactccctcaaagacaaacataccaaaaagatgctaagtaaatgaacaaaatacttggtattcttaactatctaaagtattgtacttaacaggtattttcttggctgactggttctccatacccaacaaacacagtgatgtcagctctcaccactcacattaaacaatatagccattgctgtaaagtacaaaagagaaatgcagtacaaattgaaaaggaggaaataaaacttttattcatcgttgatattatcagatacataaaatcccaaggagacaaaagctactactaatgagattagaaggatcccagaaacagacacagacatgcacacacacctccccacagacacagatacacactcacaacacactcagaagtacattttattttattttgagacagtctcgctgtgtcacccaggctggagtgcagtggctccatctcagctcactgcaacctccgcctcccgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcactttggcttcacaaagtgctaggattacaggcgtgagccaccacgcccagccagaagtatcttttaaacaggatttttaaaagtgagagttgaccctttccataatctggagttgggatgggcattagtggtttggagaggaaagagcaggtgtgttgtggctgggaggcgattcctttcagcaccttgggtgatgtctgaggccatacccactttctgtgctagttttgggattatgatgattaacccacactccctttgttcctcccatgtaagctggattcttgggcattcaaccaatattaaacccttcctctgaaaaattcctggattgacgagaccacactggacccattttcattccctgtcgtgatcaataggtatcaaaagaaatgatagcttcttagaatagaaatttgcagccactggggaatgtagttcttaatgtgaatacagaagaatctcattataaaattctgtatggctctgaatttaagattttgttaatttttattttttttgagacatggtttctctctgtcactcaggctggagtgcagtggcacaatctcggctcactgcagcctctgcttcccaggctgaagcgatcctcccacctcatcctcccacctcatcctcctgagtagctgggaccataggcgcacacttccacgcccggctaatttttttgtgtttctgtattttgccaagttgcccagctagtcttgaacttctgagctcaagcgatctatccactttggcctctcaaagtgttgggattacaggtgtgagccactgtgcacggccaggatttaagattttaggggatattgaaagcctttgattataataccattgaaaacacaaaatacttaaagataaaattaacaaaagttatgcaatagtgtaactacaaatcattgatgagagagattaaatatctaaataaagagatatatcatggccacgaattagaagacttaatattgttaagatgtcagttcttctgaaattgatcaatagattatttgtaatctcaatcaaaatttcagcaggctgtctttgttttggtataagttaataacatgattttaaaattctaagctgtggctgggcaaggtatctcacgcctgtaatcccagcactttgggaggctggggcgggcggttcaccttaggtcaggagcttgagaccagcttggccaacatggcaaaaccctgtttctactaaaaatacaaaaatgagctgggcatggtgttgggcacttgtaatcccagctactcgggaggctgaggcaggagaatcacttgaacccaggaggcagaggttacagtgagccgagttcgtgccactgcactccagcctgggtgacagagagagactctgcctcaaaaaaaaaaaaaattctaagatgtatatcttttacaactaccagtcaaagtaattataaaagagtaacaaattcagagggctcaccttattttaccataaagtagtgtaggcatatactgatcaattaaatagaaaagaaggtctagaaacagacacttatatgatcaatggatttttgattaagatgccaaagctattcaatgggagaaaggaaagtcttttaatgaaagtgttggaataactgaatttccttaaggaaaaaatatgcttttgctcttatttcactctatatttaaaaattaactcataatgactcagacttaaaagtaaaagctataactgaattcttcaaaagaaagcataggagaaaatctttatgaacttggggtagacaaagatttttaaaatgaaaagattgatcatagttctttatttggaaattaaaataaaaatgccataagcaatgacacaaaaaatggcatacctagcattacatttggcttacatttagtgtaagatctatacagtaaaatccgctaaatattgctgtgtcatgttgaggaattttttccttccttcccttcctccctccctccctccctctttcttttcttttccttttttattttctttcctcttttctctctctctttctttctttctttctttctttctttctttctttctttctttttcttcctccctcccttccttccttcctttctccctcctttcctctctccctcccttttattttccttccttccttccttccttctccctctcttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcatctggccaatcttttctttttctttcataaaagttgtactatttatgaagtacatgtgatattttgacacatagacacaatgtgtaataatcgaataaaagaaattcggatatccataacttcaggcatttatcatttctttgtattaggcacattccaattccactctcagttattttgaaatatactaaaaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttggctctcccataggagtgagaacatgtggcctttgtcttcctgtgcctggcttgtttcacttaacataatgtccttcagttgcaactgtgttgtaaatgcaggatctcattcatttttatgactgaatagtactcctttttgtgaatgtaccacattttctttatccattcatctgttgatggacagtcaggttatttccaaatcttggctactgtgaatagtgctgcagtaaacatgggagtgtggatatatcttggatatactgatttcttttctttggatatatacagtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaaaccatttgaactagggtgagatgacatctcattgtagttttgatttgcatttgtctgatgataattatgttgagcactgatatggtttggatctgtgtccccaccaaatctcatgttgaattgtagctcccagtgttggaggtggggtctgctggagggtggttggatttctcatgaatggtttcatactgtcctcttggtgctgttcttgtgatagtgagtgagttctcatgagatttggttatttaaaagcgtacagcacctccccgctcactctctcttgctcctgcttccgccatctaagatgccttactccctctttgctttctgccatgattggcagtttcttgaggcctctccagaagcagaagctgctatgcttcctatacagcctacaaaactgtaagccaattaaaactcttttctttataaattacccagtctcaggtatttctctgtagcagcatgagaacggattaatacaagtctcaggtatttcttttcttttttttttgagatggagtctcactctgttgcccaggagtgcagtggtgtgatctcggctcactacaacctccgcctcccaggttcaagcaattctcatgcctcagcctcccaagtagctgggactacaggcgcccaacaccacgcctggctaattcttttgtatttttagtagagacagggtttcaccatgttggccaggctggtttcgaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttactcatttttaaattggattattagatttttttcctattgagttgtttgagctccttattttttttgtcaattattctttgtcagatggaaaacttgcagatatttattttctcccactctgtaggttgtctcttcactttgttgattgtttcctttgctgtgcagaagcgttttaacttgatgtgatcccatttgtctatttttgctttggttgcctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccaattttcttggcatcatttattgaagggactattatttccccaatgtatgaatgttcttggcacctttgtagaaaatgagttcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaagatagctttggctactctagatcttttgtggttctgtttaaattttagaattgttttttctatttctgtgaagaatgtcattggtattttgataggaattgcattgaatctgcagattgctttgagtagtatgaacattttgacaatattgcttcttctaatccatgaacacagaatatcttttcaatttttggtgtcctcttcaatttcttttatcagtgttttatagttttcattatagagatcctttacttctttggttaattcctaggtatttcattgtattgcagctactgtaaatgagatcacttttgttttgagataaggtcttgctctgtcacgcagagctggagtgcagtgatgtgatcttggctcactgcagcctagacctcctgggctcaagagattctcctactttggcctcccaggtagctgggattacaggcgcacaccaccaggcccagctaatttttaaaatatttgtagtagagatggggttttgacatgttgcccaggctggatttttaaaaatttcttttttaaattgtttgctgttggcagatagaaatgctagtgatttttgtatgttgattttgtatcctgcaactttactgaatttgtttatcagttctaatagtttttttgtggagcctttaggtttttccaaatataggatcatatcatctacaaacaaggataatttgacttctccctttccaatttggatgcgttttttttccttctcttgtctaattgctctagctaggacttctggtactatgtcaaataacagtggtgaaagtgggcatctttgtcatgttccagatcttagaggaagactttcagttattccccattcaatatgatattagctgtgggtctgtcattcatggcttttattatgttgagatatcttcctgctatacctagttttttgagggcttttattatgaatggatgttgaattccatcaaatgctttttcagcatcagttgagatgatcatatggtttttcttcttcattctgttgttatgatgtatcacactgattgatctgaggtgccacctcagttgcaatagaatagagcaccaggtagattgctaaggccctggctcctggacagcatctctattcctccctggggcctggaagaactcaccaccccaaagggaagaacaaaaacctccctcctccctaaactcctggcaactactatcttgtactgtcttcacagtttcatttctccagaatgtcatatagttggaatcatatagtatgtggccttttcagactggcttctttcacttagctacatacatttcaggttcttccatgtccttctgtggcctgatttctttttattgccaaatcatatttcttttctttctttctttcttttttttggcttttttttttttttttgagacaaaatctcactgtgtcacccaggctggaatgcagtggctccatctcagctcactgcaacctccgcctcatgggttcaggcaattctcccacctcagcctcccaagtagctgcaactgcaggtgcatgccaccgtgcccagcttatttttgtatttttagtagagatgggtttcaccatgttggccaggctggtctcaaaatcctgacctcaagtgatctgcccgcctcggcctccgatagtgctgtaattacaggtgtgagccatcatgccctgccatatttcattgtatgaacatatcacagttcatttatccattcacttgttgaagaacatcttggttgcttacaagatttggcaattatgaataaagctgctataaacatctgtgcagaggtttttgtgtgactgtatgttttcaactcatttgggttaataccgaagagcatgattgctgtagcacatggtaagaatatgtttagctttgcaagaaaccgccaatttgtcttccaaagtagctgtgccattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctactgttgagttttaacagttctttgtgtattttgaatgtaagtcccttatcaggtatgtcccctgcaaatatgttctcctagtctgtagcttatattgtcattctcttgacaattcttttgcagagcagaagcttttaattttaatgacacagaacttatcaattgcttctttcaaggattgtgcttttggtgttgtatctaataagtcatcaccaaacttaaggtcatctagattttctcctacgttatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaatgggtggtttttaagaatgtgtctagagggctatgggcacagatctgtgttcaaagattttctgggcacttatgttttgtgagacatcagatagagccaactttctaagcctcagctttgtcacgtgtaaaatgggcatgaacgcttttccccttcgcagaggtttgtggcaattaagtgaggtgagcgtgcaatagtttttgaacaaaggtgacacgggggtacgtgctcaggaaataagagctgctattattactactcttcatagcataatgtaaggtttcccttcctctcatcccagctcggaagcaccttatcaaggtgaactgagccgcttctgtttcttctcttccctctagccaccacgccccttcctttcccgcatcttccccccattcttatacccgcctcttccgcgaaccccgccctgaccccgcctttccctggccccgcccaccagacctgcaccggcacagccctcgctcagcggggcaggaagctcatggtgtagtttcgtgggatcgtggcaaagaccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaggggtggaatattatggcctgagagagtttcagaggaggctctgatcctccctgagcctcagtttctttctacaagagatgtaacaatggtgaaccaatattgatatattattactaacaaagtccatagtttacactagggtttactctgtgttatacagttctatgggttttgaaaaaggcataatgtcacacatccatcatagatggggtgatccatgccaggtgtagcaatgggaggtttagatgtccttcttgccagatacacttgcaaatatgactgctgtgccgtcatctcctttttagggatctgaggaatctgctgtgtgaccctagagaaatacatctacggggaaagatgtttcctttccttttacctgggtgcaggtactgggtgcttggtagttaaggaagtatcagctgctggctcaagggtagattctaacaggaacttccaagctggagaaataccaggctacaccgcagagaggggaggtgggtgagggaggcgcctgctggtgtgagcagtggcctggcagcaaacagtggtctcttaccgatggaaaagggcacaaaagcatcactcttcttaaactgccccttgtcatccaggaaatgctggggattgaagtcctgagggttggagaagaagctggggtctctcagcacggagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctgtgaaggaggagctttggggaatagaaggttcacatctctgaaacaggaagtttgggagacatggggtccatgtcttgctacgcaggttgtttgggggacctgaaatttgtgtccctaagacaaaaggcctaatggaaagggggcttctgtttcttaagataggaagttttggaacttgagtttgattctcccgacacaaagagtctggggagatgcaggactcaggagtgtctaagtggaaaggtggaatggatgtggtggttggggaagtcctttttgactgattgagggagtgggacagtgagtagaaagcttctaatgggggcaggattctggggacacagagaagggctggaagtccccgtagtctagggggtggggaggatagcaccttagggaggaaaaaatcccgaaacttggtgtcctttttaaccctgcgggccaaactcatggggatcacgtctccaaatctttggatctcgtggatcactgcctccatgtagggcatcttggtccggtcctcaaacttgggctgccggttcttgccgatcactctgtcaatctcctcatggaccttggctgggggaggagggggaatgtgtttaggtatctgggagtctcagagcaggaaatgatagtctgaataggtaaaacggggtggatgatacggctccccctatgagacggaggtagagcattcataacagaacagacatcggccattcgcattgttggagtaggatcctgttaaccaggttgtgccagaatcacaggggaggcacagggaggaacttaggagatgacccgggggaaggggcagcgggcactcagtgggcttgggacagaagtgactgaccaatcagtgcagacattttcaatattttaatagctaatgagactcagctgatgcctaccagctgaatgttgccctgtctctggacagcaaggcacgtctcagggtcctgggatctgggacaggtagggacattgcaccagtcgaaggggaattttgagggtctggggccctccacttccgtccccctccagccttaccctccacctctgggtgcttcatgagcagcaagaagccatagcgcagggtggtgctgaccgtctcggtgcctgcaatgaagaggttcaacgtgctcatcatcaggttcttcaagtagaactccgtgttggggttcttctcctcctgcagggagagggggctttaggccaacctcactcctcttgccctcagggcccttctagggcttttcctttggatctacctctctttggtccagaccaaaggtggaaagagggaccctagatctaccagactcgctctaggttccagcccttgccctggctgctggctttgcccaaaatgctctttcttctcaccttctttacgttgctgaccatctgtcctttaattatcaacttagctgtcagttttttttttcttacactgacttggtcttgctaagttgcacaggctggactcgaactcctgggctcaagcaatcctccacccttagcctcctgagtagctggaactgcacacgcgcatgaccatgcaggctcacttactttttaaacaattaattaattttttttgagacagggtctcattctgtcacccaggctggagtgcagtgccgtgatcttggctcattgcaacctctgccccccttcgcgccaccacgtgcagctaatttttggatttttagtagagacagggtttgaccatgttggccaggctggtcttgaactcctgacctcaggtgatccacctgcctcggcctcccaaagtgctgggattacaggctgttagccacggcgcccagccaattgtgaggattattatgatgagggctaatttgaacgggtctgtgtcgtctgcccgccccactcccagtctgatttccctctgcctggctttgcacctccccgcactggctgctggggtgtacctcctgcatgtggatgagaaaggagtcgatgaagtcctgtggggaattgggatccagcgtgcgctggttgtgctccaccttcttggctatgaagtcctccagcccttgcagcaacttaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcattgtttaggtatttcagtggggtcggataggaacttatatctaagttttcaggaaggttaggtaccagggccacggtctagtaatttaggtgagaagaactgaggcatatatccaggtttcaggtatgcaaatgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgttcaggtattaaagtggggctggtgaagatgttgaagtgcaggggatacctgttgaggtgtttacctatccaagtgcgatgcacagggagcacctctgtaaggtgtgtgattggaaagggttggggaacacttatttgtgtgtcagggaacaatctgtctagatatttgtgtgtttaaggtgttggttagggcagctgtccatgttttcaggcatttaagtgggtgaagtagagggcgcttggccagatattccagtgggctaatctgggacatttgtgtagatgtgaaatgattatgatgggctggattttgcagcaccaggtgttcaggcatgcaggaggcgggttgacgcagtcatttgtccaggtgttaaaatattcagaagaactgggtagggagcatctgttagaaattacggtaagttggggatgggaacacgtgcccaggtgagagagctgagctgagggtatgtatcctaccagcaggctctgttttggggagcatctgttgagctatccaggtgtccttggagacaggcttctggtgcaactgtccagttgtccaatatcgggggctgattttgaggggacactgtctggagcggggtgggagtttggggcacctgtctccaggtaggggagcagttggcaggttgtggtaggggcgtcacgggccgggctgcagccagttacctgccccgtggaggttgacgtgaactggaagattcctagcatcatgctcagcagtgacaggaactctttgtcctcatagtcaaagcggtccccaaagacaatggagctgatgacattggagactgtgcggctcaggaagaaggtgggatcgatattggcgcctgcgggtgtggagggagaagggggttggggagagagtcaactcagaggtctgaggagaatcagaattccaggaggcagggccttgttgagccaaattcccagcgccagactccagggctggaagtgcgggcgcctttccccacctagtccccatccgcaggcagaacgcgcgcgggttcctcgtcctgggtgttttccttctcctgcccccgcactcggggaaccttactcaccgtgcgtgctccggatggcctcgatgaggaagcccgactcctcctggatgcgctcctcgatgcctcgcttgcccaccccgaagtccctcagggtggcgatggcaaagcgcaggagctgcttggcgcgctccccgttgctgaacgccacgcctggggaggtcaaggcgggggtggagagaggtcagggggcggcggtggcaggagcggaccagttccaaggggctccccaagggtggagcagaggggtagtggggtgggagagagatggattcagtgccagtgcccaggacaggtgcaaactcagtcagagaaacacgagggagagagagagagagagagagagagagagagagagagagagagagagagagagagagagagagaccgggtagaaagaataagagaatcagaagagaaacagaaaggccagatagagatgcgcagagaaacagagggataaggggatactccatggaggaagggtaggaagtggggagagaaagagagagatggaggaagaggatggagggaggggaagtgagatatggggagatctgggaggaggaaataaaaatggtgaaacattcttaagctgagctggagaagagagaaaaatactgagacagaaacagagagggtctggaaggaagagagactgttaccaggagatggaggctggagatgtggaagtaagaatagcatgaaatcctaagggagaggaaaaagtgagagagggaagtggagagaggagaaacatggagaagcacagaagctgagagcaacaaaaagacaaatgaagacagaggaccagggctggaaaacagaaacccaggatgtcctcagagatggagagagaggggaaagaggagactccagtgagagagaataaggaggtggggcagagagaggcagggaggaatcacgacagggacgctggagacaggtgagggatacacatggagaggccacagtgaagggagatggggagataagaccagaccgggggttctgccatagcctccagtgggcaggagagtcagggagaaggctggcaacactgagaccatcgtgtccgcctggccaccttccccatcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcactcactgaactgatggaggcgagtgggagtggttagagggagcagcccccactctgaatggggcccagcaccgagatgtcaagtactgggatccttcacccccaggttctcacagtcagggagctggacatcccaagatcctgtctttcctggctaggacccggatgctgaaactccaaaactccctttcctaagactctggtccacactggtcaatcccctgccacaaagccccagccaactaggcagcccccaccctgtgccacccatcttcctgccttgggacaccttcatgatggagtcacatatgtgctctgtgttcagctggaggtagtttccaatgaagggcagtggggtgggtcccggaggcagcttccccctgctcttcctctgctgccagacagacatcaagaccatcacagtcaggcaggccagcaaggccaccagaagcagccctgaggccagcatggtggtagtgagatgacagatggtgatgggtggggtggtttgcctttatactgcctgaaaaagagggatggactttggctaattacataatcaccttatttcacctcccaactacacgccccaccatgaatgccacctagcttgggacacagccagcaagggaggataaggggaccccagggcagctgaacagagagggggcctccagactaaatctgtggtacttcaggaggggtgccgcagggctgtggatttaggagggggcaaccgataaactgtagaactgaagagtttggaatatttgcataggggagcacttgggctttggatttggggtctgagagtgagaatgcaccccaaagttgtggatttgggcattccaagggagaggaatccaaaggtctgggttttattagggtgagatggaagtgtggctgtgcatctggaggtcttctgttgcggaggatgcagggttaagggtctcaggaggggggactccaggcatatggacttgaaagtctcggggctaggaagacccagggctgtgggtgtggagtttctgggaggaggagtgtgtagcaagccagcaggtgctcccagaaagcccagcagcccagcaatgggcccaggggctgacttgattttgcttttgcccagagctatctcttgatgcccagaatcctcattggaacctcagagtgaggccaggatgggtgccatggaacctccactgcccatctctggttgggaaaggggtggaagaccagggccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacatttgagggtgagttaagtctcctttaagggcgattcctgctttgtcaggggctactactattagcaggcagagggaacagtcgcagaagagattggggtaaactccagtgttaggcacagaggcagatcctggggtgggtgtgagtggagaagggatgagtagccctcctgtccttccttcagggaaattcttccttagtaaacaggacagttaccctttggtgagcatggtcatatatgggaagattaagtctaggtgtgtatgatctggttgaatctttgtaacagtgaggttggttcatcgtgatcatcctcattttgaagatgagcagatctagactccataaaccctcttgagtgaggtcacacagggagtaagtgagggagctgggatgtgaactttctcctcgccccccttcattgactggcctagatcaccctgggagtcaagtgcgggccagccttagcaggaggtgagtgctgagactggcatcagcagtggacacactgatgacattggcgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcataagggtggcaccatatagggtctgaggttggtcccagtgggctctgacatgagcatgaggcaggtgctgatattggtcctatgtgggtctgagatgagcctcagccagaccctgagaggggccccagatggccacaggacaggctctggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtggaaaggaagattagcaccagcttggcagatatcaatccctctaatcctgttcaccagcctgcacctgggcctggctcctccttttccttcttgtttcttaaaaaggtgggagacagaaatctgaggagtttgtttctcagtggggttggcactaagaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtatatgtgttaatgcagatgaggtacatggcagtaagtgctcaatgaatggtagttgttctctttaatctgtaggatgaagcagattgatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcgtgcatctttgttttgtgccattttgtccagtgggttctcctggatgcctctgccatgtttatcctcatttatacaactgtgtgtgtgtcattctgggtgcatgcttttagtgtctacgtgcatgtatgtttcagcacgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttttttgagacagagtcttgctctgtccccacgctggggggcagtggcatggtctcggctggaacctctgcctcccagatttacaccattctcctgcctcagcctgctgagtggctggggctacaggcgcctgccaccatgcctggctaattttttgtatttttagtagagatggggtttcaccatgttagccaggatggtctcgatctcctgacctcgtgatccgcccgcctgggactcccaaggtgctgggattacaggtgtgagccaccgtgcccggccagtatgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaatttttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacgcagctcatttttgtatttttagtagacacggggttcaccatgtttgtcaggctggtttcaaactcctgacctcaggtgatctgcccacttcggcctcccaaagtgctgggattacaggcatgagctaccatgcctggctgtgaatgtaagtttcatgctgttaatcaccactttggactgctaggccccacctgtttttctttatgaaacattagaaaaactgcttgtactctcttgtgtttcttcaaatacttccatgtaaacatgtaacaaaggatttcaaaatgttagaaaaaaaagtcttttaataggagggagacttgaccttctgtagtgtttgcactttttggaagcttaaccaaagacctagttggccagtatacccctcatgccattggcaatgaagcagtgggggagttggggtactagttgttgtggccagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccagtaaaatggcaggacttagagttcagagatgggaaagaagttggatagatgatagggatgaacagctttttttttttttttcttttgaggtggagtcttgctctgttgcccaggctggaatgcaatggtgcaatctttttttttttttttttttgagatggagtcttgctctgttgcccaagctggagtggagtgctacaatcttggctcactgcaagctccacctcccgggttcatgccattctcctgcctcagcctctgaagtagctgggactacaggcgcccaccactacgcccggctaattttttgtatttttagtagggactctgtctcaaaaacaagacaaacaaaaacaaacaaacatgatgcaactatatgctgcctataagaaactcattttacctgtaaagatgcatatagactgaaagtacatagatggaaaaagatattccatgtagacaaaaaccaacagcaagcagtagtagctataacttataccagttgaaacagattttaaggccgggcgggaacggtggttcatgcctgtaatcccagcactttgggaggctgaggtgggtggatcataaggtcaggagatcgagaccatcctggccaacacggtgaaaccctgtctctactaaaaatacaaaaattagccgggcgtgcacctgtagtcccagctactggggaggctgtggcaggagaaccactcgaacctgggaggcagaggttgcagtgagcagagatcgtgccactgcattccagcctaggcgacagagcgagactccgtctcaggaaaaaaaaaaaaaaaccattttaaatcaaaaacattaaaaataaaaacaaaacaaagtatgaacccgggggcgggggtggaggttgcagtgagccaagatcacaccagtgcactctagcctgggcaacagagcaagactccatctcaaaaaaaaaaaatattctggcagcatcacatttcttagtcccagaaggagggccatgtgactaggcaaaaaatgacccaggttccatttcatgcacacaccctctggagcacaaatctccttctctctatcccacttagacctgggtttctctcttgtccctgtatctctttgtttcgttgcctttctctttgttcatctccacctccaactttttgtctagttggatttctctgtgagccatgggtgcgtccactctttgggttcctcttgattctcttctcagccgtatgtcactttctcagtctctgtctcactgaaacttttttcctgtcttttattctttctgcttctatctccctctctctgtttctttgaattgtcttttgtctctgtgtcctccttgacatttatctttgactcactgaatctctctctctctcatctcaattttgttttgtttgctttgttttgtttttgagacagtctcgctcttgttgcccaggctggagtgcagtggtgcgatcttggctcactgcaacctccacctcccgggttcaagcagttctcctgcctcagcctcctgagtagctgggattacaggcgcccgccaccatgactggctaattgtgtgtgtgtgtgtgtgtgtgtgtgtgtgtgtgtgcatgtatttttagtagagacagggtttcaccatgttggccaggctgatctcgaactcttgacctcaggtgatccacctgctttggcctcccaaagtgctgggattacaggtgtgagtcactgtgcctgtcctcatctctattttgatctcactctggttctgtttctatgcacctcgattttgtctcaatcttgatttctgtctccatcacataatacctggcataatctgccatgctctgaatttctctgcctcaagtcctctgcaattatttttcctctttagcttgcttctactttttagttcaagttcctccactcctggcttcctatctggaggtggaatggtgaagggagctgttctaagagtatttgctctctcccttcccgtctgagtaggaaaaccagactcaccatcaccacacacatgccaccaccctgaatgggtgttaaatgctggggtgtgaggatcagaatgggatggggaggtgaaatctaagagagtcaaaggagatgggctgagctgagtctctactccaagaaagacattctagcagcagatccaagagacagaacgtggcactgtgtgtgagtcactcagttttcgtagaatttccactgcttctggacacaggatgcctcagctcagccagccaaaccccattcccaaaacttacagataccttgagggattcagtttccaagtctgagaatacagtcgtgtgaaaaggacattgaattttgataaatagtatatgtgggtaggatataatatccaggaagttcatttcaggccaataaggctttgaaaatatttggtgcggaaaaggtagtgaatcactttttagattattaaggaacacaatcactaattgcgctggaggagatgttctcctccagagactggggttcagaggtgatccctacaccttagagttttaaaacacacacacgcacacacaccaacacacaatacagcaaagttctttttttcttttttaaatttgatacagcaaagttctgatacaccaacacaagtaatctttgattattgttatttaacatcttgagtagaaaacaagaactttttgaacaaaacctgttcaattgatttatttctcttgttttctaaatcttcagcttactttccttattaacattctagtgttccattacacagtagggtagctgtagttaacgataatacattgcatatttcaaaatagttagaagagaggattttgaatgttcttaccacaaagaaatgataaatgtctcagtaatggatataataattacccgaatttgattgttatacatcgcatacatgtataaaaacatcacactgtaccccacaaatatgtacaattattatgtcaattaaaaaaatttaataactgtttaattagggttatacttaattaagtaacgaacaaagagttttccttgttgtctatcaagactttctaaaacaacatggtctgccagctgtggtggctcacgcctgtaattccagcactttgggaggctaacgggggggcgggtggtggatcacttgaggccaggagttcgaggccagcatggccaacatggtgaaaccacatctctacaaaaatacaaaaattagctggacatggtggtgtgcgcctgtagttctagctacttgggaggctgaggcatgagaatcgcttgaaccctggaggcagaagttgaaatgagattataccactacactccagcctgggtgacagagtgagaatctgtctcaaaaaataaaacaataaaaaaaaataaaacaacatggtttccctgtttgatagatggggaaacaagtcccagaggttaagtgactttcccagtgaagaaaagacagagctgccacttgtacccagattgtctggatcctaaaatcaatagcctaaaaagataataatttgcctcttacaccccaccaagaaattctgttcaattctgttgagctgagagggaagaacagggagactggaaatatgaagaaaggggaatggccccagaggatttccctgtgtgaattcaatttacctttattcaggtgggagattataggttatataaccacccccaatataaagcaatctcttccccgatgacactcaaacccggaaaacttgaatcccagggtgttcagattttggtataagctgatctcccaggacctacttaggcaggatctggtgcccaggacagaacctgttgacctggcaccatggagctgggaggggctgtcaccatctttctggcactccgcttgtcttgcctgctcatcctcattgcctggaaacgaatggataaggcaggaaagctgcccccaggtcctacaccaattcttttcctggggcacctgctgcaagttcgaactgatgctacgtttcagtctttcatgaaggtgagtctgtctgtctcctttaatagggctaaaagcaactaatcctatagccagattcacatagaaacttatgacttctaaaagatagactctcagaaacacagactttgcaaatctta

SEQ ID NO: 612 - DNA, 30931 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttttaacatctgctatagtcctgatgctgaagaatcatggagtcaaaggtttcagcctctttccaagggggagagcacatggacaattaccatctcatgcaggcatttggttttatggactcacatgcttgttacaaaaccagacacagctttagggcttgttattaccttcccccaacccatccttggtagaagacagtcaacaaatgatatctaagctgccaacacatattggaaaatgtttgaaacttgagatctgtggtttattatgaaacacgcagtgccctggagtttgaatttcttcccggttggtcttagtaccctgtctacagattgaggggaaagggcaggaaggggagtaagtgtagttaagagcatagccttggccaggtgcggtgtctcacgcctgtaatcccagcacattgggaggccgaggttggtggatcgcttgaggtcacgagttcaagaccagcctggtcaacatggtgaaacccccatctctactaaaaatacaaaagttagccaggtgtggtggtgggtgcctataatcccagctactcaggaggttgaggcaggagagtcacttgaacccgggaggcagaggtttcagtgagccgagattgtgccactgcattccagcctgggtgacagagtgagactgtctcaaaaaaaaaaaaaaaaaaaaaagagtcaaacagatctgactactacatctgtgatctgtgctaggtcctttcagtggttgaaccttaatggttgtgactctctgtttgctcatatgtaaaatgtggatgatcatagaacctttatcacagatttgtgaagactgcatagcacactccatgaaaagttctccttagcacagcatcaggcacagggaagctcaacgccttgaaggtgctgtttttatttctaggtccctaagatcttcctcgtcctccttatggctcccccctttattctccatatttgttccttccttgaaagtcaagggtgcaggaagaagatgatatcctggaggccaagcccacacaattaggacatgtagtggacatttacctgttcttagatccactgctgctcttcctctgcttgtctatcacaaggggctgacacctgcacactaattctgtcttgagggagactgtgtaggggaacatggccatttgagttcattaggaaagggttttgaggtcaggacatgggtatttggtgtacatgggagtttggtggcctctattgtaggaggctttggaaatgtgtattgttgggaggtcctgagggaggaagtttgggatgaacatggagattctaggctgtggaggaagatgtaacatggctattggaggattctgggaccttaccttggtaccttggtaatgaggacatcttcagctttatttttatgtatttacttttttttgagatggagtctcactctgtcacccaggctcgagtgcagtggcgtgatctcaaaatactaaaaattagctggttgtgttggtgggcacctgtaatcccagctacttgggaagctgaggcaggagaatcgcttgaacctgggaggcagtggttgcagtgagctgagatcatgtggctgcacctcagcctgggtgacagagtgagactctgtctcaaaaaaaaaaaaatgttcatgcctcagctgctcagccagtagtcattcttttctcagtagctgttttctcctcagctttgtggagtctttccctcagcctgtgcagctctgtattcagccaatgatttgaggccactgtaagcagctctttccctttggagctctttttgtaagcaaaagctcagtttcttacgtaagaaaacccaattccccttgaggaagagaaagagctggagtcctttaaaattaactgcctgtttttctgtggctagggagccttatctctccctttgccaggcattgtgaagactctgtttctctagctgtgcagctgcaaggtcactagacagataatctcaagtcgtaaaatatgccgttccttgaaaagtaagaaatgatgtaatgcatgtctcaactggataagtgtctttgtttctcgattctgttttatgcttccccctgcacagatctcctcctgcaccagaagtgcttaaaaggtaactggactctttgtttggggctcagtcattttggatgttgatctgactgggccggtgcacctaaataataataagaaatcctcctcaacccctcagtctctctgattcctaaattatctcactgcaaaggcaagataattgcttgagcccaggagtctgagaccaacctgggcgacatagtgagatcctgtctctacaaaagattaaaaaaattagccgggcattgtggcgcatgcctgtggtcccagctactcgggaggctgaggtggaaggattgcttgagcccaagaggtcctggctatggtgagctatgatcacaccactgccttccagcctgagtgacagagcaagaccttgtctcaaaaaaaaaaaaaaaaaaattgggctgggcatgatggctcaggcctgtaatcccagcactttgggaggctgaggtgggtggatcacctaaggtcaggagttcaagaccagcctgaccaatgtggtgaaaccctgtctctactgaaaaatacaaaaattagccaggtgtggttgtgtgcacctgtagtcccagctactcgggaggctgagacaggggcctaggattaaataaggagttttggcaaaactaggctggaactccaaaacctgctacgtaagtactcacgagggttgctagttattagtattattactttgttgttatttttaggagtggagca
